United States Patent 7,833,706 (GENETIC POLYMORPHISMS ASSOCIATED WITH RHEUMATOID ARTHRITIS, METHODS OF DETECTION AND USES THEREOF) - sequence listing, part 5

SEQ ID NO: 10647 - DNA, 118356 bp, Homo sapiens
  misc_feature (1)...(118356): n = A,T,C or G, or insertion/deletion polymorphism (see Tables 1-2)
atgtttaatgatgaagtcaaagtccacagagtcagcaagcaagtgtaaaaacctcaggagtctaaggacagtctacatttctccccagaaatggcctccctatgtactgttgaagggagagggtcctttcaaggggctccaagacgcagaagcaactgggctgcagctcgaaataaagatgtcctttctacctgcaggttccacgaagcctcacaggcaactttggtgatctcacctgagctaggaattcggttttttgatgtgggttctctttgagccattgtgtgagctttaaaatgtgatgtggagattttgctatactggtgtttccttgccggaatttgacatccatggtggctctggcttccctgtctggtcccaggaggaaatggagtgtcctgcactttttttcagcttcgctttgtgtaggaaggatcaggagacctggagtcagggcttcctccaatctcactctcctccataaaacagtgtctcctaagctttctgggggtgagggccttgacaccgtgctgttctgatgaatataactgtcccagctcctgaaataaaagcacaggtgcacaaaataccgactgttgcaagcaatgcctaggtggggatgtttcctaggcgccaggtttagcactttgactttgtatgtacacacacaggggccaggcattgtggtttatgcctgtaatctcagcactttgggaggctgaggcatgagaattgtttgaagccagaagttcaagaccagcatgggtaacaaagcaagacccagtctctacaaaaaaaaaaaaaaaaaaaaagggtatatatatacacaaacacacacacacacacacacacacacacacacacacacactgggtgtggtggctccagtctgtagtcccagctactcgagaagctgaggtgggaggattgcctgagtccaggagttggagcctgcagtaagctgtgatcaggacactgcagactgtcagagtgagaccctgtctcaaaaacaaacaaacaaaacaaaaatacatacacacacacacagccagagccagcgctgagggagaggctggactcaggggcggggtcacaggcgtttctcaggtccttctcgtggtctttgtctctttttcctggaggtgggggactctgtacttcatgaggagaagttgtctgaagaaggtgggagatactcaggagcagggtccagagagggaaaaggatgaggaagtggagacaaagcagagggggcaggacaagaggagagcacgcaaggaatggggatggggaggaccttccagctgtcagaaaggtcacccgcagaatttggctcttggtttttctgctttatcaggatggatttgggaaaccagccggagtgggagataaggagtctactttgcaaaggacacgtgtgagcctcctcctagtttgaactcatgagtagcagctaacagccaggacccttgtgtcgggcacgtgaggcccctttgcaaccagggcgttttctgcaccccaccagccacccctcctgggaccacgctggttccctccaaccctaacagggagagaaggaaggagaggtctggagggtttgggtcctcccttgtgctccttcttcctctgccatttattccctgagtgtcctcgcctttcctccgctacctggaccccactacagtaatgcacactggcctggactccctttgtaaccaccaagtgggttcatcttgccggctacctagacgaagccgatttatcaagacaggagaattgcaacagagaaagagtaattcatgcagagccagctgtgcgggagaccagagttttattactcaaatcagtctccccaaaaactctcatcagtttttaaggataatttggtggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggttcacaatagtgatgttaccttcaagagtaactggagaagttgcaaatcttatgacctctggaataatggctggtaatattcagaattccagcccctctcatcctaacttaatggccggtggcctttcttcgttttacaagaacagtttccctttaaactataaactaaattccttcccaaggctagttcagcctacgcctagaaatgaagaagggcagtttagcggttggaagcaagatggggtcagttaggtttgatgtctttcactgtcatcatttccttagttataattttgcaaaggcggtttcaccttggcttcagccccacccatgcagtaacactgtgccctgtccttccaatcactgccactaggtggaagcagagcgtgcatcgcccagatgggctagattctcacaggctcactgctagaacgaatattcttgagactttagatctgaaagtcagcctgatttctgaaagccttggaccgtttccaaaatcaaatcaatactccaggaacaagatctgcctcgactttgcctctacccaaggacgctatggcaacgcagttttcaaacgtgctttgagaataaatggaacagggtcccctgtgtccccactcatttgcgttttcctttttattacagccaaccgcttttgtaaatattgttacacatctctctattccactgaaaacatctctttcaaatgcactttaagaaagattcaatgccatgaaaatatgaaggatcctcttgaaagagagtttctggtggtgggttttaatgaacattttcttttttaaaactctgtaactatttcgttgtggggcttagcttcatattttcaaactgaaatattctcttccttaacctccacataaatccaagtttataatttttattattttaaaattttatttatttttctgttttggggacagggtctcctcctgtcactcaggctggagtgcaatggcacaatcatagctcactgcagcctggaactcctgggcttaagcaatcttcctgccttcgattcccaaagagctgggattatagtcatgaaccactgcaatccacccaaatccaagtttacactaaaagataaaattccaacattgtaggggattggtcaggtggtgggaataattataaagataaagttataggaaatagacacaaaccttcttggaaggtggaaagttttgcaaaagcctcaggatagggttatagctgaaagcagcctaatccccttaccttgagttaatagcttcgagtaagtacaaagacatgtaagagagtttatctaaagagcatgtttacctttgatcatttgtaggactgctctctccgggggactgcgaccagattaattacccacaggtgtgttgactcaaagcctttgtcattaaatctgtgctgaataaaggcccacagggccagatagtcagggcacgcagctgccacaaccctttctgtgagtggcctggccctctggtgcactctttcactgaatatcggtgtctgagtacattattcatccatcgtgcagcctgggtctgccggtcagaccctggcacaacatttaagaggaaatgaaagtcacaaagttatcccagtctctggagtcactgtcaaaactttggtgaggaatcttccaggttttcccctacttcaaatatatattaatattatgtaagtgatattagtggcattttcgcccaggctggaatgcagtggcatgatctcggctcactctaacctctacctcccagattcaagcgattctcctgcctcagcctcccaaacagctggaactacaggcacccaccaccacgcccggctaatttttgcattttcagtagagacagggtttcaccatgttggccaggctgatcttgaacttctgacctcaggttatctgcctgccatagcctcccaaagttctgggattacaggcatgagccactgtgcccagcctccttaaccttttaaaaaaggttaaaagtatgctgggcacatcttttcatagcaatacttaaaattgctcttactctttttaatgacaacatagaattttatcgtgtagctgttctttgggagacgattaaaatcttctttatcttcactgtggtagtggagatgtgggtgtgtacaacagctaaaattcaacaagttgaacattttaaatagatgcagtttattgcatgcaaagtatgtcccaataagatgatttaaaaatattatcctctttgagacttgtactttgcttatgtgaaacaaaacaaaacaaaaaccctgttcttgtgcccaggagacacaccctgacacatctggaggtagagggtcatgctgtctgcaacttaccctcacaggctctgaaataacaataatagcagcatatttacagatttagagagagagaaatttgtggtaaaaatgttcataagtaaaactagataaagggcaaaaataaaagaaataatgaaactacgtcttttaaattttctctctccggccgggtgcggtggctcacgcctgtaatcccagcactttgagaggccaaggcaggcagatcacgaggtcaggagatcgagaccatcctggctaacacagtgaaaccccgtctctactaaaaatacaaaaaattagtcgggcgtggtggcaggagcctgtagtcccagctactccagaggctgaggcagcagaatgccctgaacccgggaggcggagcttgcagtgagccaagatcgcgccactgcactccagcctgggcgacagagcaagactccgtctcaaaaaaaaaaaacaaaaaacaaaaaaactctcctttactttttctctccccttttcttcctatctcttccctcatttcttcaacacgtccccccatccttccctcttttctccattctctgcatttgatccccggtatattccagcctccaggccaacaaacttctccgcgtccgccgggagcaggtcagggaagggacgcgaggcggcgctgtcaccgcattctgagcgccgcagctccctgggccccttgtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcgcgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataaggcaagtgctgagggagaaaacgtagttgatggggtagagcagacggggttggaggtggggtggagggggagggctttggacagaagacctgggaggcttggtgggggaggggcgcccaggcctgggcactaagaaacaagtcccctggagctcaagaccatctcggcctcccctagcccaagagaggactggcttcatgactccctgaaaccatttctaaatgccttagaacaaaccttgcatattcattattgttattgaactattaaaagtcttttttgggggcgagctgaatcagatcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaaattctcgaatacattacattttcatccacagaaaagtgtaggctagggatcatgggggaatagttagtaatgacagggatagttgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctggtgagtggcgttcctggcggtcctcggcggagcgggagcagygggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagaccccyaaggggaaccctgatgctaatggcagttgggccttaggcagggcgcagggcagcgcagatgccccctcccctccagtgcagatgcctgytctggaccctgcctcatkgtggccccttccccactccttcatcctcagcctcaccctcttgaggacsccaccctccagcccacaggtgctggacyatccctccctggtccctccgcccctctccaccttgggaccttgtgctgctcctrtctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccactccttgctttgtttttaatttttaacttttgtttgggtacrtagtagatatatatgtatatatttatggggtacatgggatattttsacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccratttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaracaataataataataatatttttgaggttcatccaagttgtagtatgggtcagaatttcattccttttaaggatggataatactcattatatgtatgtaccacatcttggttatccatccctcagacaayggacacttgggttacttctaccttttggatattggcaaatatttcatttcctttgggtatrtatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttrcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctrgggctacaaccttcctacccyttgtgcctcatgaccaccccctcccttgtccccgccatgcccatgatgagtctcttctcraggcagctcsccttgcctccatctcaccctcagcctatgcaccacagccacactggacatgggtccctctgagcctgagtcccttcccattcccacyatcycctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccycaggaaggttgggacagcagacctgtgtgttaaacatcaatgtgaagttayttccaggaagaagtttcayctrtgatttcctcttccccagagccccacagtcttcsttataacctcacggtgctgtcckgggatggatctgtgcagtcagggtttctyrctgaggtacatctggatggtcwgcccttcctgcgctrtgacaggcagaaatgcagggcaargccccagggacagtgggcagaagatgtcctgggaaataagacatgggacasagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggrggagggccagggaggcrtaccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactaygatrgggagctcttcctctcccaaaacstggagactraggaatggacartgccccagtcctccagagctcagaccttggccatgaacgtcaggaatttcttgaaggaagatgccrtgaagaccaagacacactatcacgctatgcatgcagactgcctgcaggaactacggygatatctaraatccrgcgtagtcctgaggagaasaggtacsgacgctggccaggggctctcctctccytccaattctgctagagttgcctcacctccmagatgtgtccagggaaaccctccctgtgctatggatgaaggcatttcctgttggcacatcgtgtcctgattttcctctattgttagagccactggataaagacagwgggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagygaggcctcagagggcaacatyaccgtgacatgcagggcttcyrgcttctatcccyggaatatcayactgasctggcgtcaggatgggstatctttgagccacgacacccagcagtggggggatgtcctgcctgatgggaatggaacctaccagacctgggtggccacyaggatttgccraggagaggagcagaggttcacctgctacatggaacacagcgggaatcacagcactcacsctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctaygtcygttgttgtaagaagaaaacatcagctgcagagggtccaggtgagaaaagcgggcagtttctggagatggtaaggcccytgtctgggcagtagggtcccytcattgctcctgcaaagataggcatgttggtgacaaggcttcyrtaacaggggatgaaagttggggaatttgggamgggaatgggggcarcatctccatctacacccataagtgctgcccaagcragggtcaaacgcccagctgtggcatcytcctgctgcaggtgaggagtgggcagcagggagggctgcggcgcctgctctgtccccatcccggtctctgtgtctcttgractcactagggcgcatccaggtggggtgagctgggaatcacgtgctgaatgctragggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagacccctwgtaacagggagggtcctgagcacacatggccatctctgtccactktgcagctccccatgcacctcctccaggagctttcttggggttgtygtgtcctctgcaccattcgaggccctactctttccaggttcccacggcctggcctccctgagtttcttgcagatgacatggatgagtagataagcagatgtccctgggccatttgaggagtggggcccagcccctcatcagggcagwtgtggtccctgttttcatcctacctccgagtgttttcttctccagtccctgagggacacagtcctcagggcccatgtttttggggatttaatctgtgctctgtggcctcaccttgccytccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggrtgtgtctggcagtagggtcgctggtttctcatccttgaacctaattgcactgtcartcggcccctcaggcctgagcagatgggaaggtttgtcccctgccctgcagcaagagggccctgtccaggaggcacccacaacagrggcagtgcaggtctgtggtcactcctrctctcacctgtggcgtctcccgtagagggattgtcagttctggttccctgtgggcaggaatggtttcctcataggtcactggagttttggccaggaaaagagtatgaagttcatgtgscagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttyctgatggggtccccagttaggagctgcctgctcagggctgggaggggaggagcactgagctgcagatagagggcagagcccacagtgggcagggcctgccctggtgtgtaggtgcctctgcaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagwgaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcrcctagactctacagccaggcggctggaattgaattccctgcctggatctcacaagcactttccctcttggtgcctcagtttcmtgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcaygtgatgacacagagctgaagtgtgatattcgggaggggatagagagtgcttggaggtyttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatrcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaacttttacttccatatgtctaaatacaattccttcattaatactgcttgatttttccgttgcagtcattatctgttgcacagcacagtggtgaatgcaatagttaattgtacctgttccctttcactcttcccattctttcatcttcccgatgtatttctgtagtaattatgtttggttcagtcgttccttgtttccttttccatgactaattttctcatatgtcagcttgaccacttttcacttcctgaacatttgttcttcctgtagttaatacttgcctttgtttttgtttattttataaatagcactcattaacgttgatatttcttctatttgtattactcctttttttgggatggagtctcactctgttgtccaggctggagtgcagtggtgygatcttggctcaccacaacctccgcctcccaggttcaagcaattctcctgcctcagcttcccgagtagctgggattacaggcactcaccaccatgcccagctaatttttgtatttttagtagagacggcgtttcaccatgttgtccacaatgatgtcgatctcttgacctcgtgatccacccacctcagcctctgaaagtgctgggattacaggcgtgagacatcgcgcctggcctttttttttttttttgagatggagtctcgctcttgttgcccaggctggaatgcaatggcacaatcttggctcaccacaacctccacctcccaggttcaagggattctcctgcctcagcctcccgaatagctgggattacaggcatgcaccaccacacccggctaattttgtatttttagtagagacagtttctccgtattggtcaggctggtctcgaactcctgacctcaggtgattcacccgcctcggcttcccaaagtgctgggattacagaggtaagccactgcacccagccgtattactcttttaagaaattacagactttggatattccactttaccttcttggaaatgtccctcytgggcccttctcgctgctcccatctggaytggaggcttctccctgtggagcagagtcactgtcctaggatctccctccaccgccatctggggcagtgctttacatgcagtggagccacctggggtccagccaaaatgcagactgattcaagatgtcaaggctgaggcatatgagcctttctgtctagtttcatgagatgctgattctcctggttcgtgtgtgtgtgtgtgtgtagagagagagagagagaaagggaattttgctctgtcagccaggctggagtgcagtggtgccatcatggcttactacaggctcaacctcataggctcaagtgaccctcctacctcatcttcctaggtagtcaggaccacaggccacatcctaatatatttttaattaactgatgcagtttctttctaaattagtaagagggctgagcattttttcattgtggcaaaaaatacacataaaatttactatcataactatttttaagaatacagtaccattggccaggtgtggtggctcatgcctgtaatcccagcaatttgggaggctaaggcaggaggatcactggaggcctacagttcaagtcaggcttggggaaagtagtgagaccctgtctccagccaaaaaaaaaaaattaaattaaaatatactgtactataatagtgttaattgtaagcacagtgtagtgcaaccgatctttagaatatttcaccttgaaagctgaaactctgtgcccctttcacaaaaatccttattacctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaataatattccattgtctgtatataatcatattttcttgatctattcatctgttggtaaacatataggttgcttccatatcttgcctgttgtgaataacaccattatgaatayggatatgcaatctttcttttcacttttgtatcccccctcattttggtgcaactaatcttctagtagcttttcctgaaagcacgtgcttaaagtacatttgtgtgtttcaacatatctactatcattttgcctctctccaggaagaggaaagaaatgtattaaggtgctctttggcacagcatttaatggtaaagaaagaaacagtataactggccrgtgctgggtttcagcatcctgcaatttcagaactactgtgaatacaaaagaaagaaaggtcctgcccaggatgggagtcactcctatatatggtggccctgggacagcagacctttcctgtcacacctcttccatgagggcccttacttcagtgactgtggtgctttccttctctctatggtcyatctatctatctatccagttggttgggtttctctggagaaccctaatataccaatggacagtaagcaaataaaacctagtattaccactaattgccattgagaaaaatatgcctaggccagaagattggtgatggtgggaatagcagggacatagtttagacaaggtcattgagcaagacgtttctgagaacttgaccactggttatctgagaagagacctgaatcgtgtgaggagtgagtcatgtgaatccctggggagcaggtacatgtgggagtcagagcatgggtaggtggcagaaatagggcagagcastgacaagaggctggtgtgagtggagacaagtgagctgggckgagaggagtgggatgagcccagagttgacagaggggccctgtgttgaggggcttstaggaaatggtgagacattggggtttcattgcactaagaggggaagaagctagagtggctttgggatgtggtggtgatgatgtgctctaattcccgtttgaaaggtttactctacctgttgtgtgggtgatggacagcggcgtgaatgtctcttcatgtccattacccatttttgaatggcgttgtttttttaatggatgagttgtagttttttatgtattttgaatattaattcttcatcagatrtatgattggcaaatagctcctcccattctgtgcattttctttccactcttttaataatgtcacttgttgcaaaaaagtttttaaatctgataaagtctaatttatcatttttctttaattgctcatgctttgggtcatccagccaagaaactactaccaaatccaatgttcacaagactttcctcaatgttttcttctaagggttttacaggtttgactcttaagcttcgttgtttgatacattctgagttaattgttgagtatggtgtagggaaggctatgaattgtgtccaacatcattcttttgcatgcggatatccagtttctcagcaccacttgttgcagcaccatctgtggaagtgaggctgacacatttgcaaaatgcattgagcactagtacaccatgcatttatttacttttctttactccacagttgttttgaggaggcttccagtgacaaacacaacagaaatgaaaatacatgaattcttataaaatcaatatcaagtagaattataaactttaaaatgttaagagtgaggcaaggctagatcattactagacaagctgaaacatagactgaaatggagggtttacggttttccttgctacaaattttgttggcccacaatctgtcatgcttactgcataagggagccagccacagggtgggttgatagctcacataaccagtccctggtttcctgcttcagaaacaagttcagattctctccacttacagtaaaaaagtgaattgcaggatgttcaaagtgaagttgacatctacaaagtcaacaaataagtagtaagtgtagacctcagaaatttaacaagattctactttttcccccaaaaaaatgtcctcacaatttcctgctgaaaggagagggttcattcaggggaccacatgatgccgttcttctgctgcagttctaaattaagttgtccttccctctaactacaggtctcacaaacccttgcagccagcttcaatgattttagcttgactaaggttttgggtttttgatattgtttgtatttgagctgcagcctggggcttagaaatgtgacttgggtattttgccaaaatggtatgtttttctatagaatttgacgttgtggagaccctgcttttctgccaggtccccagaggggatacagtgctttgtacctctttttagtacttcattagcagtgatagaagatttggagtgagggcctccctcaatctctaccctctgcctagtgcagaggatcatggactgttgcagttatggcaacaaaaaatttctccagacatagctcctgtcctctggtgggaaaatctcccctggatgagaacactagtttgagaggtagagacactcaggagctgggcttggacaggggaagggaagaggagacagacacaaaacggagtggggctgggaaacaggcaaagggagttcaggcctggagggacctggcctgatgaggcacatgaggaatggggagagtggcaggatctcctattgccagaaaatcgtacttgtacccactgcattcccagccctggtgtatgcatctctrggaaatcagaatgaatttggctattatggtgtcagaaagagccctgaagagcctcgtgtgcctgtcaatgtaatgaaagtgcaggtgacagcccctcctggaaatattgttgccaaatgtttaacccagatctgcctcggtctttaggaaacacagcagagagaagagcaaagtaaaaggcatcaggggaamtaatatgataaattcggtgtggagagcatgctaaagttatttggcctgcaataagtaatgctgttctaaaagaaaaaaggattagtggattgttgtagattacaggtaactaaaggacacataatcaaaggcaatgagtggatattttatggaaccaagttataaaaatgtacaaagaatagattgaagaagtgaagatacttgaatatgaaaggactttagataatatggaattattgtttattttctttggtgtgataatgtaggtttttactcttaggagatgcacgatgaggtgtttagtggtgaaatatcatgggtctagcaagttactttagaatggttcagtcaaaaatcttagtctcttcattctgtctctcttcatacatacacacacacatacactcacatatacacactatacaaacacatacagctgaagcagcataaaacctagtttctagtagagggatgcaaaaagggaggagaattggtaagttagagttttttggcaaaggactgacaatgcgccacatggataggacttctattccgctagctggtgctgttgaccttgaaactccatgtgcactccagaccaagggcagagagagatgctcactgtggcgggtaggggggatgtgttcctagaaaatcacaatgacattcccctgagctatatccctggttactacagcatttcctgatcttgcctaacaggattacttccctgaactgtaaaattcctgcagcattgtatacagagaaagaataggagacatggcaatcatggacaagaaaggaggaaatcgtgataggaaagttagagatcctgttgccaacacccagtcaggcattcggaggctggggtcagtctagaagcctttcataatgccacgtggtagctccatccagaaatcctcagttgctccctgacttcttccagccccaggtgatggctagatcctccatgaaaggaaactggttcaaacacggccaatatgcccagcaacccatgggtaatgggggattctccatgttctccccaggaagcctgtctcccgtcttgtaatgctgggagccacactaatcatttttaaatggctgaaggggacccagtatttggtttgatttgattctaaaaatggaggccaagagcctcaaaataaaaaaacagagtggaggtctgctcctgtactcaccattctgatgaatgtaccttgggatcctgaatgagcaccaaaaataaagcagcacctttgtctggggtgatacctgagatgcattgcctcatgccaagaaaattaaggacacagacacacacaaggagtgagtttaggagtagaggtttaataggcaaaagaaaagaaagagaaagaagaatagctctctctcctgtgagagaaggggcacgcaagtgggaaytccagcccatggcagagtgcactggattttatacacaggctgaaagaggtgtctgatttgcacagggcccacagattggttggaccaggtgtgatgtttacatagtgcatggggaagctgaccaccccaccctaatcttcttatgcaaataggctttccacttggctgacaccatgttgtctgctccctgctgcacacgtggttggaaaggaaaagtgaagatggagccgccatttgaacatgcctagtcccaggtagccttttcctattggcacaactgctggcattcactcaggcaagcttccagcttgcttgtctatgtctgcagctcaattttacaggctgctctttgttagaaagaaaatgatttgggggctgcttttcattaaaaggaaaaccttaccaaggacttctttactctcactatctgcctaaataatttctttttaactcctctatcagttacaaaatcagttttaaagcacatactgttctgtgatattgggatatctggacattttgttgtcataggagtttatccttgcaggtattaccaaactgcttccttagctatcaacatcctaggaccatgggtcatgacaagcaaggaatgtaccctgctagtttaaagataaacttgatttgcggggagggggtggtttttagttacatgggtaagttcttttgtggtggtttctgagattttggtgcatccatcatctgaggagtgtacatgtacccaatgtgtagtcttttctcccgcaccatcctatgaccctaccctctgagtccccaacgttcattatatcattcttttgcctttgcatgcccatataagtgagaacacatgacatttagatttcaattcctgaattacttctcttagaataatggcctccaacgtcattcaggctgctgcaattgccgttatttcacttctttttgtggctgagtagcattctacggtatatatatatatacaccacattttcttttttttaattacactttttattttgaggtaatcatagatccacatgtaactgtaagaaatagtaaagagggcaggcatggtggctcasgyctgtaatcccagcactttgggaggtggagagagcaggatcacttgagaccaggagctcaagaccaacctgggcaacacagcaagaccctgtgtcttaccaataaaataataataataatawagagaaatgtcatacattctttacccattattcttcaatgacatgttacaaactacagcataatatcacaagggacactgacattgatatggtcaagacacagaacagttctaccaccacaaggagccctcatgttacccttttataatcacactgacctttccccgcttccatgcctaacccctggcaaccactaayatattctctacttctattaaacttgtcatttcaagaaagtgatatgaatggaatcatgcagtatgtgttcttttgatattggctttttttttcactcagcrtgattccctaaagattcaaggattcatttacattcttggatgtatctatcaatagattgttggtttttttgtttttttkttgttgttttttttaattatactttaggctctagggtacatgtgcacaacgtgcaggtttgttacatatgtatacatgtgccatgttggtgttctgcacccattaactcttcatttacattaggtatttctcctaatgctttccctccccmctcttccctcccccaaccccacgacaggccccagtgtgtgatgttctccaccccgtgtccaggtgttctcattgttcaattcccacctatgagtgagaatatgcggcgttcagttttctgtccttgtgatagtttgctcagaatgatggtttccagcttcatccatgtccctacaaaggacataaactcatcctttttatggctgcacagtattccacgatatacaccacattttcattttccactcattgattgacggacatttgggctggttccatatttttgcaactgtgaattgtgctgctataaacatgtgtgtgcaagtatctttttcatataatgacttcttttcctctggtacatacccagtagtaggattgctggataaaattgtaaatctacttttagttccctaaggaatctccatactgttttctatagtgattgtactagtttacattcctgccagctgtgtaaaagtgttccctttttaccacatccacaccaacacctattatttttttatttttcaattatggccactattrcagaagtaaggtggtattgcattgtggttttcactggcatttccctgataattagggatgctgagcatttttttatgtttgctggccatttgtatatcctcttttgagaattttctattcctgtacttagccttctttttgatgggattattcattttcctcttgctgatttgttwgagttccttgtagattctggacatcagtcctttgtcaaatgcatagtttgtgtatatgttctccctctctatgggtcgtctgttaactctgttgattatttcttttgctatgcggaggcttttttgctgaattaggtcccatgaatttatttttgtttttgttgcatttgcttttgggttcttgctcatgaagtcattgcctaaaccaatgtctagaagggttttgttcagtgttatcttctagaatttttatggtttcaggtcttagatttaagtctttgatccatcttgagttaatttttgtatacggtgagacataggatccagtttcattcttctacatgtgagttgccaattatcccagcaacatttgttgaatagggtgtcatttccccactttatgttttcatttcctttgtcagagatcagttgactgtaagtatttggttttatttctgggttctctattctgtttcattggtctacatgagtctttagggttttctagctgtacaatcatatcatcagcaaacagcaacagtttgactttctctttgccaattcggatgccctttatttctttctcttgtctgattgctctggctagaactttcaatacaatgttgaagacaagtggtgaaagtggacatccttaccttgtttcagttatcgggggaatgatttctaatttccctcattcaatataatgttgcctgtaggtttgtcataaatggcttttactaccttcaggtatgttccttgtatgccaactttgttgaagcttttaatcataaagcaatgctggattttgtaaaatgtttgtcaaatgttttttgtgcrtggttaatactaagtgtcaacttgatttggattgaaggatacaaagtattgatcctcggtgtgtctatgagggtgttgccaaaagagattaacatttgagacagtgggctggggaaggcagatccacccttaatctggtgggcacagtctaatcagctgccatttaacataaagcaaacagaaaaacaagaaaaggagagacactggcctagcctcccagcctacatctttctcccatgctggatgcttcctgcccttgaacattggactccaagttcttcccttttgggactcaggctggctctccttgctcctcagcttgcagacagcctattatgtgaccctgtgattgtgtaagttagtactcaataagcatatatatatattatatattatatatgttttatatatattatatattatatatgttttatatataatatatattataatatatattattctattattatattattctgttaatattaaatactaacataatatatattatatataaaataatatatatataacgtactaacttacattttgtgtgtgtgtgtatatatatattctatatatatattctatgtatatattctatatatatcctatgtatatatcctatatatatatcctatatatatatcctatatatatatcctatatatatatatcctatatgtatatcctatatatatcctatatgtatatcctatatgtatatcctatatatatatactatatgtatatcctatatgtatatcctatatgtatatcctatatatatatcctatatgtatatcctatatatatatatcctatatgtatattctatatatatattctatatatatattctatatatatattctatatatattctatatatatattctatatatatactatatatattctatatatatagtatatatattctatatgtatatattctatatatattctatatacatatattctatatatatattctatatatattctatatatatattctgtatatatatattctgtatatatatattctatatatatattctatatacatatatattctatatatatatattctatatacatatatattctatatatatattctatatacatatatattctatatatatattctatatacatatatattctatatatatatattctatatacatattctatatatatatactatatatatattctatatatatattctatatatatattctatatatatatattctatatatatattctatatatatattctatatatatattctatatatatattcttatatatatattctatatatatattctatatatatattctatatgtatattctatatatatattctatatgtatattctatatatatattctatatgtatattctatatatatattctatatgtatatattctatatatatatatatatattctatatatatatattctattagttctgtccctctagaaaacctgactaatacagattttggtaacaggagtggttctagaggaacagaatattaaggatggagttcttttgttagtttaggggtttctggagttggttgcttaatatgattagacccaaaaatgctaaggactctacttctaatagtgtggagaatgctgatagtccctggcatgaactgtttagagagtaacgcaaaataaatgcatttcacactattcactgctcctgagaggcaagtttagtgactctaacctaataattttgaccatatgtagagaaccaaggaacataatgaagctggttggttgctcctaagttcagtggacaaagtgataaaagaagataatgaactcagggattctgtctcccagcttcagaagcagatactgagcctcaaatctgctaagattgccccatgagtgacagtcttatctcctgtagagaaagagctgaaattgtggaaaaacagacaaaagctcctatcatgtgagtagctgacctgcgatgaaagatgcatacacagcctcaccaagtgtctactgttaaagtgagggcattgatcagaaaagaatgagaccctgcaacttggaatggggatatgtgggaggatcctaatgaagctggggacactaagtgtgtaaattatgatgaaactttttttgctagaagaatcagcttccccgtccctagtattggcaacatcccctccccagcccatgctgtcatcagcctttccacctttatctgagaagacaaaccctgcactgcctgaggcaacagtgatggcctgccctgaagcagttgccaggcaagataatgttgattctcctcaggagccacccctaacacctctgtttgcttctagacctatgactagactaaagtcccagcggtcccctagaggtgaggttgagagtgtgacccatgaggaggtgcactacactcaaaaagagctgtttcagttttctaatttatatcaatagaaatgtggagaacaggcatgggaatggatattacaggtatgggataatggtgaaaggaacatagagttggataaggctgaatttattgatttgggccattaagtaaggactctgcttttaatgttgcagctcggggagttaaagaaggtcgtaatagtttattttcttggttagctgaaatatggattaaaaggtggcccactgtgagcaagctggaaatgtctgatctcccttggtttaatgtagaggaaggaattaaaaagcttagggagattgggatggtggaatggattagtcagtttagacctactcatcccaactgggaaggtctagaagatttacccttgaccagtgccttgtgaaataggtttgtgagggcagcacctgcatctttgaagagccctgtaattgctcttctctgcatgtcagagctaacagtgggaatcacagtactcaactataaaatttaaatacaatgggaataattggatcccgaggtgtcaggggccaagtggcagcattcaaccatcaaaggcaaggtgagtgtagctaccataatggacagcagaggcaaagtggcagtcataatagtccaactcatgcagagctctggcattggctaattaatcatggtgttcctaggaatgaaattgataggaagcctacttcattcctacttaatttatacaagcagaaaacttctatgtgcaatggacaaaagactaattttaatcataaaaacaaagaatcatggcccctcagtcaatttccagacttgagccagtttacagacccagaaccccttgaatgaaaaggaagctgggtctccttgaagaaggaccccactacattactgacaatttatgcagtgaatcttcttccatccttctgtgaggagacctccagccttttaccagggtaactgtgcactggggagaggaaaatgattagatatttcaggaatacaggacactggctctgagctgacattgattccagggaacccaaaacatcattgtggccctccagttaaagtaggagcttatggagttcaggtaattaatggagttttagctcaggtctgacttacaatgggtacaatgaatccccagactcatcctgtggtcatttccccacttaatgcattttcccaattaattttcccaattaatgcatcatttccccaatgcaatttccccaattaatgcataattggcataggaatagttagcagctggcagaacccccacactggcatgctgactggtagagtgagggatattatggtgggataggccaaatggaagccatcggagctgcctttacctggaaaaatagtaaatcaacaatgtcacatccctggaggtacagaggagattagtgccaccatgaagaacttaaaagacacaggggtggtgattcaaatcacatccccattcaactctcccaaatggcctgtgcagaagacagacagatcttggagaatgacagtggattattgtaagcttaaccaagtggtgacgactccaactgcagctgctgcaccagatgtggtttcattgcttgagcaaattaacacatctcctggtacctggtatgcagccattgacttggcaaatgcctttttctccattcctgtccataaggcccacaagaaacaatttgccttcagctgcaacaatatgcgtttactgtcctgcctcaggggtatatcaacaatccagctttgtgtcataatctgattcaaagaaaccttgatcactttccgcttctgcaagatatcacactggtccattaccttaatgacattgtgctgattggatccggtgagcaaaaagtagcaaacacactggacttattgatgagacatttgcgtgccagaggataggaaataaatctgactaaaattcagggaccttctacctcagtaaaattctaggggtccaatggtgtgggacctgccaagatattccttctaaggtgaagaataagttgctgcatttggctcctcctacaaccaagaaagaggcacaatgcctagtgggccgatttggattttggaggcaacacattcctcatttgggtatrttactccggcccatttatcaagtgacctgaaaggctgccagttttgggtagggtacagaacaggagaaggctctgcaacatgtccaggctgctgtgcaagctgctctgccctttgggctatatgacccagcaaacccaatgatgtttgaggtgtcagtggtagatagggatgctgttggagcctttggcaggcccacatagttgaatcacagcagaggcctccaggattttggagcaaggccctgccatcttctgcagataactactctcctttyragagacagctcttagcctgttactgggctttggtagaaactgaacatttgactatgggtcatcaagtcaccatgcaacctgaactgcctatcatgaactggatgctttgtgactaatctagccataaagtgggtcatgcacagcagcattccatcatcaaatggaagtggcatgtacatgatcgggctcaagcagatcccgaaggcacaagtaaggtacatgaggaagtggctcagatgcccagggtctccactcctgccaccctgctttctcttcctcagcctgcaccgatggcctcatgaggagttccctatgatcagttgacagaggaacagaagaatagggccttgttcacagattgttctgcacgatatggaggcaccacccaaaagtggacagctgcagcactacagcccctttctaggacatccctgaagggcagcagtgaaaggaaatcttcctagtgagcagttcacctggttgtgcagtttgcatggaatgagaaatagccagatgtgcgattatatactgattcatrggctgtagccaatggtttggctggagggtcagggacttggaagaarcatgattggaaaattggtgacaaagaaatttggggaagaggtttgtggatggacctctctggtcaaaacccacaaagatatttgtatcccatgtgagtgcccaccaatgggtgatctaagcagaggaggattttaataatcaaataggatgacccgttctgtggacaccactcagtctgttttcccagccactyctgtcatcgcccaatgggccaatgaacaaagtggctatggcagtagggatggagggtatacataggcttagcaacatagactttcactcaccaaggctgacctggctatggccacttctgagtgcccaatttgccagcagcagagaccaacactgagctctcaatatgacaccwttccttgggcgatcagccagctacctggtgacaggttgattattggacctcttccattatggaaagggcagaagtttgtcttcactggaatagacacttactccggatatgggtttgcctatcctgcatgcaatgcttctgccaagactaccatcatggagtcacagaatrccttgtccacccttatggtattccacacagcattgcctctaaccaaggcactcacttcatggctaaagaagtgcagcagtgggctcatgctcatggaattcactggtcttaccatgttctccatcctgaagcagctggattgatagaatggtgtaatgaccttttgaagtcacaataacaatgccaactaggtgacgatactttgcagggctggggcaaagttctccggaagactgtgtatgctctgaatcagcatccaatataggatagtgtttctcccatagccagaattctcgagtacaggaatcaaggattggaagtggcagcactcaccatcacccctagtgacccactagcaaaatttttgcttcctgctcccacaacattatgttctgctggcctagaggtcttagttccagagggaggaatgctgccaccaggagacacaacatcgatttcattaaactagaagttaagattgccacctggatactttgggctcctcctacatttaagtcaacaggctatgaagggagttacagtgttggctggcgtgattgacctggactatcaagatgaaatcagtctactactccacaacagaggtaaggaagagtatgcatggaatacaggcgatccattaggatgcctcttagtattaccatgccctgtgattaaggtcaatgggaaactacaacagcccgatccgggcaggactacaaatggcccagatccctcaggaatgtaggtttgggtcactccaccaggaaaaaaaaacacaacctgctgaggtgcttgctgaaggcaaagggaatacagaatgggtagtagaagaaggtagtcatcaataccagctatgcccacgtgaccacctgcagaaacagggactgcaatggtcatgaatatttcctccttcttttgctaaaagtcatgtttgtgcatgtatacacttggactaagaaaatacctttattttatttccttttcctttatcatgtgacataagatttattgacttcatgtcagcatttaagttttattaactttatgtaatagtacttggggattggtgcgtttctggttgtacgaaggatcattgtattatgttggtgtaattatgaccttattattgtctttgtttgaagattatgtatgatctcaggagatgagtatgggttcaagttgacaaggggtggacttgtgatggttaatactgagtgtcagcttgattaaattgaatgatacaaagtattgatcctgggtgtgtctatgagggtattgccaaaagagattaacatttgagacagtggaccagggaaggcagatccattcttaatctggtgggcacagtctaatcagctgccagcaaatataaagcaagaagaaaaayttgaaaaggagagagactggcctagcctcccagcctacatctttctcccatgctggatgcttcctgccctcgaacatcagattccaagttcttcagttttgagactcgaactggctctcctttctcctcagcttgcagacagcctattgtgtgaacttgtgattgtgtaaattaatacttaataaactcttatatatatatatacacacacacacgtatatgtgctattagttctgttcctctagagaaccgtgactaatacatgtatctatygagataacaatattatttttgtttttcattctgtttatgtgatgtatcacatttattgacttgcgtatgttaaaccatccctgcatccctggtatgaaacccacttgatcatggtggattatctttttgatatgctgttggatggattaaccagtattttgttgagaatttttgcatctatgtttattagggatattggtgtgtagtttacttttttggttatgtcttttcctgcttttggcttcatagaatgatttagggaggatgccstctttaccttttgaaatagtttcagtaagattgagaccaattcktctttgaatgtctgatggaattcagctgtgaattcatctggtcctggactttttttggttggcaatttttttttattgctctttcaatcttgctacttgttattggtctgttcagtttctgttttttcctgatttaatctggagggttgtatatttccaggaatttatcaatatcaatctattctagattttctagtttgtgtgtgtaaaggtattcatggtagccttgaatttctgtggtatcagttgtaatatatcctgtttcatttctacttcagctcgtttgggtcttttcttctcttggttaatttcactaatggtctatcaattgcttatcttttcaaagaaccagctttttgtttcatttatcatttttcatgcttcaattttatttagttctgctcagatctttgttattttatttcttatgctgggtttgagtttggtttgttcttgtttctctagttccttgaggtttgaccttagattgtctttttgtgctctttcagacattttcatgtaggcatttaatgctatgaactttcgtcttagtacttcttttgctgtattccagggttttaataggttgtgtcactattatcattcagttcaaagaatttttaaatttccatcttgattttaatgttgactcaaagatcaytgaagagcaagttatttaatttccatgtattcacacagttttgagggttcctttggagttaatttccagtttcagtccactgtggtctgagagagtacttgatataattttgattttcttaaatgtattgagacttactttgtgacctatcatatggtctaccttggagaatgttccatgtgataatgacaaaaatgtatattctgcagttgttgggtagaatgttctgtaaatatctgttaagtccatttgttctagggtatagtttaagtccattttgtctttgttgactttcttgatgacctgtctagtgctgtcagtgaagtattgaagtcccccactattattgtgttgccacctatctcatttattagatccagtaataattgttttataaatttggaacccctagtgttaggtgcatatatattaaggattgtgatactttcctgttagactaatccttttgtcattatatagtgttcctctttgtctttttytttttaaactgttgttgctttaaaggctgttttgtctgatataacaatagctactcctgctcacttttggcttccatttgcatgaaatatttccacccctttaccttcagtttatgtgagtccttatgtgttaggcattctcttgaagacagcagatactcgattggtggatttttacccattctgccaatctgtatcttttaagtggagcatttagattattgacattcaacattagcattgagatgtgaggtactattttattcatcatgcaggttgttgccttaataccttgttttttccatttcatagtgttgttgaagagtgatggctaaatgtatccagcataaytcrcctacacttagttttctagataattgagttgggtggccccattttaataatgacaaacatgaaattctaaatgcaatatcatcttggagagattatttgattttttcctataggaattgtctccaaactgctttctagacagcctcacaaagcatctagaatgtataaatttgactttcataatgcattaatgatatggtttggctgtgttcccacccaaatctcatcttgaattgtagttcccataattcccatgtgtcatgggagaaatgtagtgggagttaattgaatcatgggggcagatcccccatgctgttctcatgatagagtgactctcatgaaatctgatgcttttataagcatctgacatttcccctgattacactaattctctcttctgctgccatgtgacaaggtgccttctgccatgattataagtttcctaaggcctccccagcaatgcggaactgtaagtcaattaaacctctgttgtttataaattacccagcctcaggtatttcttcatagcagtgtgagaatggactaatacagtaaattagtaccaggagtggggtgctactataaagatacccaggaatgtggaagtgactttggaactgggtaacaagcagaggttgggacaggttagagggctcagaagaagacatgaacatgtgggaaagtttggaacttcctagagactcagagggctccgaagacaggaagatatgggaaagcttgaaacttcctagagacttgttgaatggttttgaccaaaatgctgatagtaatatggacaatgaagtccaggctgaggtggcctcagatggagatgagaaacttgttgggagctggaataaaggtgattcttgctacgctttagcaatgagactggcagcattttkcccctgccctagagatatgtggaactttgaacttgagagagatgatttagtgtatctgccagaagaaatttctaagcagcaaagtgttcaagaggaagcagagcataaaagtttgaaaaattcgcatcctgatgatgcaatagaaaataaaaacccattttctggagagaaattcaagcccactgcagaaatttgcatcagtaagggggagctcaatgtcaatcaccatgacaatggggaaaatatctccagggaatgtcagagactttcacagcaacctctcccatcacaagcccagaggtcatccttaagtgaaaaaatcaaccacaggagatgacatgataataggcttattacagtagaggaaggtacaaagtgtttctcatcattggtgtgtttgttaaaatggggaggggttactgagtgagtgggcagtgggtggtggtggtgacaaccacattctctcactgtggcccaacacttttgaagcagtttcccatttctccattagatgtgtcttctccacatgcagaaaatgtagtctcatagcttccctattgggtgctggactgttggcatttcattattttttttaaatcaaagacatggatatcttttttcttagttgatttctaggacttcaaggttatttgggggaagaagttgcttgaggaggctcctgggtggaccatggagtccctcctagggatttatttggtgctcctggtgtgggtgactatctccctgagtcccaaaagacagcacattctgccgggtacccagaggtggggacagatgctaacagstccatcttataagtgcaacatgaaatttaaggtcagggaatctcttaacttttcttgaaggacctcatatttagcttcttgactcaaaatcatttgtggatttgaacaggtttcctctgcaatgtactctctggaggggaatacattgaaaatacagttcattttcagatactcaatgggattgaaaagttgaattgtgtgctttcttgcagtgagcacagaggaatttgctgtcccatgccactggracatttttaggagcaccattctcttccagagggcttgagtaaggtcagtgaggaattaacatgtagcatattggcaactccagggttgagcagggagacacacatgtttttctgatgtgtgaagttctgagggcattttccaaagtacttgttcactgagcaggtgtttccactacttkcattaagtcaggggatatggaagccacttttccagcaatcaaactcaatgagaagatgaacaagaagtgttctgaaagtaagcagaaaaggccctttccatgaattttcctaatttttagatttctcttaaacaacatgcctgaagttacaaccacatccttctctagcagcttctaaatgagaaaatcatcaaaagggtatttagtactcaagtggtggacacaggataaatgctgaaaatcagtgctcgattcgaagatagtgatgttccaggatgttggagtctctcaggtgtcagtagggaggcgggccgggaacttctcccagtaaccagaaagaagagcctcagggagatgaggatgtctcacagccagggacgggacagtaaagggccccatgtgagtgcatcacagggatctgttcctgtttagactccaatgctcagtacccagtgcagaacatggcaagacttcagcaaatacatcagtcagctggatgaaggaggmaggtgtgagccagcaaaaaaaagcttgtgattttattggagcatgaatttaaaagtgttgatgtggctgggygcggtggctcaygcctgtaatcccagcactttgggaggccgaggtgggtggatcacgaggtcaggagtacgagaccagcttgaccaacatggtaaaaccccatctctactaaaaatacaaaaattagccgggcatggtggcagacgcctgtaatcccagctacttgggaagctgaggcrgagaattgcttgaacccaggaggcggagattgcagtgagcygagatcatgccactgcactccagcctgsgtgacagagcgagactccatctcaaaaaaaaaaaagtgttgatgtacctaccttgcaaggaggtagataggtagacagaagcatggatagatggatggatattctttttctgtgtttttctatttctgttctttctctgtgttttgtctctttctcttgctctgtctgtatcttccactgttccttcataatcatgtcttagccatcatcagtgacatcttttatctggtcttataagatcttgtctgtctgttgtattagtagccacaggacagaaaaaggaaaggagtcgtgaaaaacaagataaggaaaaagatgctcctgacatggggcatcgggaggatgtgtggccctgaggctcccgggagacaggggctgcgcctcactgcagagtccatcctgctgaacacagaggggaaaagcgccctgacagccccgtccgtgctgctcagaaaagacggctccgtctccagatccttctctctatgtccttcagtcttggctctctaggtacaatttactgctatgaaaagggatttgagaattcccagaggagsctttcagcctctttgcatggctctttctggcctttcaaaagcgccagagacatcagaaatgaaatcgtacacacttattcggagttttccacaatcattgaaatttctgtgagtgccaaagttaagtttttggcaaccccgtcaaagccgggtgtgcccaggacagtcaactcaggcgctggactctcattctggttggattttatgacagccgtattcgccataagaattctagagccagaccttgttacttcacaattgcctcacgttgcaggacaagcaaatctagcctgagtcctgtggattccagggctgctcaggagacgcctccatcctggcgtggatgacctcaggatcagccccgtctgccccactcagcccgcagcctggtccccgaaagcgctcagtcagaatccgagagcagtgtggcggcgcccccgtgtggccacaggactgaagacaraggaccccgctcccctttctccccagccaggacgtcccaggctctccccctgttccccgcacctggacgggactctgcacagaagagagtctcccggtctcgtgtcaggctctgagttcatccagcttcccaaaatccatgttgatatgaacgttttctcccacaactgattgactggacttttgtctcagggcagagggaggcctccagaccaaaacagcaggatcaggtctggagctgactcaaccccaaacccttgmtaatgcacgacccagtcccccagcctccaggatgggaccttggcctcctgtcccctcccttgttcctgccactgctcctgcaggtggaggctgctcatcccaggaatcagtctgtgagctccaaccttggggcctcggtccaggaaggagggaggctccagagagcagaagggagatgaaatggatcataagagaagaaggaatcayaccaaacactggaactgtaggtcaattaaacctttttctttataagggggggggaggaagaggaggaggaaaaaggaggagggtgaaaggagtcagggaggagagaaaagtgggaagtgtttctttagaaggggtgtgtgtgtgtgtgtgtgtgtgtgtgtgtgtgtgtaggtgtgtgtaaagcaggagggagttcctaggatcctgaagaaaagagagtgaaggacaggggctaaggggcccagccctggtaggttgagggccccactttctgtgctcgggccttactgtcctagcagagtccagccccgggaagcctggggtcacagcactcggcttgctggatggctgcctcttcattgtctttgacagcaggagctaccttgccaggcccagtggccacagggtcacaggcagagagcaggtccctctgctggcagccaaggagatgctcttggaggatacgtgcacaacttagctgggagtctgaagatggtggtgggttacaaagagctcagcgatgarcctggcccaagattctgaccccttgccctggatcctgagggttccacccttycctattcccaacaggtctcaagaattcttctgttagtctcctgccctcttgggacagccccgcacttccctcactttgataccctggtacccaggcatctgyctccttcattctcctccagctacccaagcacccccaggccctgctctctgccaaccctgatccctgaactccagcactttccaaacccacccccgaattgctggataatatagtggttctatttttagattttytaaaactctccatactgtcttctatagtggctgtactaatttaaattcctatcaacagcgtayaagagttcccttttctccacatcaccagcatctgttattttattttattttatttattttatttttgtcttttcagttgtggctattctatctggggtaagatgacatctcattgtggttttgatttgcatttccctaatgattagtgatgttgaacatttttttatgtatctgttggccatttatattcttcttctgaaaaatatttattcatgccctttgcccactttttaataagattgtttggttttttaattcttgagtwgtttgagtttcttatagtattctggatattagtcccttgtcagataaattgtttgaaaatgttttctcctgttcagcagattgtctcttcactctgtcaattgttttatttgctatgcagaagcttttttagttattatagtcctatttgtctggttttatttgtgttttctatatttttgaagtcttagccataaaacctttgcccggaccactggcctagaatgtttcccctgttttcttccagttgttttatagtttcaggtctttcattttatttaagtcaacttgagttgatttttaatagggtgagagataagaatctaatttcattcttctgcatacgggatatccattttcccagcccttttactgaagagggtgtccttttcccaaatgtgtgttcttggcacctttgttaaaagtcagttggctgtaaatatatggatttatttctgcattctctattatgttccattgattggcatgtctgtttttatatcaataccattctgttttggatactatagccttgtaatgtattttaaagtcaagtagtgtgatggccctagctttgttctttttgctcargatttctttggctatttggactttttaaaaatgttttgggtccatagaaatattagaattattttttctaattctgtggaaaaataaccttggtatttttgttggaattcccttgaatctttagattgctttgggaactatggtcattttactaatattaattcttctgattcatgagcatggaatatctttccatttgtttgtgtcctcttctttctttcatcagtgttgtatagatttatttttaagagatctttgacttccttgcataaacttattcctaggcatttttttctagttatcgtaaatggaattgcttttttgatttctttctcagctacttcattaataatgtatagacattatactgatttttgtatgttgattttgcatcccacaactctactgaatttacttatcatatctaatagttctttgatggagtcttcagatttttctagaaataggatcatttcattggcagggaggggagagaggctgaaggttaagctgatggccaatgatttaatgaatcatgcctaagaaatatgacttccatcaaaacccaaaagggcagggtttggagagcttctggatagctgaacacagggaagctaacaggaggtgaacaagaactcagccatgtgccagagagggtggcgcatcccaaccccatgggacagaagctcctgcactggaaacccttctsaccttgccctatgtgtctgttcatggggctcwttgtgtcttttaaaatatctttttaaataaactggtaaatatatgtaagtgttttcctgagttctgtgagccattctagcaaattaatcaaacctgagaaacrggttatgggaacactgatttaaagcaagttagttagaaacacgggcaaaatggcttgagactggcatcaggagtgggaggcttgagactggcatcaggagtgggagggggacagtcatggggactgagctctcaacccatgggatgcratgctatctccagggaaagagtggcagaattcagttagaggacacccagctggtgtccatcacagaactgattgcttgtttgttggagaaattccctacatttggtcagagaagtcttctgtgttgatagttgttgtggtgtgagagyagtggaaaacaaygtgagattttccacactcagagtggatctaaatgttgagttgcttttaaatttgacttagtcgtggcctgactaaacaggattagatgtgagaaattttttggtataatgtataggaaggaactaaaggctgatgaggatgggagtgttggaatagatgttctgtgcatgagtacccccttcatcctctctgtctcccaagaaccaaaaaatactctctctgcagctttaacaaatactggtttggaagagagtgactgcgtttttcaaagttctaaatggctatgattgcaggacctttgtgatgctcaggaatgtcctgatgtcagcggagatgaaggaaaaccagagattcaaaagtcaaaggaaagggccatttaccataattcatatcatacatatttcctggaaaaaaaagaaaaattccttggggaaaaagcatcaaaatcatcaggaagtcttccacacagaaatgacttcattaatttgatctctgtcattctttcttttcattcatgtattattatccatagagatttctatcctgtgggttttttatttaatttttgtttgtttggttttttcagacacagtgagaccctgtctcaaacaaacaaacgtcacaggctgcagtgcagtggcacaatcattgctcactgcagcctcgacctccctgtctgaagcaatcctccagcctcagcctcatgagtagctgaaactacaggaacatgccaccatgcccaactaattttttaaaaaattttkttgtagagatgaggtrtcactatgttgccgaggctggtctcaaactcctgggttcaaacaattcacccaccytggctccccaraatgctgggattacaggcctgagccacgtacccagcctctatcccatgttttgattcatcatcatctcctaagccctttcccagcatcgatagtctactaaacatgccatgattaaattatatctctataccttgatataaacaaaaaattatatgagcagtaaagacaaatatgaaaaagtaaaattactgccaaagttrttaggaggataacctaaattatttgggtaggaaaatctttcttttttattttatttttttttccagccagggtctcattctgtcactcaggctaaattacagtggcccgatcatggctcactgcagccttgacctcccaagattcaggtgatcctcttgcctcagccccctgagtagctgagacaacaggcatgtgagacaatgcctggctcctttttatatttttagtagagatggggttttgccatgttacccaggctggtctcaaacttctaggctcaaacgatccacccacctcagcctcccaaagtgctggkattacaggcatgaggcactgtgccagccttttttttttttcacatctgctggaatggaaaatatttcttaaatgagacacaaatgtatcaaattgaaaatgtttaaacttcaaaggacttacatacatatacagtcattcttcgctcaatggtgagatagcttctgagaaatgagtccttaggtgattttgtcatgtgtggacatcatagagtgtccttacatgaacctagatggtataacctacttcacacytaggctacgtgataagcccattgcttctaggctacaaattatatagcatgttaccgtatggaacattgcagccaattctaacacaatggtaagtatttgtggatctaagcatgtgtaaacagagaaaaggtacagtaaaaatgtgattaacaaaaagatctttaaaatggcgtatctgtctaggacacttaccatgaatggagcttgcaggactagaagtgccctgggtgagtgagtgagtggtgagtgaatgtgaaggctagggcattactgtacactacttagactttataaacttaggctacactaaattgattttaacattktctttctttaataataaattaacttattaataattaactaataattttattatttatttattaacaattaataactaattaataattagttaccatagctttctgtraccttttgaacttttttgttttattattatactttaagttttagggtacatatgcacattgtgcaggttagttacatatgtatacatgtgccatgctggtgtgctgcacccattaactcgtcatttagcattaggtatatctcctaatgctatccctcccctttcctgccaccccacaacagtccccagagtgtgatgttccccttcctgtgtccatgtgttctcattgttcaattcccacttatgagtgagaacatgcggtgtttggtgttttgtccttgcgatagtttactaagaatgatgatttccaatttcatccgtgtccctacaaaggacatgaactcatccttttttatggttgcatagtattccatggtgtatatgtgccacattttcttaatccagtctatcattgttggacatttgggttggttccaagtctttactattgtgaatagtgccgcaataaacatacgtgtgcatgtgtctttatagcagcatgatttatagtcctttgggtatatacccagtaatgggatggctgggtcaaatggtatttctagttctagacccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgggttttgatttgcatttctctgatggccagtgatggtgagcattttctcatgtgttttttggctgcataaatgtcttcttttgagaagtgtctgttcatgtccttcgcccacttttttatggggttgtttgtttttttcttgtaaatttgtttgagttcattgtacattctggatattagccctttgtcagatgagtaggttgcgaaaattttctcccattttgtaggttgcctgttcactctggtggtagtttcttttgttgtgcagaagctctttagtttaattagatcccatttgtcaattttggcttttgttgccattgcttggtgttttagacatgaagtcctttataaactttttaaacttttctactcttttgtaatagcacttagcttaaaacgtcaacacrttatacagctctacaaaaatatttttctttatattcccattctagaagcttattcctatttaattatctttaccttttaatcttttttggtaaaaataaagacatacattagcataggctgacacagggtcaagaccaacaatatcaaccatcttcagccttcacatcttgtcccactggaagattttcaggtgtaataacacscatggagctgcatctcctrtgataacaatgccttcttctggaatacctcctaaaggacctggctgaggctgttttaatttttttatatatatagaaggagcacactctaaaataacaataaaaagtatagtaaatacataaaacatagcatagtcatttattatcattatgaagtattatgtactgtgcatagctgtatatgctagactttttataggactggcagtgcagtaggtttgttgacagcagcatcaccacaaacacatgattaatgcatcrtactatgaggttatgatggcttcaatgtcactaggtgataggaatttttcaggtccattmaactctcatgggacgacagtcatatatgcaattcatcattgacccaaacatcattatacaatgcatgactctataacacagtggggkgtgtgtgtgtgtgtttgtattttgtgtgtaagattaacactgaaattgaggtatcaactaggcaccaaggtaaaaacatattaacttttcctgtgaggtgtcaaattaccccatgcagaatttgaaatgcaaacgaccattggaggcttagaggtcttcgggttcaaaccrtcagagaatagctcattttaaactcatcctccmacrgtaaacaagtataaaagtcacaaaaaacatacaatgcagttgtgcagccacaaaacagcaaccagcacaggactatcaccttttggagaatggaagttcctgaaagggagattcacatccttatcagctttctttccagaagcatttgccaaaatacaatgaagagaaatggaacccaagcagagaaaatcagtctcrtcggcaaaggaaacagagatcagagttcaggcttggcacattgactgggatttaggggtagggtgctgagggagggagttacagacaagaaacccccaaaatctgcactcctgagctgcatatgctccagatgacactctaagaagcccactggagaacagcttcttggagattgcatgctaagtagaaatgtcacaggctccatagtgtgaggagatgttggaatttcagccctgcaaaacctgygttgagacatcaggatggggaagccgygtaagtgaggaccgtgaccttggagtaagaaccacactgaaatagrctcaccctagcaaaggctaaaatcaagagkaagcagaatcaaagtgggtctgatttttactaaaggtgattctttgataattacctaactgtcaaactattaccagtctttggaggaagataacaaaacccagakcytctaaaatccatcatgtagaatatgtgccatgccaagcagcagagagaatgcagcaactaaagaagaaataatcaacagaagccaactcaaagaygatctgaatattgaagtcagcaaacaaggacattcttcaaaatatttatgattaatatgttaaggaaaatagaggaaaagatgggcaaactatttcaaaattcccagaaagattaatcataagaagagaraaaamacaaatgaacactatgagaagggacattataaaactgtagattttattaaaacaaaaataagagaaagttagacacaacttcatggaaagagcttttaaaatttaggtatagtgacatgagttcttgaaaaagacggttgaacaragccaacagaaaactaagtagaaaatataaataatcctatatccattaagaaattgagttctaaatacattccttcccaccagagaaactccatgcccagayttcttcacctgtcaattctttcaaaaactttttaaaaggcatgtcagccttatacagtcttcctctggtaccttttgggatgggttctagggcacctgtggataccaaaatccatggatgctcaggtcccatatataaaatagcctagtatttgcctattagctatgcacatcctcccatatactttaaatcatctctagattacttataattcctaatgcaatgtaaatkatttgtaaatagttgttacactgtattgcttaggaaataatgacaagaaaaatgtctrtacatcttcagtacagacmtaaccactgtaggtactcctaactacagagtatacatcagcarcaacataacattttcaatcctaaggttgttgaattcacagatgtggaactcacagacatgaaaggcagactgtgtgctatggtttgkctgtttgcccacccaaatctcatcttgaattgtagttatcataatccccacgcgttgttggagggactcgatgggagacaatttaatcawgggggtggttcccctcatgctgttctcatgatagtgtgttctcacaakacttcatggttttataaggggctttttctgcttcggtttggcacttctccttgttgctgccatgtgaggaaggatgtgtttgcttcctcttctgccatgattataagttwcctgaggcctccccagtcatgctgaactctgagtcaattaaacctctttccttttaaattgcccagtcttgagtatgtctttattagcagtatgataacagattaatacactgtcttatattttttagataataaagagtaaacaccttccaactaattttatgaggcaacataagtcagacaaggacctaaacatgacaattatattacaagaaaaataaactcatcatcraaatgatctgatgaacatagccwccaaaattccaattaaaatattagtaaatagaaccaaataatatatgaaatggataacacataatgaccaaatgggatttataagagaaatacatggtagatttaacttcaaaatgtcagaataatctaccccaaraatagagaaaagtaggacaacatgtggttatatcaatagatgcaggaaaaccatttgataaagttcagtaggcattcataataaaaactaaataaactagacataaaagggaacttccctaacagaatacagttatttacaacaaagaaatacaaagaaatacctaaatctaaagtcataattaaygaagaaatattaaacactcctctgaggtggggacaagagaaggatgtccactatcatcacttttatttaacattgtactgtgtgtccaacagcaaaaatagattacataagatatatgactgtcttcttcaaggaaaacattatcgtgtatgaagaaaatttaagaagctctatgaacagactattaaaaataagtgaatttggcaaggccagtataaagcaaaaagtaacatttctatacgtgagtaataaacagtgagaagaactgacattctttaaatagctctatgtacaataccacaaagaaacataaattgtagaaataaatataaaagttatacaaaatctcatcattcagaattacaaaacattgctgagacaaattaagtggatagttatttcatatatatgargaagacaatattgctaagataccgtttatccacaaagtgatccatggagtcaatgcaattgtaataaaactcccaasagttttttttgtgggaattgacatgctycttctaaaatgtatacaaaaatgtgaggagcttaaaatagccagaacaatattggaagagaacacaattggaggacttaaactatcagatatcaacagatatttgaaagccayagtgattagaaaagtgaagtatttgttcagggataaacaaacaggaaaaaattattaaaatagagccctctctattttcttctatgagttttataatttagcccttacatgtaggtctctgatccattttgtgttgatttatacatatgctgtgaggtagggtttcaacttctttgttttttttcttttgcagagacagtgtctgtgtcacccaggctabagtgcagtggtgcaatcagagctcatggtaaccttgaactcctgggyccaagcaattctcctgtctcagcccctcaaaatgctgagattgcaggtggagtcaccacttccagcccctcaacttcatcctttagaatgtgggcatccaggtgcccagctccattagatgaagagtgtatactttaacacattgagttgtcttaacacctttactgaggttctttgcatatatctctttatgtgtctctgagctgttgtctagkgccctttcattttaatctgaatgactcacattagtatttcttataggaaaaatctactggcaatggaatctktcagttagttgttaattaactrgaaacatctcaatttctccttcatttattttaatttattaattgtgataaaatgcacataasataaaatttaccatcttaaccatttgtagtrgtagtgttcagtagtgctaagaacactcacactgttttgcaaaccaatctccagaactcctttcatattgcaaaactgcatattttcatttttgaagaataagtyttctagatatagaacttttggttgacagctttatttttgtagcactttaaacatgtcataccactctgacwttcctcagtgttttctggtatgaaattggctgttaatctcaatgaggwtcccttgtacatgatgcattatttgtttcttgctgctgtccaagttctctctgcttctatttcaacagtttggttataatgtttcttggtttggatgtctttgagtttattctgcttggtagattcacagatttttatcaactttggcaaggtttcacctgttaccctatatttttactctctctttctatctctcctctactttgggaactcccattatgcatctgtcagtccacttgatgctgtacagaggtgtcatagcctctgatcatttccctttatttttttttcttcctgctcttcagattgcataatcgtaattggcctatcttcaatttgctggttcttctgcctgctaaactctgcatatattagtcagcatggcrgtgtcccacaagtcccttaggctctgttcactattttttgttccttttttcatttctattcctcaaagtctatgatttaagatgacttggcttcgagtttgctgattctttcttctacctgttcaagtctgctattgaacatctctaatgaattttttttcagtaattatattttcccttctagaattgctgtttccttattatatttttaatgagtctttatttggtgagatattgttcttctggttcctttacatatatacatatatatatatacacacacacacatatatgtgtatatatatacatatatatatatatttacatatatagagagagagtccacggtcttttttatctatttgagcatatttaaactattggtttaaagtcttggtctagtaagtccaatgacttggcttccttagggacaggttctgctgatgtatttttttctgcaaatgggccactttcttaaacttytaaatacctcaagaattttcrctgaaaactgaacactttgaatacaacaatctagtaactctggataccatattctttccactccccagagtttcttgttgccacttgaggatggagttgtttcttagtgacttttctaaactattgttaagctgttctatgtcatgtgtggtcactaaaatctattctgttagcttcatggtcagctagtgatttgacagaggtttccttaaacagctggagccaaaaaaataaataattaatgccctcccaggttttgcagatggactctgagttgggacacttcttcaacacttaaccaggcagtttagacgtccaccttaaccttcactggctgcttacttggaggctaaagatcacccagaggtaaaagcctaaggtcatctcaggtctttttaaagartgtgggcatccagggctaaatatccagtgtttagccctggccatgtatgtgacattctgatttcctcagtatatgcgggatattttgaaagccatattgccttatgtatctccatctccagcctctacctccctaggcttttcagtctgtctgctgttaacccatccatcattccatgccccaggcatctgtgactagtatttgcctttaaatgcttttgacaaacattgctatggagacctctccaatcttaataaagttccaagaggagtgaagcaaagaccagcctctaagctgatctttttgggggctatcatrcatgtcaaaggacacaaacacaattctttgaaaagaaagttcattttgccttttctggcatcaggaaactacaccaggaatgtgggacaccgtccccatggctgcctcatagctgagggtgtgggggtgggagtgagtaggtggctaaggaatagtggcacatgctctcctaccaaaatctagagctcctttttcattaagcactactttggttgttgtaaaaaaaaaaaaaaaattcatagactccagagtacagaaaaacttaattttgatagtttttttccaggttaatagttgctttagttggggaatgtgttgttggagttctctaccatttttggtgaaggcattacagttgtcttttaataagattttaaaattatgaaaaaatcttatgtatctacccatgtgcttaccatttctggtgctcttcattacatatttgcttttggtataattttctttttgcctgaaggactgaaacayttattacagttcgtgtctgctggttatgtattttttcactccctataagtctaaaatccctttttttatagatatctttagagtctgttaagtagcttgatgcaatcattacacatggtatacatatatcagtacatcacacagtacctcatgaatgtattattatatgtcaattaaaattatacatatatatatgtttttaaaaggttttttttctggaaatagaatctagtttgacagcagttgtctttcagaactttagcgatgttgstcatctgtccctcatttgcattgtttccaatgaaataactgctgtcatctttattattcttcttatgtgttgtgttttgtgtttttcatttttgctttctgctttttcaattttctctccttctctggttttgaacaaatacrtgttactctcactcacaactataaagcgaacttaggaaacaatctatagggagagtttgttgatgattggttatacattttcagaaacagttgtttattccttcctttacaaaggctaatttccttagaatattattgtattgaagaatgtcataaataattttatttgtcacctggacctggtgccaagatacgtggtcaagcattattctggatgatytttttaggatgtttcttggatatgattaacatataaattgctatactttgagtaaagtagattgacctctataatgtggacaggcttcattcaattcattgaaggtgtaaattgaatgaaacactgaccttccccaagcaagatggaattctgtcctgggatttgaactgcagtatcagtcasctgacccataaagagctggttggtttgtgtacagcatttgcaagatgaatggacaacaccctgtttggaagtctacccytttgatcaaagaagataaaaacasaacagctcttgtgggctgaattgcagggtgttttcttagcagtgatggaagaattgaacaaygataaaagctcctatgttttagttttactgacttatgggcagtgactgatggcctggccatataattaattaagaaagcagtggaaaactggcctatgaaaagaatgcccatatgagacacagtcctrtggaaatcactatggtaatttgaggggtgcattaacgtaagacwtgttgatgcctgatatagattggatgttgtccccacccaaatctcatgtcgagatgtaattcccagtgttggagttggggtctggtgggaggtgactcaatcatggggtggtttctcatgaatggtttagtaccatcccctcagtgctgttcaatacccatcagaataactcccttccaggtttggaaggtgattgaaatcaacaagcatttatctctaagtgcttgccaggtgcacctgtagtcccagctatgasagtgtctgaggcagaaggatatcttgagtacaggcatttgggtttagcctgagaaatatttgagtctagcctgggaaacatatcaagaccacatctcaaaaaaatttacatttgcttgtgaagatcaccggggtctacgaaataagtagacactgaggctgtagcaatgcagagatgggctgaatcaagacatactccccttgcatcccccacctctaataagcacaaaatactcagtaaaactgttctttttaacaagactgggcacagtggctcacacctgtaatcccagcactttggcaggccaaggtgggtagatcacttgagatcaggagtttgagaccagcctggccaacatggcgaaaccctgtctcaactaaaactacatcaattagccaggcatggtggtgcacgcctgtaattccagctactcaggaaactgaggcaggacaatggcttgaacctgggaggcagaggctgcagtgagccgagatggcgccactatactgcacccagggcaacagagcaagactgtgtctcaaaagaagaaaamaaaagaagtattctctttaacaagaaaagagacagagacagagaccaaaaaaaaaaaaaaaaaaaygtgaatgggaggtattgccaccatgtggaccactgagccacattacactaggaaacacacttgcccagaatgtccaacaatggtcagagaaatttgttcctcagaagaagagtttcagagagaattaaaatagtcatttgaaacattgagtgtatraatcaggagcggggagacataagcatgaagggcgggcctatacaccttcatgagtgtgctcgctcttgacatgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgcagtrgtctcaggactagggatgcaaataaaagtccaggcacaggaattattcctgagcaagaaacygtwaayatatttaaaaaccattatgcaagactgcctaagggcctggagtagatgtgccttcactgcatctggcaaagttggagctaacattgaatgcagctgtattgcctggaagccagatagccaaccagttctctgcctgaataaccctaacctctatgaactggaatggactgatgggagacactcgctgttactagcatggtatagctccctgcataggccagcacagcaggaaaayctaatgtcccttccaaaatgagaaatatttggtataaatgcagaagaggaagaatagtagctgaggtgaaatgaatgaataaatggggtatgtaatgaggaaaatccaatataacatgatctcctcaaaagaggtataaacraatgatgatattgtcttttatctcatttttaccagatgtctgaaaggttgaagccrtatgttgctgagaccattgctatttttggactgcaatgggcgaattgataatgactaaacaggactctggtaatgggccagtatctttttactgctatgattcttctgctataggagatctgtggttggccaagcaaaggggctcacatttataatttcaccactttgagaggccatggtgggaagattgcttttgaggccaacagttgcagaacagcctggggcacataatgagactgcatttctacaaaatatttaaaaattagtcagccatggtggtgtgcacctatagtgccagctgctcaggagacttgaggcggaaggatcacttgagtccaagaatttgaggttacagtgagctatgattgtgccactgcattctaccctgggcaacagagcaagacattgtctctaaaataaaataataaataaataaatagaaattataagaagaaataatgtggttaaagaccaggaagtgatctgtgatccaataaatatatttggtctttgcccctagtccctgacaggcaggtcctaaaacgcttgcagtccctcagtgataagcatgattttaatatggcaatgagatgactatggggtgagrggctcctagatagtttcaggatggaggctgcttgccagaaacaccagctgtgattagaggattggaactttcactgccatccccatcctctggggaagaaaagggggctggaagttgagctcagtcatcaatggccaatgatttcaccaatcttgcctacacaatgaaacttccatagacacctctagacagtgagttttggagaacttcccagttggtgagcacatccgcatgtccacgtgctgggaggacggcacacctcatctccatagagacagaggcttctgcgcttatatctttctgtaaggcagacacccttgtttctaggagggacctagggtggactgtggatyctttctctggggcaaataaaaatgtagaatcagaaaattcaggcactttgcactcctcatgggacactccagcagcactcacgtgaccatcctgagaatggacaggacacctgaggtrgggaagggagcacagaacccagacaccagcctggacacaggcacctgggataatctcctattccttggaaagttccagtatctgagggaggaacagtsacttctggtcctgacctgagtggagaccgagggactcagaagagctggaatcagacccccacacacactgagtatgagtcagagaacaaggcctgagagaaaaagtcacagtgcccaagactgctgcaggggtcaaaggggactgctgatcagtgttccagggatttgctccagattaatctgagtcatggaaaaactgcctttcttttgtttctraacaaatacctgcaaagacaaaagaccacataaatccccagrtgcacaactttttcagatttaaagaaaaaacaacccccgtctttccctccattcccaggagaagctcactctgtggcatcaagctgcctgggtgagctctcttctagaagagtccagggggacaggcaaggaatgggaggcaggaagtccagttcagggagggggattctgggatgaaaagtgaagggagagggactgagcccatgctgagggtttttctctggtttctcagacagctccggggccaagattcggggagacattgagacagagcgtttgatataaaagaagggggtaagagccaagtcccagggcccggagcttggctctctgggcttcaggccccgagggcggtgcctgggatgggccggctcagctttggggtttcccgagctccgctctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtrcggggtcgggagggaaaargcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggacacatactgtccaattcccctgkggcagctgtaatgtgtagttcaatgggcactcatttgtccccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggycagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggcyccatcaggcttatttgctaaattacatggagataataggcaaccccaacaccaccccacatcctccagctctctaatggtggtgctacccccacagcacttgcagtgccttccacaagattcaccctgggacataygatcatttttgatttggscagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggracaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccrtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacakgccaaattcccccagcctcattattccmtcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattccygctgcattataagggtgaggcttctgcagcatcttccagcrtaggaagtgggaacyattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaayaagggcctctccatgagacactgcagaggcctcacacrtagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccgggaaccagggcatcttctcaggtccgtgctggggatatccacagcagctcagctgcaccttgtgccatggactttctctgtccccaaccaacgtggatggcattctcggcctgccaggcagtgggcaagctcagccccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgrcgcaagtggcttttttatttttattttttgagcaatctcagctcactgcaacctccacctcccaggtgcaagtgattctcatgcctcagcctcccaagtagctgggattacaygcatgcaccaccaaacctggcaaatttttgtctttgtagtagaggcgggttttcaccatgttagctaggccggtctcaaactcctgacctcaygtgatctgcccaccttggcctcccaaagtgctgggattacaggcgtgagccactgtgcccaaccagactgcaatgcaagtttaaaccccagtgaaggagagagggaaggaagtttggctgaaagtatcctasacccagtgcaggttaagagaagttcagtaakggtgagccctggagcctcagtgggcctttaaaggagrgacaatcctgtctttgtttctcctsttctctcaattattgaatcgaagaagccaatggcaagtatggtctgagagcaaacgtagcaatagatttcaggcggcaacagctrgagcatcatcagytgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactgsctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagygtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggmagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatggraagtgtgagatagagagtatggaagggctggggttcttggccatgatgagacctaggactctttaggggagaacaacaamaaagcaacaggatcctggtgtcagggacagaccatggccatggcgggatgatagcagctctcctacraaataatgcttatatgacaagggcatgagattcaggcagagrgaggagaaggtcatggaggagaggagtcccagcatctgagaagccagagggcgatgcatcctctctgctctatgggtgtttattgctgccataaaaattaacacaaaacaagtggstttaaacagcatctctttatcatgtcacagtcatgtgtgttacaayttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcatacatatcccatgcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccggccagtattttcccttttgcctgtaatgcaacctactcgtgggtgcccaggtattgagattggatgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagggagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtatmatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctcttatattctaataattaagactttaagctgtgtacacattgcaatgcaagtatgcgtcatgcataaccctagcactaagagtcaagagggaaagtacctctcccctaacattttacaaagtttctgtgttctttttccactgagtgggaacaagtcagctagtgaggaacatgaggcctttggcctcatctaaagatactttagctaccaattgtgagaagcactgaccaccgggaaggcctccctgcctggttcctggacctctataccatggcagaggccatcttccctcctagtgcagagtgatgtcccaggtagtgacctggttagccattgtccactctcgggcagttttgccttctaagacattggtttttctctgaggacctccctgttttcagatgatcaaaactggggccatccactcccttctgaaccacctctgcccagtggcctgtggctgtgcccccagtcacaacaggacaccccttcagaacacgctgcaggaagccgacatctctacacaggctcacacatgcacagtgtgtgcacggagctttggttctagttcaggaagaatgggaggaggctcactagtccaacagagcttgagccctgtaccagtgtcatattccaggagccagagttacaagggatacaaagtgcccagacctaccagagaaggcaaacccctacagcatgcagggctagacaggggcaagaaacaaggtcattctgggccagcaagaagagggaaagggaaattacagtcatacttcagatatatgcaggtttggctccagaccatggcaacaaagcaagtcacacaaatttttcagtttcccagtgcatataaaagttatatttacacttgactgtagtctcttaagtgtacaatagcattatgtacaaaatgaactatgtacataccttaatgtaaaactactttattgctaaaaaatgctaacaatcacctgaggcttcagctaatcctaaccttcttgctgtggagggtcttgcctcaatgttaataattgctgactgatcagaagggtggttgctgaaatcgctgtggcaatttcttaaaataacacaacgaagtttgcagcaagattattctcctcacttggacacttagaggccattgtagggttactaatcggcctgccttcaatatttttgtgtctcacagaatagggaaggccgggagagagagagagagtcaagaaaccagccagttggtggagaagtcacaacatacacaacatttatcaataaggttcaccattttataagggtgtgggtcatggtgtcccaaaacagttacgagagtaacttcaaagatcactgaccacaggtcaccatacaggtgtaataatgaacaaggttgaaatacttcaagaattaccaaaatgtgacacagagacatgaagtgagcacatgctgttggaaaaatggtgccaaatagacctgcttgacacagggttgccacaaacattcggtctataaataaaaaagcaagaaaaaagaaagaaagatggaaagaaagaaaaagcaaaggaaaaaatgcagtgtcagcaaacagtaataaaggaaagcacagtggaaggtgcacctgcaaaggggaaatcagcactgaagcaaagtcaggaaaagctttcaagtcagatgggcctggacctgggcatgaaccctccaggtcctcccaccagccagctraagaggcctgagcacatctgacccagagctggccccgacagacacttgcccagtgagtgagtgctgaatgaaaccatctgagccagtttcctcatctgcaaaccagtgacataattcctgccttgcagagtttcagaagaataagtgagaaaagacacagtgccaagagaaacagacacaagacctgtggcgggctggacaccagggctctaaagcaagttctgcctaaactggcragaacatttttcaggtcaggaacaggagttgttctggattctgtctggggtcaggctgggagggagctgggggtggcagagtaggatgggggcaagggctgtggcagggcctggcactgaagtgaggccaaagcctggagagagtggctcctggtggcttttgggcagctcacgcaactccctgcctcacccactgtgtgagtcagcgttctctagaggagcagaactaataggatgtatgtacatatgtaagggagtttattaaggagaattgactcacacgatcacaaggtgaagtcccacgacagaccrtctgcaagttgaggtgcaagaaagccagtgatggatcagtccaagtcccaaaacctcaaaagtagggaagctgacagtgcagccttcagtctgtggccaaaggtgtttggctgcagattccaggacaggaccttcttgtcctctgcagtgaccccccacctcgcctgactatatctgtccaacttgatggtgccaccgagggttctgatgcagggaaggagctgtgtgctctgtgtgggaggatgccttctgcctttctagctgggcctcaggtcagggctwtgagcctgagcagggaraggagatggaagggagatggccttggagcaaacgtctgcccctgccagtgcatcccgtaggtatcatcccatccaccagtgccttggcaggaccccactcactcaaccctccccctggtggtagtccctggtggtgcctcctcaggacctcctgcctccagccgcacaaatccccaagaatggcacgtgggtacaagggtgttgggaagtgtcatcctccagtgctgacttgagtgtgtgtgtgtggctgcacacgtgtgtgcatgtgtgcacaagtgggaattggagtgtgtgtacacgtgtgtaagtgtgagtgtgagagtggagcatgaatgtgcaggtgcccacaggcagcagttggggtgccagtgtcctcactcctgcctgctttcctttctctccaaaacgtgaccacacagcaacttagtgactatctagatttaagtctatcaaacagaagggaaacacaactaggattcctgtagtgtagggaagggaaatgcctagcccagctctctgattccccttttaatgggtttgagctgcaatatgggtgcagaagagcctcccacagygccactggtggtggaggaaatagcccctctcattggcccattttcacgctgctgataaagacatactgggaagaaaaagaggtttaattggacttacaattccacatggctggggaggcctcagaatcatggcggcaggtgaaaggcacttcttacatggcagtggcaagagaaaatgaggaggaagcaaaagcggaaacccctgataaacccattagatctcgtgaghctatcacaagaataccacgggaaaaactggccccagtgattcagttacctccccctgggtccctcccacaacatgtgggaattctgggagataccattcaagttgagattcgaatggggacacagccaaaccgtatcactggatgagagcaattagattgatgtcatgatgtatatgggtccatgrgaacttgaaaaagtcttccccttccacctagtttaacaagataaacaggaaaggaacttcccttaagggaagatattgactctatccctgaaattaaatcacaagraaataagaaatgcatgagatctaaactaagccatttgggtaaactgtctcagaatttaaagcatcwgcagtcacaagctatcagtatcagtgacgattctttcactccatggtctagtccaacgagactggtcagggcttgccgcctgctcctcggtgctgtcctggtactttgaaagtatctgtgattctgtgaactgcaccsccagctgcccaacaacttccctttgctgatctgagccagactctgcttttatggcttacacccaaataattcaagttattttwaaaaaataataataaatcaagttattcatttatgagttatacagtcccatgtgggkaaagggaaggagagtgaggtaatactcaattttactacctgctatgcatttataagtgagatacttctttttaaagtcatatttttggattagaacaaactctggtatatttaagtaaattccctgaagaatgtgaacaccgtaagcaggtgagtgcattattctctgcttcccctccacagagctgtggttcactctcctccatcctgccccctgcactgggggcaccacagagacagcacggcctgtgctcctgcacmacctgcttctgcttgggtgtggatgataacaggcacctgcaggagatgggagcgtggggggagaagtaactcagggttttcacttccctcactccctttggacagctctgcggttctgtaatcattgccgtcctctacctacagccacaggcctgcggggctgcccctagtgaaagctacagatttccgtgagttctggaaactgctccctcttccttgttctttcaactcagagatggaaacagtttcctgccactgatcatcccagggagcttcagcaccccttgtggctttcttaggcctgccagcacctctgtaatgtgtgtcttctttctttgtcatctctttcctgccaggaccctgactgtcccacagaagaagtgacaagaatttatttatgacatgacaataacacatgtattcatggtgttaattcgatttgtttcatagagacagsgtcttgctatgttgcccaggctggtcttcmactcctggcctcaagcaatccccctgacttggmcttccaaagtgctagcattacaggtgtgagccattgtgcccagcccttaacttgaaaatctgacagtataataaaagaaaaaaatagaagtattctggaaatggaagaggaaagaaggctaaggtggaaatcatcaatctgtgtcatctgagaagccccacgtgcagaggctgtcccgggactttaggggagaacaaaaacaaagcacccaggatcctggtgtcagggacagagcatggccacggcggratggtagtggctctcctatgaaataatgctcataaacatcccttgtgagaaggatcagatcaacatataaaaatatgccaaataaagtgaaactcaaggcaggagtgggactggccattctcagcccgygacctccatggacttggagaaaggctcagcctggagatgtgtgaggcctccgacctggagcagcacccgcccctaaagaccaggcacaaatcccagcacatggagggatccagacaaatacacaagagatgaccacagcaggagctttactgggcacagagcgaggccrcacaccactcagctcctgcccctccacctgcccttctctccccacctgcccctgccccagcacagcagatcctcagaatccaaaaagagaacctaacttccatgttttattaatggcttataatattttatcacatcttcagaaaacactatgcagaagataactgtagagcaagacatctatttagggtgagtgagtcacagtggagatctgggagggagaccctgtaaccctttcattccaagaaaagaaaggtcgatccaaagaaggggaccccaggcctggatattgggattacatgaaaggggttctggggcatcaggggaatgggtccctctccctacatcctcccggggctgtgcttgggaggacagcagctgggggaagaaaagtcagggtccacagagatataagggggctgagaactatctgtgtcttgctggtctgcacaaggcagctctcaaactgtggagaacatggtaatgaccagattcagctcagccactctcagcctttacacctagagcattatgggcagcccatcaccatcccctaccttcaaatccaaagatcgctacagcccaaagctgctccctggcctcaactcctgttggtatcaggccccaaggaagctgtgagcacgtctgcctgggaccctgtcaccatctggagaatgacaataaagaggacccagcagcctgcaggaggagactgtatttgaggcaggaccatgggatgggtgaggcacaggactgtggctccatcctctctatttgaggagttagagatgagctgcctctgccaccccttccatggtgatatttctagagtacacccctgtgctgaaattcttatgaggaaagagacctgatgagatgctatggtgaagaggggccataagggtcttgaataccaagttaattttgctaccagctgagattaggaagtgaagcccaggacccaggagaggaggaggaggagataacacaggaccctgtgatcactctcctggccatctgtgtacagtgagacgcttcccttcrgggttgggagcacccagtgtcatggtcctgagtgttgctaccctgctgttctcatctgtgaatgcagccagaccactttcttcctctgatataaataacttggaggatctgtcaccagacacctcatatctacatattaataaattctgtacagtggtttggcttaatgttttatatgttataagaaataagcaaaacatagggatgatatttttagtaaaggtatttcagggtatatgagaatcagattcctagggccctgggtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttcttggccttcctggctgctaatattccagttcccagcagcctcctctctcacccttcacctcttctgactgggtgcgaatggtaactagaccaggcagtgccctccttgtcagtctgcctgtctgcctggytccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcytcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaacgtataagattgtatgtacatggtggcttggtttccaggaattgctgattaggtaatttagaccattccttccactgagtacaatgggaaaaggaggaaaacatacatatttgaaaaatctggttgagcaaatggwtgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacrgtcccttggtctctctagaattcagtgctcatttagaccgggctaagaccctcacactcaatggctggaggatccaagcttatggcatgactgcctctggagcatttcatgctagagagatcccaacaggtgtaggtaaatggtctagagggtactagccaggcttccatggaactctgtgtaaggcacttccctgtgttgttactcatgttggccatgtcctcgggaatttagtggaacggccatgtcgtcttgagtggaagtgaggacggtgagggggtccctgggcagtcagagattttgtgtccctgcgtcctttccttccatctcaaccagagaccacttgtgaaagcccaagaacaaatgtcattaaatgtccgaggcgaatccaagaccaccgatccattgcgcccaggagccttgggccatgtagcccagcagtagtgaggtctgtgaggccttggtcacccccaaagtgttgccccaagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccctgttgttccaagtgcagaagagaaagcttcttcctgctttcagctgcgtgactgacaacggaagctggaattcagagaatcagtggcagcctctgtctctccaggccccaaccctgcaggtttaaggaatggacttaggtctctggcactttgttctcaacacacattttccttcactcattcagaaaaaaaaaaataataatagaaaatgaaccaaaggctgcaattctcatggcacctagagaactggagtacggaccaaggttgccacatgcctgtcattgctccaccacactcggttgccgtgtgacctcgggagaagctctctaccactagggacttttaaactcatctgtgaatcctggataaacacagacattccggtaaccttactgaaatgaagtgaggaccaatgagttgacaggtggagaaaaatttttttttttttttttttgagacggagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttagtggagacggggtttcaccatgttagccaggatggtctcgatctcctgacctcgtgatccgcccgccttggcctcccaaagtgctgggattacaagcgtgagcctccgcgcccggccgcagaaacagaaaaatttaagtgatggcctttactcctagacagggcttttttaggaacatgcaccttaaaagtaggaggaaaacataatgccagcaacaccctgcctaaaagcccctttagtgatgataattatcattcatctttctataaaagtacagcaagactttctacctcaatatctcaaatcagttaaatatatcttctgatcatataccagtgtggacccacatgttttgctccaagtgaaaatgaaaaggaatgagaacatctccacctttgtgtggtgaccatgggaccacggaggcttggaagccagcctacatctgcccaaactctacatcacctgccattgtcaattttcaatctatccgttctatgctttggaatcctacataattcatactcttgaaaaatctcattttcatatgtagggcagggtagaaaaggtgatatctctgttttaatttgctaagacttccataataaagtggcacagactgggtaagttaaacagtagaaatgtattatctcccagttctggaggctacaggtccacgatggaatgtattgcagggctgattgctcctgaggcctgtctctggcttacagatggccatcttctccctctatcttgtcaacattggcctcaaaatatgtgtacagggacacagtttagcccataagagtctgcgccatccttggcggtgcatattataagaaataaaagagaatacaaccctttggctggactctgttgatattttgaaatgttggtcttgcaataagaacaccaccaaaggccaggcgcagtggctcacgcctgtaatcccagcactttaggaggccgaggcgggcggatcacgaggtcaggagatcgagactaccctggctaacacggtgaaaccccttctctactaaaaatacaaaaagaaaaattagccgggcgtggtggtgggtgcctgtagtcccagctgctcgggaggctgaggcgggagaatggtgtgaacccaggaggcagagcttgcagtgagccaagatctcgccactgcactccagcctgggcgacagaccaagactccatctcaaaaaaaaaaaaaaaaaaaagaacactaccaaaacaagggagccgaagtttagttttccctggaaggtgagcactccctgagcctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcacataatatttatacatactttggggtacacataatattttcatgcatgtgtagaatgtgaaatgatcgagtcaggatatttaggatactcatcacctcaagcatttatcagttatttgtgttgggtgaatttcaaatccactcttatagctattgtgaaatacacaatacattgttgttaactacagccagcctgctgtgctatcgaatattagaatttattcctcctatttaactgtatctttgtacccattaagctacctcgttttatctcccagatcccccacacacccttcccagcttctggtaactattattctactctccacctccataagatcaactttttttcagttctcacatgtgagtgagaacatgtgatatttgtctttctttgcctggtctatttcacttaacatactgacctccagttccatccatgttgctgctagttattatgaggtagttctagctggaagaatagagaattaaaagaaatctttgtgaagcccctacccaggtttgtcaatttgtaacattttaatattattggctatatgtagtatacatagaaaataatagaaatatatgcagatagccctgattctccacagttctgttatgtatgtgtttccgctgaaacacatacagtacagtactctatgtactgtacagtactactgtactgagtactggactgccagtggggagtggcggatgtcttgaatttggtgaatgcctttatattgctacaaagtgtttttttttttttggttgtttgttttgagacggagtctcgctctgtcgtccaggctggagtgcagtggcgcgatctcggctcgctgcaagctccgcctcccgggttcacgccattctcctgcctcagcctcccaagtagctgggactacaggagcccaccaccacgaccggctaatttttttgtatttttagtagagacggggtttcactgtgttagccagggtggtctcggtctcctgacctcgtgatccgcccgcctcagcctcccaatgtgctggcgtgagccaccgcgcccggcctacaaagttttttaaatcctttcgtttgacatgattttagactttgtaaaaattgttttttgttgaatgtatcattctgtggcttgctttatcgtttaatatggtctatgaggtgaacccacacacccatagaaacagttcatttgttttcagtgctggatagtatttatgagacgaatatcccacaatttatctcttctcctgtccgcgacctttagcttgtttctgttacagacactgccacaatgaacatcctgggtcatctctctctggtcccctgtgtgagttccccaagatacggatgtaggaatgggattactgtgcttttaccatgtgatgttataggatgtcaaattgttctctgaagaggttgtatcaactcccccctttaaaatcttctttgayattttacaggtcaagttatcttcctccccaactagctgctcmgcctcagtcccccttcattggctccttttgctgtagatgctggagcactgtggggttttactgcctcccaatcactctagtgtcctccactcccaggattttaaatatcgtctagacacagatggctcccaaatrtatatctctacatatttctataatcaaaaaactaatggtaccaaaacaggtactctgatatattgcagatgggcctgcaaactggaaatgttttcaggaaaggcagtatggcaatttctgtctaaattaaaaatgcatacacccagtagtcccacttctagaaatgtgtccaaaaatagacctgcattcctgaaaaatgactgtattcagaattatatgttgcaaccctgtttgtaaaatcaaaaaggaaagaagaaagaaamtgaaagataaaagaaaaaataatccaaatgtctgtcactagcggactagttaaaaaagcattgcaagctgrgcacagtagcattcacctgtgaatacactctactccactctgggtaacatgaggaggcctccctaccttcctaagaaaacccaaacaagcactgcatatctacacggcggagtctacaaacatttaacacaaaagaagaaagacataggaaactcttgatattccctcatgggatggtctccatgatacattgttaagaagaaataaagcaaggtgtagaataacatatagagtctgctaaaatttgtgtgaaaagggacaaagagatatatatacacatttatatttgcttgcatatgcataaaatatatttggaagaataagcaagaagatatccctggttgcctgttggggatgagacagggtaagaaagagacattttaccttttgaatattttgaattttgaattttgaactatatcaagaaataaaagataattcctagggcaaccaaacaaaccccaaaaaaattcaaaatgaaaaaccttttaaaaactaatagaatttttttacctttattaaaataaattttaaaaattttctaaatattatattattcctttaacaaggaggtttaccgccattttaattcagtacgttgttttctttttaattgcatgatctttctttacatctatcttttttccattacaaggtaaaataacagcatgattaattaaatgcaatttgtttggtgaatgaaattttgttcaaatcttggtctaagtgggaaagggattctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcggtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagattggggtggggagctgtccagggtgggtcaggtgtggtctcactgatcctacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctgtgtgtgtgtgtctctctctctctctctctctctctctctgtgtgtctctctctctctctctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctatcctgggtgcctgtggggctcccacttacaccacaaaacaaagctcaaataatattattttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcgtggatacaaagggtgaggttggagcaaaagtttaataagcaaaagaagaaagctctcccccacggagagggggcttggaagatggttgccatttttacagctgaatgcaaaggcttttacaagaaactgatgagggctgggtgtctcatttgcataaggcacgaatttccggtagctccaccccatcctcctagtgcccatgcaggcccttagcttgagttactccatattgctttgtttccctgactgcccatgtatcgggggacagaattttccattgcgggcatgtctggacaagtctcctgtgcagcctttcttatttgtgcagctgtgggcatgtcttaggcaagcccccctgtgcaagttcccttctctgtgcctgcaggccgttcttttgtttgaaataattcaactgaggacccaccataactgcccgcctgaccagtttcttccttttttctctctcaatttgtgttatgatttccttactgatctctgcctgagcaagactgggcacgccttgagggcaaggagggtttatttcctcttacctcagttccagctcctcttaaaacaatgccccacgcacagtaggtatttgataaatgtttaccaaatgaagggattgcctggaatggcttggcagacaggaaagcagaatgaaaacccacaggccaaaagtggctgggaaaagattttccaaatcctagtgctgggcacagggcccactgaaattcactttcggaaccttcccatctgtcttgttctcctctcatcagggacttccatgcccctcaaagcccacctagtcacacactacctttcaggaccaccttccagatcagccaggtgcaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgctccaccagaaatgcagagtttttgtatgtgcgggtccggggtcttcaggagataaagaatgatagctccaggagcgctgggacccccgtgcagccaccagtcaccacagcctaggcaggggttgggctctcacctcggcccctcccctgcacgccctggatgtggatggtccccgagtgtgaactcgcctgggctctgaccctgggtgctcttcccgccgttgtggagcctctgcgggtgtggtgcatgcacagggggcttcacaggagacccggggccctttagagtctcaaggccaacattcttggagaatccatgtcaggcattcaggctctcagagactcagatgcccaaactatgaaaatgagagaatctatcccactctctcaggtgtggtgagattcctattatatgactatcggtcatctatacatggattgtactctcagagttgcctttatcagtcggccaatgcctahaacccaaagatrggtcaggcatggtggaggamgagttcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgargtggcttactgcaacaaacccagtgtaataaatacatacgaattactttaaaataacaccaaggaaaatatacattttaaaagattaaggctggggtaaagctggaacattactaggcgggaaggaacatctgaaacatttgctgaaatggagttgaccctttacctagccatagatttgttgcctcacgatttcattacatctgagcaccagggaggggggtggcagttcaggtcaccagtcccttgtttcctgcttcaggaacagtgtcctgttctatacttacagtcaaagcaaattacatcgttgtaagatgtttaatgatgaagtcaaagtccacagagtcagcaagtaagtgtaaaaacctcaggagtccaaggacagtctacgtttctccccagaaatggcctcactatgcactgttgaagggagagggtcctttcaaggggccccaagatgcaggagcaattgggctgcagctctaaataaagatgtcctttctacctgcagattccacaaaacctcacaggcaaatttggtgatctcacctgagctaggaattcggttttttgatgttggttctctttgagccattgtgtgagctttaaaatgtgacgtggagattttgctatactggtatttccttgctggaatttgacatccacagtggctctggcttccctgtctggtcccaggaggaaatggagtgtcctgcactttttttcagcatcgctttgtgtaagaaggatcaggagacctggagtcaggggctcctccaatctcactctccttcataaaacagtgtcccttaagctttctgggggtgagggccttaacaccgtgctgttctgatgaatataattgtcccagctcccgaaacaaaagcacaggtgcacaaaataccgactgttgcaagcaatgccaaggtggggatgtttcctaggtgccaggtttagcactttgactttgtatgtacacacacaggggccaggcgttgtggtttatgcccgtaatctcagcactttgggaggctgaggcatgagaattgcttgaagccagaagttcaagaccagcatgggtaacaaagcaagacccagtctctacaaaaaaaaaaaaaagaaaagaaaagaaaaaaatacacacacacacacacacacacacacacacacacatactgggtgtggtggctccagtctgtagtcccagctactcgagaagctgaggtaggaggattgcctgaatccaggagttggagcctgcaatgagctgtgatcaggacactgctctagcttgaccatcagagtgagaccctgtctcaaaaacaaacaaacaaaacaaaacaaaatacatacacacacacagccagagccagcactgagggagaggctggcctcaggggtggggtcacaggcatttctcaggtccctctcagtggtctttgtctctttttcctggaggtggaggagtctgtacttcatgaggagaagtcctctgaagaaggcgggagatactcaggagcggggtccggagagggaaaaggatgaggaagtggagacaaagtggagggggcagggcaagaagggcacatgtgaggaatggggagggggaggaccttccagctgtcagaaaggtcccacgcagaatttggctcttggtttttctgctttatcaggatggatttgggaaaccagccggagcgggagataaggagtctactttgcaaaggacacgtgtgagtctcctcctaatttgaactcatgagtagcagctgacagccaggacccttgtgtggggcgcgtgacgcccctttgcaaccagggcgttttctgcaccccaccagccatccctcctgggaccacgctggtycyctccaaccctaacagggagagaaggaaggagaggtctggaggctttgggtcctccctcgtgctccttcttcctctgccatttattccctgagtgtccttgactttcctccgctacccggaccccactacagcaaagcacatcctgcacactggcctggactccctttgtaaccacccagtgtgttcaccttgctgactgcctagacaaagccgatttatcaaggcaggggaattacaatagagaaagagtaattcatgcagagccggccgtgcgggagaccagagttttattactcaaatcagtctccccgaaaactctratcagtttttaaggataatttggtggatarggggggccagtgaatcaggagtgctgattggttggctccggtatgaaatcatagtgagtggaggctgttctcttaggctgagtcagttcctgagtggggggccacaggactggttggcaggtccagatggggtcctccagttgttagaaatgcaaaaacctggcctggcgtggtggctcacgcctgtaatcccagcactttgggagcccgaggcgggcggatcacgaggtcaggagatcgagaccatccttgctaacacggtgaaaccccgtctctactaaaaatacaaaaaattagccgggtgtggtggcgggagcctgtagtcccagctactcagtaggctgaggaaggagaatggcgtgaacccgggaggcagagcttgcagtgagccgagatcgcgccactgcactccagcctgggcgacagagcgagactccgtctcaaaaaaaaaaaaaaaaagaaaagaaagaaagaaaaagaaaaaagaaatgaaaaatacatctcaaaaggccgctctgaggttcacaatagtgatgttaccttcaagagtaactggggaagttgcaaatcttatgacctccggaataatggctggtaatattcagaattccagcccctctcatcctaacttaatggctggcggcctttcattcgttttaaaagaacactttccctttaaactataaattccttcccaaggctagttcggcctatgcccagaaatgaacaagggcaggttagcggttagaagcaagatagggtgagttaggtttgatgtctttcactgtcatcatttccttacttataattttgcaaaggcggtttcaccttggcttcagccccacccatgcagtaacactgtgccctgtccttccaaccactgccactaggtgaaagcagagagagcatcgcccagatgggctagattcttctcacaggctcactgctagaacgaacattcttgagactttagatctaagtcagcctgattcctgaaagccttggaccgtttccaaaatcaaatcaatactccaggaacaagatctgcctcgactttgtctccatccaaggacgctatggcaacgcagttttcaaacgtgctttgagaataaatggaacagggtcccctgtgtccccactcatttgcgttttcctttttattacagccaaccccttttgtaaatattgttacacatctctctattccactgaaaacatctctttcaaaggcactttaagaaagattcaatgacatgaaaatatgaaggatcctcttgaaagagtttctggtggtgggttttaaagaacattttggtttttaaaactctgtaaccattttggtgtggggcttagcttcgtattttcaaattgaaatattctcttccttaacgtccgcataaatccaagttcacaatttttattattttaaaattttatttatttttgttttggggacagggtctcctcctgtcacccaggctggattgcaatggcacaatcatagctcactgcagcctggaactccccggctcaagcgatcctcctgcctccaattcccaaagagctgagattataggcatgaaccactgcaactcacccaaatccaagtttatactaaaagataaaattccaacatttcagagaaaatgaaagtcacaaagttatcccagtctctgaagtcactgtcaaaactttggtgaggaatcttccaggttttcccctacttaaaatatatattaatattatgtaagtaatattagcggcattttcacccaggctggagtgcagtggcacgatctcagctcactgcaacctccacctcccgggttcaagcaatcctcctgcctcagcctcccgagtagctgggactacaggcgccggccaccatgcctggctaatttttgtattttcagtggagacagggtttcaccatattgaccaggctgatctcgaactcctgacctcaggtgatctgcccaccttggccttccaaagttctgggattacaggcgtgagccactgggcccagcctccttaaccttttaaaaaaggttaaaagtatgctgggcacttcttttcatagcaatacttaaaagcgatcttactctttttaatgactgtatagaattttataatataactcttctttgggagacaattgaaatgttctttatcttcactgtggtagtggagatgtgggtgtgtacaacagctaaaattcaacaagttgaacactttaaatagatgcagtttattgcatgcaaagtatgtcccaatatgatgatttaaaaatattatcgtctttgagatttgtactttgcttatgtgaaacaaaacaaaacaaaaaccctgttcttgtgcccaggagacacaccctgactcatctggaggtagagggtcatgctgtctgcaacttaccctcacaggctctgaaataacaataatagcagtatatttacagattcagaaagagagaaagctatagtaaaaatgttcataagtaaaactagataaagggcaaaaataaataataaaactacgtcttttaaattttatctctcctttactttttctctccccttttcttcctatctcttccctcctttcttaacacgtccccctatccttccctcctttcaccactctctgcacttgatccccggtgtattccagccyccaggccaacacacttcaccgcgtccgcctggggcaggtcagagaagggacgcgaggcggcgctgtcacagcattctatgcgccccagcgccctgggccgcgcaggtcttgtatcatttcagtggtcactcccgtctttgacggggccacactcggggtgtaaattaggatcctcactgaagcggcgggaccctgagaggctttttcctggccccttagttgtgggttttcctgcgggcggtggagcccgtttccatcagaaccgcccagaggcgggcgctgccttccaggggtgaagcgttttcggaccctggaatctgtgggcggcctgcgggaggggctgaggcgcagttccctactcacccagatccgaatccaccgcggtgctgtttccagcgagtcagattccagatcgcgctccagcctggactcggaattcctgccccgcgggtctgcattttcacagcggcaggtgtgagtgccgcgcagctggagaccagaagcctgaggcagctcggccctccccagcccaaagtgccgttattccgtttctgtatcagtaaacacgtttcattttccggagaccagggaagggtgatgggtgatcccagtcctcgcagtgaattccgggccacaaaattcaaaacgcttgcgggcaaagccgtgcgcggtggctcaagcctgtaattccagcactttgggaggccgaggcgggcggatcacctgaggtcgggatttccagaccagcctgaccaacatagagaaaccccgcctctactaaaaatacaaaattagccgggggtggcgcatgcctgtaatcccagctagtcgggaggctgaggcaggagactcacttgaacccgggaggcggaggttgctgtgagccgagatcgcgccactgcactccagcctgggcaacaagagcgaaactccgtttcaaaaaaaaacaaaaaacaaaaagctttcgggcgccgagggcagccccgccctgaattttgtgagcgaccgcgctgggccgtttctctttcttttccggaccctgcagtggcgcctaaagtctgcgaggaggaagtcgcctctgtgctygtgagtccagggatctaaggcaagtgctgagggagaaaacatagttgatggggcagagcagagggggctggaggtggggtggagggggagggctttgaacagaagacctgggaggcttggtgggggaggggacccaggcctcggcgctgagaagcaactcccctggagctcaagaccttcttggcctcccctagcccaggggaggactggcttcatgtctccctgaaaccgcttctaaatgccttagaacaaaccttaaatattcattattattattgaactattaaaagtcttttttggaggcgagctgaatgagaccctttgctggagctggcacacggaggaagtcctggagggagggtagacaccgtggagggaagggcttgggacctgtgtcaggagagctgggtccatctccctctctgtctcaaactatgcttatgatctttagcagtgaaaataatctctctaaggtggggacaggaccccagtccctgctgtgcttaataaattatgaggatcaaaataaattatcagtgaatgtgtatgggaagactaagaaattgttaaagttctcgaatacattacattttcatccacagaaaagtgtaggctagggatgataggggaatagttagtaatgacagggatagttgaacttaaaaaaaaaggttgtgaggccaacaaaaaagaaatggacacagttcctgatcctggagggttcatagtctaatgggagaggagggtagaagatggtaggtgatggctgggtgtgtggcactcgcctcgcctgtagtcccagctactcaagaggctgtggtgggaggactgcttgagcccaggcatttgaggctgcagtgagctataatcacgccactgcattccaactgagtgacacagcaagactcctctcttaaaaaaataaaataaaataaatgaaaaaaataagattcaagacagggcacagtcggtaccatcaggaaggttcaaaccatgggctagatcagtagttctaaaacttgactacacatcggaatcacgtagggaactttaaaagatactaaggtttaggtccaacctaggtttactgatttaactggttgtggctgtggcctgggaacatggatattaaaaactctccaggtggttctacgcagtggctaggtttgaagaccactgcctagatgtcccaatgactaagaatgtgcgctggggacaagccaattctcttagtagaggctttccagacagaattcttattattgagaattgagaattcacatgccacacataatttatcgttttaaagtgtacagatcagtggcttctagcataatcacaaggttgtgccaccgtcaccactatctacttgggaagattttcttcctttttttctttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactgcactcagaccagcctaaytgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatggrggtggtgccagacaatagattgtgggagctatggtttccatggtagagtagaagcatccaccatstgtgacattcagcagatggggcgctgtgggtggcttggagcactctggttgtaactgaggcaggcacagtgtttaggaagcctgtgcagtaatccagactgaagggaggggaaagcctagactaagaytrtggctgtgggattgaaatagcgttgaaggagctgactttgactcccggagatgaaggrgaaagaggaaatcagaagggaccaaggatggtgaagttcttaagagaaactgaggaggaagagaggatgatgtggtgggagacgtgtagagagtccttgtagatctgtcacattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatctcccctccccaacccagacctaaaacaggctgttgggccagctgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccacyccttgctttgtttttaatttttaacttttgtttgggtacrtagtagatatgtatgtatatatttatggggtacatgggatattttsacacaggcctacaatatgtcataatcacatcagggtaaatgggttatctatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtartcgtcattctattgtctctccccatgaggtccattgttttaatttttggctgccacaaataagtgagaacatgcgaagtttgtctctctgggcctggggcttatttcacttcacatgatgacctccagttctttgcaaatgacatgrtggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcrccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctgtgcttgtggggtattacttaaaaaatctttgccagtccaatatcttagagagtttccccaatgttttcttttatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattcctctagttttgttctttttgttcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggrgaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccrtgaacatggaatgccttttccattttttgtgtcctcttcaatgttttgcatcagtgctttatagtttttattggagagatctttcacttcttcagttaagtctattcctaggtattttatttkatttgtagctaatgaaaatgggattcgtttcttgatttctttttcagattatttgctgttagcacatagaaatgctattgwtttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggactkgcagtattgtgttgcataactgtagtgaaagtagtcatccttgtcttgttccagatcttaaagaaaaggctttcagttttcccccattcagtatgttactagctgtgagttgtcatatatggcttttrttatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatayattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcggtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacaccttggttatccattcctcagacaatggacacttgggttacttctaccttttggatattggcaaatatttcatttctcttgggtatatatttatttcttttgartatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcctaatragtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgyaagctccgcccgctagcttcatgccattctcccrcctcagcctcccgagtagctgggactacaggcgcccgccaccayacccggctaattttttgtatttttagtagagatagggtttcaccatgttagccaggatggtctcaatctcctgacctggtgatacacccgcctcggcctcccaaagtgctggaaytacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgataccctgtcacctgcccaccccagtggacactagctggtccatccaattgctgtcctggggccttgtcatgccactcttccactttgaacccaagcccacatcattgctcccctctgggatactgaccccactataaacttctctagggctacaaccttcctaccccttgtgcctcatgaccaccccctcccttgtccccaccatgcccatgatgagtcttttctcraggcagctcgccttgcctccatctcaccctcacctgtgcaccacagccacactggacatgggtccctctgagcctgagtcccttcccattcccacygtcccctctggcaagaccttccttccaacactgccttcatgctcctccctygcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgygcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaaratgtcctgggagctragacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggggtggggatgaggaatagggtcagggaggctcagcagggtggtgagccggaactcagcccacacagggaggcatggaggagggccagggaggggtcgccgctgggctgagttcctcacttgggtggaaaggtgatgggttcgggaatggagaagtcactgctgggtgggggcaggcttgcattccctccaggagattagggtctgtgagatscatgaagacagcagcaccaggggctcccggcatttctactacratggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggkgtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccggkatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcayrgcactcaccctgtgccctctggtgagcctggggtgaccctggagagggtcaggccagggtaggaacagcarggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggracaggggatggaagctggggtatttgggaggggaatgggagctgcatctccatctacacccataagtgcttcycaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcrrtgcccacccgtgtgcctcctccaggaggcactttccaggttcccacyacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacggtcagaagcatttcccccacagtcaggttgtttgatgggggatgaaaagagacagcagaagttttgtgtttctgcaaaaacagaggcagtgcaggggacagtgagaggctggggtgtccaggagacctgagtctggcggtaggggcgctggtttctcatccttgaacctarttgcactgtcagtcggcccctcatgcctgagcagatgggaaggttcgtcccctgccctgcagcaagagggccctgtccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttmtcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcrcagcctcaccaagcagcagcyctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcakgtcaggtgcagatcctgtggcagccaygtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagagragggcctggggactgagagcaagggtcagggcctctctttggggaggcctctcactgtaacaggactggtcaggcctgagaggagggcactgggttccctcttgggtcttgtccttttgtcttggggccctttcmctccctgcacggtgagtggtgggcacaggacaggggctgatgttgatggagtgatgggagagaactgacaggggctgggaaaagcaaggagggaggaagaaaaaagtgggggcctcatcttctctcagagaaagggygaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcrcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagacatttctggtctgtgttttatttcatgcgtctgggagcggataaagtgtgaggttcagggagaaggagaggtctgtctcaatgccttgacccagcatcaaagcaatctcccctccttgttccctttccctgctagttcccaatgactgacagattcacagcagaacagaaaggactgggaagggatggaggtgggacatctggcgccaatattcaggggctgaccctgtgagggaacatctgccctgaagagttggagccttcatgtgatgacacagagatctctgtcactgtattcagggaaaggatcaagcctcactccccatgcagggaggaggttctggctgtgatccggcctgtgggagaagtgaggacccgctccctctacagtgacagccaagaacctgcaggtgacagagaaggcttcccctcaactgtctcctatcaggttcttccaggcatcaaggaatagacctgggacattgcctccagtgacatgaacacacccagaagtgaggtggccctgccagggggtcctggtgctgccacttgttttgggagctcagtgtctggagaggggtgtggagagtaggctttctgcaaaacagtaatcatgacctataaattattttattcttcattagctttttgccataaaataaaacaggtacccaaaaagaaaaactgtctgaaaatgttgccctttaataataataataaataataataataaaagataaacaccctttaaccaccagagatatagaagtttgtcagccagcccagaaaccatcatttgccccagctcagtgataaaggcttcccttccccacataaaatcacagcctgacctttatgatgattgcttctttgttctattttatattttcatcctctgaaattgtagtttagttttaccttgggatgtataatttttgttctcttttttcttttttttttttaagacggagtctcactctgtcacccaggctggagtgcagtggcatgatctcggctcactgcaagctccgcctcacgggttcatgcgattctcctgcctcagcctcccgagtagctgggactacaggcgtctgccaccacgcccggctaatttttttgtatttttagtagagacagggtttcaccatgttagccaggatggtctcaatctcctgacctcatgatctgcctgcctcggcctcccaaagtgctgggattacaggcgtgagccactgcacctggcctgttctctttttttctctatgctcctccttgaaattttattgtctggctgagttttccatagtttgcattttgctggctccaccccaaggcatagtttaatatggacctgttttatctgtactttctacaaattggtagttggctacagagatttgcttatagactgacttgattttcttcttgaatacttcatttatggcactccattgtattcttccatcaggaggaagaacttagtactggttatttacttctactctacttttaattgccattgcttttcaatggctaaatctgttaattcgttatgggttgcaaaagaattatagtctcagtctctcattccttccccattcactagctgaataatttctaaaataagagatttacccttggctggatgcggtgacttacgcctgtaatcccagcactttgggaggccgaggctggtggatcacctgaggtcgggagttcaagaccatcctgaccaacatgaagaaactgtgtctctactaaaaacacaaaattagccgggagtggtggcgcatgcctgtaatcccagctactcgggaggcggaagtaggagaattgcttgaaccaggaaggcggaggttgcagtgagccgagatggcgccattgcactccagcctgggcatcaagagtgaaactccgtctcaaaataaataaataaataaagtggagcacttgacggccatgggagagaatcggttatgaccacacacagcaagatgatgagcccaacaaagatgatgagcccgactacatgaaaacaacttctaatttcattcaatcagaaccaacagaactcatctacagtgttaaaaatcaagacagtggctactctagggtgggggaggctggtttatgactcaacggtgtttcttggagggtgaaaatgatgttgcttgatgaaggtgttgtttatctgagtttttacttgggcaaaacccactgcccacctgtgatttgtccacctttctacatgcatgttgtccttcattcaagtttacatttctggtgttttgaaacaattctctctaagctaatatagaatttctcctactccaagtccttagaaatgctgcattgaaaataccagtgaatttttttttaattccaggaaataaatgcccatgactcagatataaaaaggagaatctacaagagcagtaggcttgggagctgacaccagaacagctttggaaagggctgtcgagccaggaactaggaatcaaaacccaaacaagaccacaggaggtagagggtagaaattatgccccagtagtgcatgaatgaatgaatcaagggcagtgactcatgggttgcctggccagtctggaacttggggaaaataaagttgtaaaattgggggatggaagagagaagtgtgcactgaccactttccatgggaagagcatgtgaagatagaggttgcatatggatgcctgccagagggtctccaaggggctggggctccctgtaaccaggtgagcgagatggcttgatggatgatgccactcagccgcacaaggcttgctcatgagtccctgcacaaagtggccgtggtggctgggatggacactgcatggacagagcaattgagtcaccactcaccaaggctgacctggcagctgccactgctgaggacccagcctgccaaaagcagctgtttctttgaacagagaaaaaaaacagacaatgttaattaagagcaagacagtgttatgacagataaatatgccactgcagctatagtagagatgtaaacaatcttgaaattataaaaaaaaaatgtcgatggaaaagacttactgcaagtaagaagttaaaacagttgtaaaaattctatctctgcccaactatatacagattgtttcacagggaagtcctactaaaccttcaaagaaggttattggacttatttaaaatattcaagagaatggagcaaaatacagaaagctaggcaactcactttatcagctatgaatagtgttaattctaaagccagttagggaacaaataataaagaaacaagataggaaaatcactattagtaattagatgtaaaatagatgagaaaaatagtagactgtgtccatcagtgtgctataaacaaattaaatatcttgaccaagttatgaatcccaagaataaaagaatatttaaactttaaatcttttaatgcattttaacacttaattcaataatttaaaaagagacaatcatatttcactagatgtagaaatcactgtagatgaaatctaacactacacctgacctacatttcttcagttatctccacttttaagaatttgtgatcagtgcagcactattcacaatagcaaaggtaaggaatcaacccagatgcccatcaacagtggaatggataaagaaaactgcggcacagggccaggcgcggtggctcacgcctgtaatcccagcactttgggagggtgaggcgggcagatcacgaagtcaggagttcgagaccatcctggctaacacagtgaaaccccgtctctactaaaaatacaaaaaattagccgggcgtggtggcgggcgcctgtagtcccagctactcgggaggctgaggcaggagaatggcatgaacccaggaggtggagtttgcagtgagccgagatcacgccactgcactccagcctgggtgacagaatgagactccgtctcaaaaaaaaaagaaaagaaaagaaaagaaaactgcagcacttatacaccatggtacgctacccagccaaaaaaacaagaacgaaatcatgtccttcacagcaacatggatggaggtggagaccattattctaagcaaattaatgtaggaacagaaagccaaataccacatattctcacctataagtggcagctaaacattgagtacacatggacacaaagaagggaacaatagacactggggcctccttgagggtggagggtgggaggagggggaggattaaaaaactacctattgggtattgtgctgattacctgagtaacaaaattatctgcacaccaaacacccgtgatacacaatttacccatgtaacaaacctgaatatgtatcccttgaacctaaaaaatcaaaaagaaaaaagtaaaaaagaattcctgatcagattgagccaggacaatggccgggcgtggtggctcacgcctgtaatcccagcactttgggaggccgaggcaggtggtcagggtaggcctcttggaggagccatgtgagcagacttgagaaggagagaaacagccatgcagatatttgaaggaagaaccttccagtatcccgctctaagcatacccaggactctgctctggggcagaccctaaagctgcagtggaaatggaggtggccacactcacagagactgtggcagagagtgatggggatttgggtctccccttcctgctgtggctgttagaagtgctggagttggggagggaaaggcactggcatgtggaggaagactaggagaggaggggaggctgaagtgtgtcccactctcactccacctctctgttctctatctcctgcatccggtgcctccccgacttccccaaagttgtggtccctgacaaggaggaccctgagggcaaccacaccttgccatgtagagcacctggcttctcacttgccaacatcactctgacctggctgcaggaaggggaggagccaactctggactcaagactcaaggggaccagacccaggaagatgagacatatcagggctgggcagctgtggggggccctcccagagaaggcctgagatacacctgcctgcaggtgctcctgggcctggagaagcccctcagtgtgactaggtgaggtgttgtcagaggaccagaggctgagggtggggcgtcccatccagatcctgcccccctctctgccccagcacccaaggccccttcctccctcctctatggagatgctggggatgtcctcattctccctctgagcactcacatctcacccctcatctgtctctctaacctccttccttcctgctgcagcttctgccccagccccaggctctggcctctctctccccagttccaccctccagggggtgatggttcacttccctctgaggagccagcactaggtgagaggctaggagaaggaaaagctcatgggccatgggttgggagggagaatgggcactgaaatggaagggtagggagacagaagaggcaggtatttccaaatcaccatttttctgtcatggtccaagggtgccatccttctcccaggcccagggatgtggaaagagcagcaggaattgggaaatactccacaggaaagaacaatgtgcctcctccctccaccggcttcttcctcttgtctattctggtcaattctctaagtgaatcatgttaccaaaatgtaaaatgtttattttaggaaagtctccaaatattagggaataaaattactagtgcctaagccctgcatactgaaaaacagaagctttaagaaataaagacctgcatggaaaattgctcatcaactcggggaagtcaaagtctgagctgaatcagctctttttttctttctctttttttttttttttttctttttttgagacggagtcttgctctgtcgcccaggctggagtgcagtggcatgatctcagctcactgcaacctctgcctccccgactcaagcaattctcctgtctcaggctcccaagtagctgggattacaggcatgcgccacca

SEQ ID NO: 10648 - DNA, 87716 bp, Homo sapiens
  misc_feature (1)...(87716): n = A,T,C or G, or insertion/deletion polymorphism (see Tables 1-2)
tttggatgtgaataactcacatctgaaacacacttagtagctatatgaacttgtacaagtgactcaacttctctgagctccacatctcactgtgggtggaggtaatggtatcctcctcctgggggtattttaagtgagacagtgcacgctgagttgaggtcctgctccacacactgaggcatggtcaagtccaaaaacaagtaaatgaaaaagacaaaaatccttgactttgtggaattggcagtcagtaaataagaaatataaattaaatatatgttagttagatggtgagaaataataaggagaaaagccaatgggggtggggaacatgagagaaggcttccagttttgaaatggggtagccaaggaaggccttgattaggtgccttttgagatgagggacagagccacgaagacagctggggaaggaagcagttcaggcagtgagaagaacaaggctctaaggtgtgaatgtgcctgtttcaagaacagcaggaagctaatggggctggatggtgagaagtaatcaaagatgaggttagagagggaagggccttggctggggggcagtggctcatgcctgtaatcccagcactttgggaggccgaggcaggtaggttaggagatcgagaccatcctggctaacacggtgaaaccctatctctactaaaaatacaaaaaaatagcccggcgtggtggcacgcacctgtagtcccagctactcaggaggctgaggcaggagaatcgcttgaacccgggaggcggaggttgcagtgagccgagattgcaccactgcactccagcctgggccacagagcaagactgcgtctcaacaaaaaaaaaaagagagagagagaaagagattgagagggaaaggccttgtgcagagccttgcaggccctgtagaaaagttagctttactctgagtgagtggagaagcgattggagacttttgagcagaggagtgaggtggtctaacttgtatttcaactgactcactttggctgctgtgtagagatatggacaaggagagcaaggacagcagcaggaagacaagttaggagatgcaagagatgacataggcttggactaggatattggcaatagggatgagaagagatgagaagtgctcagattctggatatacattttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctggatatacatattttgaaggtagagtccacaggatttaagacagtttggatgtggagtatgagaaaaagagaggagtcagcaatatcttcaaggatttgggcctaaacaatggaaagaatagaactgcaaaactcaattctatcaggaaggaagagaaggttaagggagaagatcaggtcagttctggacatgttaagtttgtggtacttgtacttggaagtacaagtctggagttccgggaagtgtatgatcttgagagtcatcagcacaaaggtggtcttcatagatggtatctgaatctggtagggagccaggagactggatgagatcacctagggagacagaaaactagaagaggcccagggaataaccatggacactacaatggtaagaggttggagagatgaagagtaaccaacagggaggcagagagggaggggcctggggcaacggggggctccatatctcccgaaccatatatttacaaataatctccaagagtggattactcttgcttatttctttttttttttttttttctcactctggtctcaccttgtcaccctggctggattgcagtggcatgattatggctcgttgcagcctcaacctcctgggctcaagtgatcctcccacgtcagcctcccaagtagctggggcaacaggtgtgcatcaccacggcctgctaatttttgtattttttcatagggatggggtttccctatgttgcccaggctgatcttgaactcctgggatcaagtgattctcccaccttggcctcccaaagtgctgggagtacaggcatgagccaccgctgcacctggcactcttgcttatctctatggctacagtggcctattgccttctttgtgtttggacacattatcagggccaacctcggagttcaccttttaaggtcacaagtccctatgactgaagtgtgaatgactgacaggtttatccttctcagggggtatacaatgaaagaaaatccctttaataaaatgaatctctatttgatgaaatactgtaggaaaaagggtcatttcccagagggaactatctgtatccctggcatgctgcagttcactgtagtgatgatggtaccaccctggtcagtatcaacccttgggaagccattgggaaggagaaacaagctcttgggggagcatcaatactgctttgggctgtaaggtcttagaggccaggaaaagtatctgggacccaagcatagctcataatgcctgagcaggtgcacactgccttaccttaagcaggataaagcaagaagtgggcaggcagcttcctgacactgtctttaaactcagcttctgcccaccacacttctggttcccttccacctaaccacttctctgtctccgttgcaatttctcctttttctcaagctccagcctagtgccccagcctccctttccacaaatggtgttagattgtcaacattgcagaaatggtgagttcagttctttccaccaaggtcttcgcggttccatgagaaacctgttgtctcttcctattttcctttcactactcaccagcaccaaatccccagtcagcaaaccagagagtacaaaagcagggacttttacactagggttcctcttccccatacccacagttgcctcctcaactaaggaaggtgatgggaaaatgacaatgacaccaataggacaatgggacaaaagcatggacaggaaactcacaaaagcatggacaggaaacacgaatagccattaaacagttaaaaagaatgttgacacttaacaacaaatgtgcagtttaaaggagcaataagagaccatttcatctatcaaagtggcgaggattctaatgtggagggttggcgagagtaaggacacaggcagacactactaactggagtagaaaggcctcactgctttctggagaatggcttggcaacacatagagaccaagagctttaaaacaagtctatgtcttcaccctttcactcaggggtttcacttctagaatttagcctaaggcaataattagccatgcaaatatgtaagttcaaggatatttaccgaaggtctgggcgcggtggctcacacctataatcctagcactttgggaggccgaaagaggtggtcagattacctgaggtcaggagttcgagaccagcctggataacatgatgaaaccccgtctctactaaaaatacaaaaatcagccaggcatgtgcctgtaatcccagctactcaggaggctgaggcaggagtagcttgaacccaggaagcagaggttgccgtgaaccgagatcacaccactgcactccatcctggacaacagagtgagactccatctcaaaaaaaaaaaaaaaagaagaagaaaaagaaaaaaaagaatatttaccacagctcagtttattatatgtttaaaaattgaaggccaggtgtggtggtacacacctgtaatcccagagctttgggaggccgaggaaggaggttgccgtgagcccaggaattcaaggttatagtgagctatgtgcgtgccactgcactccagcctgagtgacagagcaagaccctgtctctaaaaaaacagaaagcaaattgagacccacctaaacatgctataataggaaattggtttaaatgaactagtagaatactgggtgaccattataaatgatgctggctcacgggcttccaaatgtgatacactggtactcgtgcccaaaaatgcataaacaccagacatactcaaatttaggaacagtctacaaaacaactgtcctgtatgcttaaaaatgccagtatcggccaggtgcggtggctcacgcctgtaatcccagcactttgggaggccaagatgggtggattgcctaagctcaggagtttgagaccagcctgggcaccatggtgaaaccctgtctctactaaaatacaaaaagtcagccaggcgtggtggtgggcgcctgtaatcccagctactcaggaggctgaggcacgagaattgcttgaacccaggcggtggaggttgcagtgagccaaggtcgtgccactgcaatccagcctggactgtctcaaaaaaaaaaaaaaaagtcaatataatgaaaggcaaagtacatttaaggtactgtactcatattaaaggaaactaaaaagactcgacagctaaatgcaatgcaggatgccaaatgagatcctagaccaaaggaaaaaattgtcatgaaggacattatggggcaattggcaggacctgaatttggactgtcaattagatcatagtattacatcggtctaagtttcctgatttggataattgtactatattatgtaaaagaatgttttgttcttagaaaatttgcactgatggatttaagggtaaagggtatcttgtatgcaacttactctcaaatggttcagaaaaaaatacaaatgtgtatttatagagaaataatgataaagtaaatgtggtcaaatgatattagtggatgaatctgagtgaagggtatcctggaattctttttagtatttttgcccctttcccatgagattaaaagtattttaaaataaaaagctaaaaaaaggaagaaagtggtgctggtgaagtatattccccggtaggggaaggctctcaggtgcaccagcagcagccatgagtgcctcaacaccagggagagcacagctgccactgacaccttctgccaccctggactctcagttccctgtgctactaaaggaactcagtgtgtggttgaccccaaagttgtcctgggttgactcaagaaggtaggatgagcattctgaggcaaagaattctcttttgtgattttattgactccaattttgcattctgactggcattccctgcatcccaaggaccttgacagcggagggaggcagagatggaggaagtgaaaactacccaaattcagtgtttgttacagacaattcagactgcaaaatttagggtagactatgttcatttatcactgataatgacagtcttaacattcccctacaacaggaagaccaagatttccccaaaaccggccagcatcttgcccattcgccagaaggagaaaaataagtcctggcaagagccaagataaggcccagaagcccctgggttcctttagccaaggtgagtggtttcaaattatgacaagttgcaggttctctgagaagcatctgtaataacctggcaaattaagcatcctctcctgggaggaggaatacagaactctgtaaccacccaatacctgtttccaggtcctgcccctcctggggcacasggcagccaccttgcaattctcatccctagaaaggagagaccagatcaacaaacagcagggctgggactgcccagggggttccgagattccttctcccctcctatcacctgccctccaggcacaccgtcctacttccccctacttccccaggggttgtcagggacagaaggcccctccttcatcccccctagtgttcctccactcttcctccgccccccattactagggtgtccaggacattgtgtgactcaggaaacagctcagacgtgaggcttgcagcaggcygaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagaggtgaggcatggcrtgggtgaggtgargggacccagctcccttaggaggatgwtcagtggggtgggggaagagggccaagccccaggccrtgtgagggatgctggatggaggagattctcactgcccaaatagagacggcctccagggaaagacggctctgcccatggagctgcttygggcctggtgccaggggtggtgactgctgggggatgggtgagagggtgcccacctccaggaagaacctcgtcagcactggcactggaggactcttgcagccatagggaagaggggaagagggaacacactgaccacctgcttggggaggagatgagagggaagcaggagatggggacatgaaaggtcaggcctactaagccctttcttagtccagctgtccccaccccccggatggctcaatgctcggcctttccgggaggaaatctcttcgaagtctcagccattcacctcccgggagccacctccgcccctcttctgacccctgttgtcttgcttccgagagatggagtccgaggctggacttgggaggccagagaataaacaggaaaggggggtagggattagtaactgggayggagggcactggggctggggctgggtaccatgtggagagtggggacagatgtgaagaagaggtggtttagartacctgtgggagctgctgtgggcaggtctctcaggagcacctagaagaggaaaggtggaggcacagcacccagggcttccattgcgcctgcctctccwccctcagggctgctgtgtgggagtttcccagaaccctgtgccaatggaggcacctgcctgagcctgtctctgggacaagggacctgccagtgagtgtgccttgcaggagtgggagactggagagaaagggggagggagagcagggggggagaggtgaggaagtgagaccaaagaagaaagagaggaagtgaaggagatgaagggaaacaaatgaaggcagaggagggagtgggcaagaataggaagagggrccagtgatgtgagttttcctctcctcccctgcccaggtgtgcccctggcttcctgggtgagacgtgccagwttcctgacccctgccagaacgcccagctctgccaaaatggaggcagctgccaagccctgcttccygctcccctagggctccccagctctccctctccattgacacccagcttcttgtgcacttgcctccctggcttcactggygagagatgccaggccnagcttgaagacccttgtcctccctccttctgttccaaaaggggccgctgccacatccaggcctcgggccgcccacagtgctcctgcatgcctggatggacaggtaagcgctgctgggggcagccaggaggggacaggcaggagcaatgggctaggctgtgggtggggaagatrgaactggagcctgagaaactgcaagccctttgaagacagaagccatgagaatcaacatgccaattcttggcaatccacttacccacaaccaacattcaccagcatggttgtactgattgctaaaatgttaaaatatttccaaattaagggtgccatgagccccctttgtgcaccatcctgatgcctgtcctagcccctttaatctccccattgcctagcagctagaagagggtcattgctctgcataccaggggtcctccagacttttgcattctgagcatctgaatggctcccaytctgagtggagggagccattatatcacctgggaagactgcagtggtgggaggggcaccgggaagggaaggatgtgacccmgagagtggattgggggccgccccaggaggaggggtgtaaccctggggcaagcttagtgcttcattctaggggctctgcaccagcccctggatccaaatgctagctctgccactgatcagctacatgacctcatataagatattttagctttctggtgttcagttgtcagctgacaaacagggagagtaatggtcacacttcataaggttgctgagaggacagaaggggccgatgctcaggagatgcttgctcagctcagcacctggcacctccactgctgccgccattaccactggtgcacatggactgtgaagtgagtctccaggtgcctaaacccacttaaagattaggaaatgaggwtcagaaaggcaaagtggctcacccaagggtatacaaccagttgtggcacagcatggtgccacctgagtctcctgcctgcagacgtggggtgcttttcacctcccccaagatcacccacgtcccagattttctcaggcaaggccaatttgcaatactctcatcatcactttagaagatatggtcactccagataaaccctcccaagccatgacatcgctcagagcaggggtgatggaacagagcaaagaaagtatggtaataaagggaaggaaatatgaaaatgagacccagagataatccagagtgagcactgggtaacctcagatgggctagaattcgtacaatgctagaaacggctccctctgtcctctgcctcaggtgagcagtgccagcttcgggacttctgttcagccaacccatgtgttaatggaggggtgtgtctggccacrtacccccagatccagtgccactgcccaccgggcttygagggccatgcctgtgaacgtgatgtcaacgagtgcttccaggacccaggacyctgccccaaaggcacctcctgccataacaccctrggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtgtgtcctcacaggggctctccggccrcccctctctctgggcagggcaggatgtctccgttggagcctcctcccayagctgatccatgaccctgtcaggtttcataggcccrgrctgtgaggtgaatccagacaactgtgtcagccaccartgtcagaatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagrcccagggtccccctcactgcagaaacgggggcacctgccagaactctgctggtagctttcactgcgtgtgtgtgagtggctggggsggcacaagctgtgaggagaacctggatgactgtattgctgccacctgtgccccgggatccacctgcattgaccgggtgggctctttctcctgcctctgcccacctggacgcacaggtatgggggtagagggtatcaggaggtgggaggtagagaaggagggtgagagaagcaccaggaggactgctaggagcttcaartggcctttgagagcctcaccccctcttacccctccaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatgggtgaggccactcccacttcagagcctctctgagcctcagacaggcstctgcactgaagacagaaaagggcagattgcttttccaattaaaaaaccaaacatctttttccttgaatttgcccasatttggcatctcttgcctacatgaccctctctccaatgttcagcccctcagtccccatgarwttggtcccttatttcctttccatcttaaagacacaagccccttccccaatttggtctcgtctgccacacgcaggcccccacacmttccctgacagtctcacctccttgcccttccygccctgacccctgtggactcccagctcttctctcctcccagcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggtatcagctggatggggccttgggtggggaaaacagggaactagtcctgaacccactaggaatgccccctccagagtaaggacagcttcaggccaattggcgtaagttaccacagatgcttctctctctacccccagacgaaaactcagggacacccaagacccctaggagaggggttaccacagatggtagtgaggttatgcattcctcaacttggggggaagctgccattcatttcatagtcatcatagaggctgcacaacctggtccactgtacacagcagcccagcaagagagggtagaagagcagttcataaactttctgtgctgcagcctttgctcaggccaacccagaatgctccctctgattatagaaactctcccatgtagagattcaaggtaatcccttaaaatcccaaaagccctgtgatacaacaggaaaatttggtacaacaagaaaaaaattgctgcaagacagcacccacctccaggctagytttaagggggaaaagtcgccccagggagacagcaacagagccaacatcaaggagttgaatgaaatcagaaaaataatcgccaactttatgccaggtactgtctgagcatcttacaggcattgtctcatctacttattacaataacyctatgaggtcagcactgcccattttataactgaagaaactgaggcacagagagtttaagtgacttgtccaaggtcacccagctagcaagtggcagagctgagattcaaaccaagggcttcaacaattataaccactaccccatattgactttctaaactgagcggcacccaaagatactggctcaggtcacccaacagacaatcatagagaaataagagaaaacggttcggtaacccaagggacaacattgtagatatcaaggagcttcagaagcagactcctcaggcaagaaaagaaaggaagccaaggtccagaggttgatcccacctcaattcaggatgaaacagtggagaccaggatgaacccaaagcaacgggacaaatataggagcaacaagcttcccagatgcacttcaaattcctccactttgggatctctgttctccctagcatggaggcccgcccagggagaacaagaagcgggactcattctccaagccaatttgttcctatttgtaccttgaggtcctccaggctgatcagcctgccctggtgagccccgccctctgtatacacaggaatggccaccagaaagccttgtagtcctcccgcaggtccccagcaagcaccctgttccctggcctttcacacctcaaggagcagggccacacactgcgaagcagcagggcctcagggttcatcttattcaaccccatgcagacagcacctcgggggaggaccgcctgagtggggcaagtcaggagcagggccgattctagaacacaggtctcccaggcagacctggctgagccacagccctcatggtccccatgtccccaggcttagaagggcagctctgtgaggtggagaccaacgagtgtgcctcagctccctgcctgaaccacgcrgattgccatgacctgctcaacrgcttccagtgcatctgyctgcctggtgagtacagatgcctctctggccaccctcagaccccaggcctctgaacctgcagagttcaggctcagcaatcacccaaggccacttgaagctctctctagccaagccaaggagtcctccaaatctgtctttgctccccaaaatctctactcttacatccccaaatyttcccttgcttacttgcccattctcatctctgtcctaccaaatcacccaaagatccctcctttccagtcctcctgcacagcctctgtgtatgcatgttgaggtcccaggctggtcttggcactctcatcataaacccagcaaaagctgccccaagcctttcttctccagcctcaccggacactcctctgtcccctgctattataataactacacttattcaccacttactccaggctagccatttggctgagtacttttcaggcgttatgtcatttaatctttttaacagtaccatgaggtaggttccattattattccccttttacacagaacaggaaactggggcctagagggttgaccagcttgcccaaagtcacacagctggcaggtggctgagcttcaccttttctgcatcatctcctgtcaccccacgctcacctgccccaggtgtcttctctgggaagctctgcaagttcacctttcctggcaagggaaggcgccatgctgtgcctccctcgatgaccttggcctcctctccccacccacttccgccccaccaggattctccggcacccgatgtgaggaggatatcgatgagtgcagaagctctccctgtgccaatggtgggcagtgccaggaccagcctggagccttccactgcaagtgtctcccaggtaaactggggcacacactgtgggggacagcgggagcaggaggcagacatccgtgcaggtccctgaccttcctgctgtgccacaggctttgaagggccacgctgtcaaacagaggtggatgagtgcctgagtgacccatgtcccsttggagccagctgccttgatcttccaggagccttcttttgcctctgcccctctggtttcacaggttcacaggggaggcaytggaaagaactggcagaatattttattccatttgggttggggcagagttcattggtgggtgtttgatggttgggatgtgagaatagaatgagaatggtatcctttaaagttatttagtgtaaaacctgcayaattgtacaaccatggggacaagggcaggggttaccgtagggcccacatgggcccagtgtaaatggtgtgattgcggcttgggagcagaggacggggctcaaagaaaaggcattcacttgcttatttagcaagcacttaccaactgcctactatgccagatacggaggcaaatctgagtaagacagttgccatcttcatgtgactttaagtctaatacagagagaccaacaagtctcctgttgatcatagcccacagaggtgctctgagagaaaaacgtgcaggatattacaagagcacagaggaccagccaacccagactaaaaatggaggaggtgatggctgagatgagtcttgaaagataagcagaggctgggcgtggtggctcacgcctatagtcccagcacttcgggaagccgaggcgggtggatcaccygagattaggagttcgagatcagcctggccaacatggtgaaaccttgtctctattaaaaatacaaaaattacaatttgggaggccgaggcgggtggatcatgaggtcaggagatcracactatcctggctaacacggtgaaaccccatctcaactaaaaatacaaaaaaataactgggcgtggtggcgggcgcctatagtcccagctactccagaggctgaggcaggagaatggcgtgaacccgggaggcggagcttgcagtgagctgagatcacgccactgcactccagcctgggtggcagagtaagactccacctcaaaaaaaaaaaaaaatacaaaaattagccaggcgtggtggcgggcgcctgcaatcccagctattggggaggctgaggcaagagaatcgcttgaacctgggaagcagtggttgcagtgagcygagatcactccactgcactccagcctgggtgacagagcaagattccatctcaaaaaaaaaagaaggaaggaaggaaggaaagaaggaaggaaggagagaagggaaggaaaggaaggaaaggaggaaatgaggaaagagagaaagatagaaagatggatggtcaggagtctgtctaaatagagtgccagatagtgtgttttagctggagataactgcatgtgcaaagacacagatggaagaaaagcccaccccatttaaggaactgtaagaaagtcagagttaagggtacagcaaggcaaagatgagaaacacagctgttgtacaaatgtcatgtcctgcaggactctgcatatcattctgagaaagttaaacaatatcttaaaggcaatagggacccattgaaggacaggttcatgggttcatagggagtgagtaaggcaagcataagaagtggctttggcccaatgaaggatgtggctttggcccaatgaaggatgtggaggagctgttttctttttgacccatyttcccaccccaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagaggtaacatcttccagaccctccccatctgccccctcctttgggctcccttcgctaggacaggagaagacagccagtgagatgtaggtctgtgagaaatgaccaatggggaaaaggaaggagatggcaargttcttagggcaaggcagtgggagggctcaactggtaagtgttatccaaggagaagagagtccacaaaaactggtggaaacagaggaccagggggtcagagcagaaagaagagcaytaaatcccagggcgaattaatcattcattagaaaaatatctgctgaggccaggcgcagtgctgattacggtctcatgccggtaatcccagcactttgggaggccgaggtgggcggatcacctgagatcagcagttcaacatcagcctggccaacatggtgaaaccctgtagctactaaaaatgcaaaaattagctgggcatggtggcgcacctgtaatcccagctacttgggaggctgaagcggaaggatcacttgaacccaagaggcggaggttgcagtcagccaagatcatgccactgcactccagcctgggtgacagagcaagactccgtctcaaaaaaaaaaaaatctgctgagcacctactttgtgtggctactgttccaggccctgggggaaacacaaagcaaaagagataaagcaactgctctcgtagagctttcattctaaagaaagacagaaaataagtaagttacagaaagaatatatatgtgtgtgtatatatatatatatatatctccaactagatatatagatgcatatatctagttggagaaaatgagcaggtgttggggaggatgggggcggtgctgagagcaaagtcactgaagaaagaggccagaatctcagggccaaaagaagaggaagtcataggggtccaggcagcagggaggggaacataagcagtaggagaagagaaaaaccctcccctttctctttacaaccagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggtgagaccctccctaaaccatatacaccctgtgctggtcaccccctatgtcaagggtaaggcaggcgaccacgggccctgagtctcagtcaccactaaggagaactggactgcaggggacacgggtgatgtgtgggaggtggtgagaacggaggttgatgggaaagaataatagggttggggatgaggaagggaaggaagaggaaagagaaggagagcggagggagggaaggaggacaccctttctcagcccccacctgtttccttcaggacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctggtgagtgcccactgtgtcatggggctggggtccacaggagaatggaagaactaaggagggtatgcttgtgtcatattttttaaaatttaattgaacagaccagcctgggaaacataatgaaactccatctctaaattagctgggcacacagtggctaaggcctgtagtctcaaatacttgggaggctaaggtgggaggatgacttgagcccagaaggttaagactgcagtgagctctgatggcaccactgcctgggtaacagagcaagaccctatctaaaaayaataaaatatcatataaataaaaattaattggatggcagtgagctgtcgttttgatgggggtggggggtgtatgtcctatgtacagtgtgactgaggtcacaggccaggttacaggcaaggaacccaaaccctcacagcctcctctctccagccccgtgcttcaatgggggtacctgtgtgaacaggcctggcaccttctcctgcctctgtgccatgggcttccagggcccgcgctgtgagggaaagctccgccccagctgtgcagacaggtgagcagggcccaaagacccctagaagggagaaaacccctcagccttcccacccctcctctcatctccccctgggttccaggctgcctcccaccccacacctcgttccgccttccctcctggcttgccacctccctgtggttgcctcccgacaatatcacacactaccttccccttgttgcccgaacttcttcctatcatgccctgtctctgtcttgttcagcccctgtaggaatagggcaacctgccaggacagccctcagggtccccgctgcctctgccccactgkctacaccggaggcagctgccaggtgagggccattgaagtcaggcgtgctgaggagggaagtggctgggagggaaaccagggagggtcacctggtcccaggccattcaggagaaggttttygaagtaagggatttcgaggagctggagtgggcagaggaccatctctgggctgagaatctgatgctatgtccwgcctcacgctccctcccacccctcagactytgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggtaaccaacrccggcactgactggagagcaaatgaagaaaatatgggtgttctcacctgccccgttcctgtgggcttccacacagcttttggccaaaacaaccacctgagaatcaaaaccacacagacaaatcagttcttgattgcagaggtgttgaattgtgcaatcagagaagcctaacacaattcctgttacctcatttaacgcaattcaagcaacaccaaccagcccattccacaggattccagtttaacccaaccatgagggacatgactcaacgtggagcaactcaactctgtcctgatcatcataacccaggcagagtggaccacacttaatccagctacactcaacrcatttcaccccaccccwctcacttcgatgtcacgccaccctctttgtaaaagaacactaaaataaggtttgatatgagaagagctcgggaaagagattatgatggagttaagggatagctgatgggaatcacagggagagaacattaaaggaatgcagaactcaggggacagacttaagccacttgtcctcacttgaggcataccttgaattatttcttgctcaagccttgctttaagccaagaaaacagttgctttaacattatgataagctttaggggtatgtctccaatattctggcagaaagggtgaggagagaggtaaaactcgatggtctaatttcttcagtgccaggagttattaactccttgggcccagaccagtctccacccaggaatgttagtggtccccaaggtaaaggcctctacacccagagattgggccctgaatacacccttyctcctcctcacataccttatttatttatttatttatttatttatttatttatttatttttgagatggagtcccagtctgtcacccagggtggagtgcagtggcacgatctyggctcactgcaaccttcacctcctaggttcaagtgattctcctgcctcagcttcccaagtagctgggattcgtgtgccaccatgcccagctaatttttttttttttgtatttttagtagagatggggtttcattatgttggccagactggtctcgaactcctaacctcagtgatccacccgtctcagcctcccaaagtgctggaattacaggtgtgagccaccacgcccggccacatccccatttaccgtttctgtttgtttgtttgtttgtttgtttgtttkagatggagtcttgccctatagcccaggctggagtgcaatggcacgattttggctcactacaacctgcgctgcccaggttcaagtgattctcctgcctcagcctcccaagtagctgggattacaggtgcctgccacaacgcccgaccaattttttgtatttttagtagagacggggtttccccatgtttgccaggctggtctcacactcctaacctggtgatccacctgcctcggcctcccaaagtgctgggattacaggcgtragccatggcgcccggccccccacttatctttgtatatccctgtttgtctctctccccaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacrgggccacctgcatggcccagcccagtgggtatctctgccaggtgagagggtctgcaggagaagggggaggaaagacaagggtgggctggatgggagagacagtagtgactgagggaagacccaatgtatccatttcacctccttttattttttttaaccccacacacccaactaaccacaaagtcatgccacyttatctcctgaagttttctcaagtctgtgctttcaccttcaccctttgtcccactgcctgagtcctgacctttgttgcgttccagatagatacttgcatcagcctcctaactacagtctctgcctccacacttgtccttctataggttcagcctttaccccgtggccagggtactctactgaaaatgtccagttgacctgtctctcccctgctgaaccttcggaggctgcccgcctcattctgaataaagtccaaggcctgcatgacccagccctgcctgcctctcaggcctcagctctccccatcccacccttctactctctgctccagcaacatgaaactgctgctgactttgccacgtaccccatactgattcttgcctctcagcctttatccctgctattgacactacctggaatggccttcccaacccctcttccacaggctggtgttcaggaggcatcttcttcaggaagrtgtccctaacttctccccasgctggattagggcctcttctttgtggtccaggtcactaagccaggagaggcaaagctggcattcaagtctaagcagcctgattcatatgctcagaaccacaacttttttgtgtgtgtggttgccattttattttcttttgttattgacaaacggtagtcatacgtatctatggggtacatgtgagttttttggtttctttttttttttctctctcgtttttggagacagagtcrctctatcccccaggctgaagkgcagtggcatratcttggctcactgaaacccccgcctcccaggttcaagcagttctcatgtctcagcctcccgagtagctgggattacaggaacgcgccaccacgcctggctaatttttgtatttttagtagagatggggtttcaccatgttgggcaggctggtctcagaactcctgacctaaagtgatccacccrctcagcctgccaaagtgataagattacaggtatgagccaccgcacctggacacatgtgatattttgatacatgcatacaatgtatcatgatcaaatcagggtaattgggatatctatcatctcaaacatcatttctttgtgttgagaacatttcaaatcttctcttctagttattttgaaatacaaattgttaactatcaccatccttctctgctatctaacactagaacttattccttctatatgaccataattttgtatccattaaccaacctctcttcatctccccctccctgccaccctttctaacctctggtaaccatcattctaccctacttccatgagactaacttttttagctcccacatatgagtgaggagcaatattacacatgcaataggaggctgatgcaagtatctacctggaatgcaagaaaggtcaggactaactaaggcagtggcacaaaggtgaaggtgagagacatgcaatatttgtctttccgtgcctggcttatttcacttaacataatgtccttcagtttcatccatgttgctgaaaatgataggatttcattctttttctggctgaataatattccattgtgtctatatgacacagtttcttttttccattcatttgttgatggaacttcagttaattccatatgttagctattgtgaacagtgctgcaataaatatggggatgcagatatctcttcaagatactgatttcctttggatatgtaatgaacagtagattgatcacatggtagatctatttttaatttttgagaaacttccatacttttctccatactggctgtgttagtttacattcccaccaacagtgtatgagggttcccctttctctgcatccttgccagcatctgctattttttgcattttttttccttttytgagacagagtcttgctgtgttgcccaggctggatcacagtgacttgatctcagctcactgcaacctctgcctcccagattcaagcgattcttgtacttcagcctcccaagtaactgggatcacaggcgtggaccaccatgcttggctaattttttgtatttttagtagagatggggtttcaccatgttggccaggatggtctcgaactcctgacctcaaatgatcttcccgcctcaacctctgaaagtgctgggattacaggcatgggccaccacacttggcccttgtgttttcaataayagscactttaactggtgtgagatgatatctcattgtggttttgatttacatttccctgatttgcatccatatacctgttggccatttgtatgtcttcttttgagaaatgtctgttcagataatttgctcattttttaaaccacattatttgtcggtggtggtagtggtggtgtttgctgttgagttccttatacgttctgattattaatcccttgtcagacagtttgcaaatattttcttctattctgtaggttgcctcttcactccattaattgtttcctttgctgcacagacactttttagcttgatgtaatcacatttgtctgttgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgccttagcctcccaaatagctggaatttacaggtgcccaccaccacgcccagctatttttttgtatttttagtagagacggggtttcaccatgttggccaggctggtctcaaactcctgaccttgtgtttgaggattacaggtgtgacccaccgtgcccggctgaattttttttttagtggcttcaagtttccagctgtacatgtaaggctttaatctattttgtatatgatgacagatagagatttagtttctttttttctttttttttggggggggggatagagtcttgctctgttgccctgttgcccagtctggagtgcagtggtatgatctcagctcactgcaacctccacctcccaagttcaactgattctcctgcctcagcctcctgagtagctggaactacaggtgcacaccactacgcccggctaatttttgtaattttagtagagatggggtttcaccatattggtcaggctggtttcaaactcctgacctcaggtgatccacccacctccgcctcccaaagtgctgggattacaggcgtgagccaccccgcccggcctaggtttagtttcttctgcatatggatatccagttttcccagcacaatttattgaagagagtgtcctttccccagtgtgtgtacttggtgcctttgttgaaagtaagttggctggccgggagtggtggctcatgcctgtaatcccagcattttgggagaccgaggcgggcagatcacaaggtcaggagttcgagaccagcctgaccaacatagtgaaacccccgtctctactaaaaatacaaaaattagccaggcatggtggtgcgcacctgtaatcccagctactcaggaggctgaggcaggagaatcgcttgaacccaggaggtggaggttgcagtgagccagatcgtgccattgcactccagcctggcaacagagcaagactccatctcaaaaaaaaaaaaaggaaagaaaagaaaaaagaaagtaagttggctgttaaatgtttggacttgtttttctgggctctctattacattccattggtctatgtgtctgttttttatgccagcaccatgctgttttggttactatagctttatagtatatttttaagttaggtagtgtggtacctctagctttgttctttttgctcaggactgctttggctatttgggtcttttacagttcagataaattttagggttgttttttctatttctgtaaagaatattattggtattttcataggggttgcatgactctgtagatcactttggtaagcacagacattttagcagtattcattcttccaatccatgaacacaggatatctttccatttttttgtgtcctcttcaatttatttcatcaatgttttatagctgtcattgcagtactctttcacttctttggttaaatttattcatttgtttttattttttgtaactattataaatgggattgctttcttgatttctttttctgattgtttgctgttagcgtatagaaatgctactactttttctacattgattttgtatcctacagctttactgaatttgtttataaccagtgttttctttaggtttttctaaatataggattatgtcatctgtgaacatggataatttgagttcttcttttgcaatttggatgccctttatttctttctcctgcctaattgctctggccaggacttccagtattaccttgaataaaaatagtgaaagtgagcatccttgtcttgttccagatcttagaggaaaggctttcaacttttccccattcaatatgatgttagctgtgggtttgtcatatatggcttttattattttgagatatagaaccacagctttttttttttgagacagagtcttgctctgtcactcaggctggaatgtagtggtgcaatctcagctcactgcaacctctacctcccgggctcaagcaattcacctgcctcagcctccccagtagctgggattacaggtgcctgccaccacacctagctaattttgtgtatgtgtgtatttttagtagagatggggtttcaccatgttggccaggctggtctcaaaatcctgacctcaagtgatccacccgccttgacctcccaaactgctgggattacaggcgtgagccaccgtgcccggccagaaccacaacttttgatagaaggctcaagacagataccctaacctaccctcttttttcacttttttattttattttttaaccttttattatgaacattttcaaacataaacaaaagcagtatactgatcagtagtaaacctctgggcacccattactcagctttacttattcttttttttttttttttttttttttttgagacagcatctcactctgttgccccggctagagtacagtggcgcgatctcggttcactgcaacctccgcctcccgggttcaagcgattctcctgcctcagcctcctgagtagctgggactacagggacatgccaccatgcccggctaatttttgtatttatagtagagatggagtttcaccatattggccaggctggtctcgaactcctgacctcgtgatctgcccacctcagcctaccaaagtgctgggattacaggcgtgagccaccgcacccggctatttacttcttcttttatgaagctccctcctccaaaacacccccatcacctgttccttccagctctctgaccactccttggattctctgtgaattcccttttctctctttgaagcctgccttcctggtactgtactcttgcacactctctttcctcttgcaagaagccagcacgtggtacagatcttgccaatgacccttctctcactagctgagtggcatgaagaagcagaaaatggttaagagcattggtttggagtcacagaccttcattgattcccagctctgccacctatagctatttgacttgcacaagtcactaacctttcagagactcagcttccttacgtgcaaagtaaaaatcgaatgagataacccaaataaaatgtcattagggggatttttaggttatgtatataaatcatgcaataaatgctagtcatttctttcctctggttgactgagagcttccaggaaataggaatgggttctaactttctttgtattcctagtgcctaaaacggtgcctgacacaaagtaggcactcaatagatgcttatgaattaataaagtatgagagagcctggtaggtatttagcaggggaggaaggttttaccaaaaatggtgctgtgtttggtggcagtgtgtcatagagattgtttgggactggggaagtttgagttgtgtgtcgccaacaattgtgtctcatggggagttgagatagaaggattgtgacacatggccatgatggatggtgagttgagtgatgctgttgagctggaaggtgggggactggacagactatcttgagctgggtcccttgtagtgctgggttgggctcatccactggttccctgtctaatcctctttgtctgcagtgtgccccaggctacgatggacagaactgctcaaaggaactcgatgcttgtcagtcccaaccctgtcacaaccatggaacctgtactcccaaacctggaggmttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggtgaggccccaagacaaggggcacaagtgtgtctggagcacagccaagcagaccayggagagccagatagtctccacccatgcggcagccgtcacctggtccatcccctgcctccacgcccacccccgcccagaaaagatgccccaggatcccttcacctgcacatctagcactgggccaacatccaggaatgagctaggatggaggcagtgactgatgcagtgtgtgacrtctaatctcccccataattacaggccagtggtgtgaggtggagatagaccyctgccacagccaaccctgctttcatggagggacctgtgaggccacagcaggatcacccctgggtttcatctgccactgccccaaggcaagtgaycacaaatctgccttctctgttgccccctatgctgacaaggcaagaatacctcagttggaatcccagaagggactgtgggtgagcactgatgtggaaattattggaaaaagccatgccaagctcacagtgggaagtgtctctcagaagcagtcaaaggcaaggcaggatcrgttgatagcatgaatggaattttcaaaaatcacaggcgttgcctaagggaaggtcaggagctccccaagctcaagctgcrtggtgggtrgcctcagataggttattttaactctgtgtgtgtttgtatatgtatttatggacctcagatgcatggaattagactaatcttaagctttggttcctgatacactgacattggtttatgcctggtcttcttttattttattattctaacaatgtaacacccatgaacctaacccaagaatttcaatattaataataacttacatcyacttaagtcctcctcctgtatcctgttccctctccagaggaagaggaagacatatgatcctatttctaaggagtaagataataatataacagccggccgggcacagtggctcacgcctgtaatcccagcactttgggaggccgaggcaggcggatcacctgaggtcgggcattcgagaccagcctgacaaacatggagaaaccctgtctctactaaaaatacaaattagctgggcgtggtggtgcatggctgtaatcccagctattgggaaggctgaggcaggagaattgcttgaacccgggaggcagaggttgcaatgagctgagattgcaccattgcactccagcctggacaacaagagcgaaactctgtctcaaaaataataataataataatataatagcattctattaactgtttagtcttctaggacttgcactgtaatgccacagtccatcaggttgttgcacacagctgtgcttcatccattttcaacagaatgtaatatgtcattgtgtgaaattaccacaggacatggtttcaacatccacaaaatgattaacttgatgctctctgaggcgccttttagatatgagaatctaggaccctctgcaccgtcttaacccaagagtttgcttgatrgagagcgggaagaataatgcaagttscatctccaatatctcccctcccctccacagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatgraggggactgctctctrggagtcccagacccctggaagsgctgcccctcccactctcggtgctggcttctcttccgggacgggcagtgccacccacagtgtgactctgaagagtgtctgtttgatggctacgactgtgagacccctccagcctgcacgtgagcctgaaatccactggagccagggaaggagaggggtgggtgagaggaggaggaaggacgtagatggctctgagttacagtgtggccacagccttgggctccagggagtttccaccctaataaccatcactaaacaggggtcgaagactctggactccaacctagggtaatggggtggcatcagtatttaatgtggggcgtggcctttgggctcctctctaagagttgwaggaactcaggtctcaagcctccttccctaagccttgctgccatggrgtatttcccctagcagtcagcacctcacagagggaaaagggcctgggactctcctttagaaacagaggagagcttgggagggtacagagaggggacagtctagggagacaggggtgttagcagacattggggtgtctggactaccatccaggacttgactaagctcattgctccacagctgcccccacttagcaaccaaagccctagagggcacaaaatatggggaattctttctagggtgaagaaaagagtcaggttttagggaggtcctgagtccccctctccttaccccacagtccagcctatgaccagtactgccatgatcacttccacaacgggcactgtgagaaaggctgcaacactgcagagtgtggctgggatggaggtgactgcaggcctgaagatggggacccagagtgggggccctcyctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacrcagcccctgggcaaggagaccgactccctcagtgctgggtaagaagctaggtggagggaagggccagacaccagtttttttaagagggcagagggaggaaagggagccagggaccaatacagaggtctctgaggtgcctcctctacaggtttgtggtggtmatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccggtaggtgaccccttgccactttctctgacctctgttcccaggccagctctcatgctagcaacaggcaatggaggctgaatcaaacaggacagctgagactgaaaatgttctttgtggggacttactttccctaaccccgctttctctaactgaatctcccactggcccatttgttctacagtctccttccttatttccctaagcacattatcctaacctctgtcatagccctccaacaaagggatggtttatcttctctaccagactgagaatacctaatagtctttgtatcagacaattcatagtacatgaaagaataataggctgggcgcagtggctcatgcctataatcccagcacgttgggagaccaaggcaggtggatcacgaggtcaggagattgagaccatcctggctaatgcggtgaaaccctgtctctactaaaaataaaaaaattagccggctgtggtggcgggtgcttgtagtctcagctactcaggaggctgaggcaggagaatggcgtgaacctgggaggtggagcttgcagtgagccgagatcgcgccactgcactccagcctgggcgacagagggagactccatctcaaaaaaaaaaaaagaaaaataactgctatatcgtactttgtgccttactctaagcattttacattgttacctcatttaatcctcccccacaaccccatgaggcacgtactgctggttgagtatcccttatctgaaatgcttgggaacaaaagtgtttcagatttcggatttattttggaatatttgcattatacttactggttcagcatccctaatacaacatccaaatgctacaatgagcatttcctttgagcgttatgttggtactctaaaagtttcagactttggaacatttcagatttgggattggggttatggatactcagcctttttttgtgtgtttgttttctgagacagtcttactctgtcagccacactggagtacagtgacgccatctcagctcactgcaacctctgcctcctgggtttaagcaattctcttgcttcagactactgagtagctggaattacaatggcatgccaccatgccctgataattttttttgtttttgttttgttttgttttgtttgagacagagtcttgccttgtcgcccaggccggagtgcagtggcgcgatctcggctcactgcaagctccacctcccaagttcacgccattctcctgcctcagcctcccaagtagctgggactacaggtgcccgccaccacacctggctaattttttgtatttttagtagagacagggtttcaccatgttagccaggatggtctcgatctcctgacctcatgatccaccygcctcagcctcccaaagtgctgagattataggagtaagccactacacccagccactaatttttatatttttagtagagagggggttttgccatgttggccaggctggtctcgaactcctggcctcatatgatccacctgcctcagcttcccaaagtgctgggattacaggcatgagccactgtgcccaacctcaatctatattatcatccccattttgcagataaggaaaccgaggcaaagacaggctactaaacttgtccaaaggtctcccaatagtaatcagtctcaccaggagtggcctctctttgtgactctgtctctcccaccagcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccccactaggcgaggacagcattggtctcaagtgagaatgaggagaaacccaggctcaggaaggggagtctctcctatggcgatatttacaatcagaaaagataagaaatactattgcagaagtcaaagataggggaaggagagaggggtgggaagcctgctggaaattttggagaccctgatggtcataattccgtgtaacctctacccacccattcctttccagggcactgaagccaaaggcagaagttgatgaggatggagttgtgatgtgctcaggccctgaggagggagaggaggtgggccaggtgaaagggctggggcaagaatggtctggaggtgatggaagsgatsaaagggcaaatcaaccttcactgatccttgctgttacccaaaggctgaagaaacaggcccaccctccacgtgccagctctggtctctgagtggtggctgtggggcgctccctcaggcagccatgctaactcctccccaggaatctgagatggaagcccctgacctggacacccgtggacctggtatgtgagtcaacccagaccaagaaaaaaaaaaaaagtcctttgaccctattagaatcagagagtcctttaatatcagaactagaggaaataattttagactgagtgccttagaacaatgattctcaaagtgtggtcctcagacagcaaaatcagcatcacctgggaatttgtcagaaatgcaaattattgggctccactacagagctactgactcaggaatttaaaatgttaggcaatctgttttaacaagcccttcaggtgaatctgatccagactcgtttgagaaaaccactgctaggccgggcgyggtggctcackcctgtaatcccagcactttgggaggccaaggcgggyggatcacaaggtcaggagatcgagaccatcctggctaacacagtgaaaccccgtctctactaaaaatacaaaaaattagccgggcgtggtggcgggagcctgtagtcccagctgctctggaggctaaggcaggagaatggcgtgaacctgggaggaggagcttgcagtgagccgagatcgcgccactgcactccagcctgggtgacagggcgagactccgtctcagaaaaaaaaaaaaaaaaaagagaaaaccactgccctggaatgtcagagaattaagctgcaggttccttttacagaggaagaaactgaagtcagagaaaagcagaaaagtcacttggctaaagccacacagagccagaacttagcttcccaacacctcaggttttgattctcyctgagcttacatgttgtcccttcccccttgttgtgtcctttagattgacccattactctgtcttaccaacagatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccaggttagcacacactgaggtccctacagggaatggggcgagcttacaagtaaagctggacagaagcatcccctagagtttgacaaggaggaaattggtgtgattgggaacctgacagggaaactgyggaggatggctgaatatggattgcgagtggggttaatagtgtaaggaactcgagttggcagtccaaggtaccccaggkgtcwstggccctctgtctccccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggtatgtagaggaaggggtgatgtatgctatagagaagttgagcagatggggtgggagatagcgtgcaaaatataggtgcagcagaggggcattccctctcatcctgctgttacgrcggtcaatctgagatgcggtggaagtacgggccgcgtgagtttccccccccaactcccaccctcaacaccacactggccctccgctccagcttactggggaactggcatggaacacagtgtctgtggaaaggggggggaatctcgtggggggagactgtctcccggtctcaccgaccccagaacaatgccccattgtccctcccgcgcactggtgacgtcaccagggcaacacttcctgcaggccggtggtctcctgggcaacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagccgataaagatgcccaggacaacagggttagatgggacagagggcttcccacaaaacagtcaggcgcacgagagatggaaagtgcggtaacccgcaaagcctgaagggataggggccagtggtcgcgcaagtgaaggcagaaaggcccagtcctgtgggcgtggccttccctgatatcggccctggctcttctgtacaggagcagacgccgctattcctggcggcgcgggaaggagcggtggaagtagcccagctactgctggggctgggggcagcccgagagctgcgggaccaggctgggctagcgccggcggacgtcgctcaccarcgtaaccactgggatctgctgacgctgctggaaggggctgggccaccagaggcccgtcacaaagccacgccgggccgcgaggctgggcccttcccgcgcgcacggacggtgtcagtaagcgtgcccccgcatggrggcggggctctgccgcgctgccggacgctgtcagccggagcaggccctcgtgggggcggagcttgtctgcaggctcggacttggtccgtagacttggctgcgcgggggggcggggcctattckcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgaytgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacrtcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgttacctttttttggaggaattggggagaagaatgggaaaaaagatgggagtgactgcataatgtcagcattttgtgcttttggctcagcatttggattggatggaggatgtaagtatagtttaaaagcaagaataagtatatttaggggccctatgataatttagggtattatctgaaagcaagaatctagtagccaagggagaaaccgcacacactaggtcaggggtccccaacccttgggccacagactggtactggtccatggcctcttaggaactgggccacacagcaggaggtgagcaagcattactgcccaagctccacctcctgtcagatcagcataagcattaaattctcataggaactcgaaccctattgtgaactgtgcatgcaagggatctaagtttctcgcttcttacgggaatctaatgcctaatgatctggggtggaacagtttcatcctgaaaccagccctccgtcgccaccgaccatggaataattgtcttccacgaaactcttccctggtgccaaaaaggtaggagaccactgcactagatgatgcacacactttgtccctcatcctagggcttttacttatggccacttaggagattcctaaggccacaagtcaagtagatggagagagtatcttgaaactttgtccaccttgcagcaatatgttgctaggtttgaaacatggagtcatgaggcattttgaaagccaataatatctacagtttattaagtattcactatgcatcaagtgcttyattacattattaatacatcaaccctatgaagtaggtgctattaaaaccctatttcactcagaaattgaggcacagagatctgcccaagattgcaaggaataagcggcaggaccagatctcttcatcacatttcacattccaaatcactcagctataaactccctaacatgacaggttgccatttagaggtaccaaatggttgtctgccctgctccttccttgatgccaaccagcctgattagcattgatcaaagaccaagccagagaggtagtcctctcccttttcaatttcatttcatttctttctttttctgaaacagggtattgctctgttgcccagcctggagtgcagtggcacaaatggctcactgcagccacaacctcctgggctcaagcaatcttcctacctcagcctctcattkttccatatctatatctcttatgcccaaaataaactttcccctgccccttgtctgcactaaactrtaagtttccaaaatgaacccttcccgtactctatttggtacacatcttgtctcctgaatagagtgtattttttattttattttattttggagacggagtctcgctctgtcacctaggctggagcgcagtggcacaatctcagttcaccgcaacctccgcctcccgggttcaagcaattctcctgcctcaacctcctgagtagctgggattacaggcgcatgtggccacgcccagctaattttttgtattttagtaaagatggggtttcaccatgttccccaggctggtctccaactcctgagctcaggcaatccacccgcctcagcctcccraagtgctaggattacaggtgtgagccaccgcagccggccatctcctgaatagattttaaatacctagaggtcagggatgattattcaatacatatatattgaatacttactatgtgttggacccggtgctagggttttatgtatatatttgagagctccacatccctggatctgaatcctccacttcccactggaaccatgcccctcccagtcccggtaagtaagagggaagatcgggagggccaaatcctacaccagggtctatcttarggagggaagggacctggctggggggagggggattctgaggagtgaaaccacttcctgtgtagctagttcctgtgttgacagaaagagcagaagaggaggtggggtggagggagcagagccagggattaggggactactgaggctctggagatgagaccgccaggagtccttccccaccatgagccccctccactcctgcagctggaggagtttttcccagtctcagtgctgccctggggcgagagagactgaacaagctgtttgggtgggaagagaatggaggaagttgacagggatgggcggggcccgtgggggggctgaccaggaacccagcttcctgctcagtacccaggcatccagcccccagctcacccccaccccttccagcccccactcccctcaggaacccaaggttccagccctcctcccaaatcccagccacccctcccccaccagtttctcccctctaggggatggaggctgagagaccccaggaagaagaggatggtgagcaggtgagctgggcacggggttggggaggctgacactgggaaagaagggaggtgagaggacctggggcagaaatgtagggacacaggggccttgaaaggcttgggcaaactgaggcaggaacagagacacacagagaggaaacgggccactggcctagccccctgtccactcctcccgcttcaaccaccactgcttgactagaatggacatattttggcatcagggcccccctcaggatgaggaaggctggccccctccaaactccaccactcggccttggcgatctgctcctccatcccctcctcctccagggacccgccacacaggtacccctacccacccagggagagccccgaccctagtgcccacatcctgaccccattaccaaggcccactccattgtgggccctctccccacctcctccagactccccttgggattccccattgcaccccctctcctctgatccaaagtccctaatcacgtcaccctgtccacactcccccacggctcctgtctgccaacctctctgggtctctgagccctccacacccctctccccagccctgggaccccgctcggcctccctgctctccctgcagactgaactccttctggacctggtggctgaagcccagtcccgccgcctggaggagcagagggccaccttctacaccccccaaaacccctcaagcctagcccctgccccactccgtcctctcgaggacagagaacagctttacagcactatcctcagtcaccaggtaagacatccccccaggaggcaaacccaggcctcctggtctcttggcccctgttctctttggggctctactcctgtttctccctaggcaccccatcgccttcacaggtttcctatatgcctccccataccaacccttgatcctctcaagaacctcctcctctcagaccctcaccaaagctctccctctccctccactcctccagtgccagcggatggaagcccagcggtcagagcctcccctccctccaggggggcaagagctcctggagttgctgctgagagttcagggtgggggtcgaatggaggagcaaaggtcccggccccccacacacacctgctgagacttgagccccaaccagcccttccttgccactggtctcaaagctgggcagcccattgcatgccctcaactcttgcttggcaggggtaccagagactgaaagacacggcacaaatctcaatattcatctcccacatcaccttccctgggaactggacagggtgaaagtcctcaaactctgggaacaggcgagatggaacagggatttaactccccgcccacaggtccatgggagcttgaggcagtaagggggatcccaggcacccatctcaaggagtggctgggagtcttttccctaacttgtggggacaccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgaggggtttacgggctgtgaatggaccttcagccctgcccaccctccctccccactgctgctgagtctgtctgatgttttggttgtgtgaataaatataattcccctctggactgcagactggtatctggggggcccaggcggggtgaaaggtaggaaggtgaggccagaggccttttctctccccagtctggccagaggccagctcccctccccggctggttaattactggctcattaagcagcggctggagacctccctaattatctcccccagcccccctcttcggttttaattaagtagaacagggaggggagtcattagaacaagaaataygaactgagctgccggtgaacccaggcattccagcggcctgagtccacatcgcttagatccctgattcaggacccaggtgacagacgcccccagccgccaacacagccccactcctaggccgcggaagtccagccagggggctttcccatatctttcagatggcccgtctcctcccctcatcccctcttccctctcccctcctccactaggtctcagttcctctgtttctgtgtctctctctccgcccccagctcctccctgttcctcctctcttctcccctcctcttcctctccggctcccctcccccagcctccctccctcgctccccccccttctccctcctccctcctccctctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagtgagtgcccccactccgggaccccacacagacccagcaaaccccgttcacatgttctgaatcttctgggagccccccccaactccagggccctctccaggatccaacagctctcttctctccttattcctgggagcccatagaaaagtgatccctctcaaacctcccttcacccccaggccctgaaaccttcacagagggaacccccggtggcccggctccccactcctaaccttttgccgacccctgcagtctcctggaacagccccatccccgggagccccctctggctcccagactaagaaactgttcttgggctacgttatcttctcccctaactctccacccagccccctcattctctccagatgtggagacctccacaccctctccagagcccctaaagctcctctccactgctcagccagacactaggtgcatcaaagcctcccacctgctcagccccaggaccccttcacacaccctacactgatctccccagttagctcggcacccccagccccactctgccacctcaaactctgactcttctcaaccccagcytctgtctctctccctctgaaacctaccaagtcactttcctttctccatccactcccagattcctcctcctacctttctagaccatctcccaaagcccgcagcctttaacctgctgcctgcatcttccctgtgtctccctgaagctgaggagcttccccatgctctgggagctgatcttttcccaagaactcctcattccacccccaactcattccacccccaatccgcttcctccctccgcagactgaccctcctccctccttgttctcaggccccctgctctgtttctctagctcctcaacttttctctttccccactcccactcctcccaaggaaacacgccctaaactgccaccgaatgaagcctgctctctttagcgtcctgtgtgaaatcaaggagaaaactggtatgtgggcsccccccggattgctcaactctgggaacagaaccctgttcattatagggctagagtgtgacaacttggggccctgaggaaagtaaggagtcagggggactggggaaggaaccaaagcctgggaacttggctctccaggaagcaccaggaggactgagcactgggtattggggtctctgggtccctaagtccactcgcctgcatgctaggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggtaaggagaggaggcttgggtgggtggagggaagggctcttgcaggggaatcccatggtcaaagggctcctcctcaccagcccacyggcccccactacaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccaggtgggcccagggaccccaggctggcccccagcactgggctccttcccattcctctccaagaccctgagctgccatgctgcacaacatggtactccatgacaatggtgactctggggtcatgccatgtgacagccctgccaggacatcaacatcctcctcacygctcttctccctcctctgtagacgaaagcgccgtaacttcagcaaacaggccactgaggtcctaaatgagtatttctactcccacctgagtaacccatatcctagtgaggaggccaaggaggagcttgccaaraagtgtggcatcaccgtgtctcaggtattatggaggttgcgggaggagttgtcaggcaaagtgcacgcatctcagctaggtgcagtggtgtgttcctgtaatcccagctactagggaggctgaagtgggaggatcacttgaattggagaccagcctgggcaacagcatagtgagaccaggaagcaaaaaaaaaaaaaatgctgtcactcacatcttattcagtgaaggacttcagaggcaaatgtttctacctgaccctcctttctgccccacaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggatcccactgtcaccccrgctgactgttttgcacacttcctgcttttgttcccacttcctatctaggcaggatcatagcagagagggggccttttggggtgagagggaccgagctgagataggctggagatgtcaggggacagaggccattccagtgatcttagttctgcctttcttcccacgggtggccaaggaacagcctgctctttctgtgtgttggaatgttattttgtggataattggagtatagtagcatgtccccacaagagttgagagttgtggttcatcctctaccatcacgggctctattacactcttccctctctgcccccacaaggctctggcggctctttcaatctctcaggatctggagacatgtttctggggatgcctgggctcaacggagattcctattctgcttcccaggtcagatgcccatctcctctcgaatagggctttccccaactccatttcctctactttaggatacaagacctctttcctctgaggcttctcttcactgtcataccttcctctgctgcctgcaggtggaatcactccgacactcgatggggccagggggctatggggataacctcgggggaggccagatgtacagcccacgggaaatgagggtgagtggatcctgaagctcctctctgtccagttctcacaggacagaggggcattttccctagtaatgttgtgcccacacagggttcccagggctytctctgttttctgtactctgtctctcctttcaggcaaatggcagctggcaagaggctgtgaccccctcttcagtgacatccccaacggagggaccagggagtgttcactctgatacctccaactgatcttgcccctcagggtcacaggggtgggggstctcacaaggcgacttgaagaggacgcaggcttccagaggacaaaccccaatacaggagaagcacaagacagagaagggccaatggggtcatccsctccctaaygagactstctgtgctgggggtgctaattacatggcaggaagaatggggcctctaaggggagtgtggggtctgtctctcccttttttccatctttttcctctctcgckttctttcttacacagaaacatrcacataccsagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttkttgttgttgttgtttttgttgttgktgktggtggtggtggtggtggttcttaatttttaatttagtttggggaagtagcttgtttttttttttataaatatgttgatttcttgtcttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagytccaaacaggtttctctcctgttccccagccttgccttcatgatgcaggcccaawtgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggcwgccggaacagcagttggagcctgggtgctggtcctcagtctgtggggtgagccactcccycaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcrgctggaatgraaactggtaagcggggctcctgttgcagcctcccaacttccagggagaccagcaatgatttggatccccgtcactctgcctcacagtcctttcccaaaggccttgcactgtttaggccctgcttctctgcttctagaacacaggccggacagaagcttggaaggtcctgtctccccagggaggaggcccctgggacagtgtggctcgtgtccttcccaacrgctccctcttccttccggctgtsgggatccaggatgaggggattttccggtgccaggcaatgaacaggaatggaaaggagaccaagtccaactaccgagtccgtgtctaccgtaagaattccagggtcttctccaaggcctccctcttacctaagaaaaagccttcaaccccagccttggcccatgagggcctctgacttccactggcctcatttccacayacagagtttgagaaccttcacaattacagcctctgactggatttttcctccttcagagattcctgggaagccagaaattgtagattctgcctctgaactcacggctggtgttcccaataaggtagtggaagaaagcaggagaagtagaaaacggccctgtgaacaggaggcgagtgtgtgtgggtgtgggtgtgtggcatctctcattttcaaaggattctgaggtcaccactctttccccaggtggggacatgtgtgtcagagggaagctaccctgcagggactcttagctggcacttggatgggaagcccctggtgcctaatgagaagggtgagtcctaaggtgccccccaagctgccttctccctgatctcactcccacacccaccctgggataatttgtcttatcctcccatcataggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctggggtgagcataggtggggagggccccaagctcacgtgagcacgttctggaagtctgacccttagggaaagagggagtcaagcccatggccactgggatcactcacaagtgtaactctccacctcaaaacccttccaactcccagagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggaggtagggtgaaccataactakcaacagggagggcagagggctaacgagggaaaggcaggctaggagctgaggaggaagagagggtatctgaagatatggagacaaaaagacaagggttttgaaatagtctcctctccccttcccccaccagggtgtgcccttgccccttccccccagccctgtgctgatcctccctgagatagggcctcaggaccagggaacctacagctgtgtggccacccattccagccacgggccccaggaaagccgtgctgtcagcatcagcatcatcggtgagacctctccccaagccctacagaccctgggactagggtgcaggacagcacaggctctaatttcctgccccattctggccttatccctaacagccaccccacctctccctccatgcacccacacccaagcctcccctrccccacccaaattctgccaagagagcagccaagcctctcccttcttccctctgagctaaaaaaaggracagacggctgggcgcggtggctcacgcctgtaatcccaacactttgggaggytgaggcrggcagatcacctgaggtagggagttcgagaccagcctgaccaacatggagaaaccccatttctactaaaaatacaaaattagccaggcatggtggcacatgcctgtaatcccagctacctgggaggccagctacttgagaggctgaggcaggagaattgcttgaacccaggaggcatagattgygatgagccaagatcgcaccattgcatgccagcctsggcaacaaaagtgaaactccatctcaaaaaaaaaaagaaagggaaagactccactggggctcccactaaataaccctctctcaacccgaagtcttcctttctgactggatccaactttgtcttccagaaccaggcgaggaggggccaactgcaggtgaggggtttgataaagtcagggaagcagaagatagcccccaacacatgtgactggggggatggtcaacaagaaaggaatggtgagtggtggtggctgtgctctcaattttccctgtctccrtacaggctctgtgggaggatcagggctgggaactctagccctggccctggggatcctgggaggcctggggacagccgccctgctcattggggtcatcttgtggcaaaggcggcaacgccgaggagaggagaggtgagtggagaaagccagacccctcagacctagggcttccaggcagcaagcgaagaggggtcggggggtggaacgacaacgtgccgcattccccccaatctttctcctcaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgctcttgtgtgtctgtgtgtgtgtatgagacacaacctcacccctatacccttgagggccctgaaggaaagggactcacccccatacttcaccatactataccaaacatctactcaagttggggagaagatgcttctgtcgggggtgggggcgaacttgggaagagatcccatcaatatatttcaccttttttattgaatttgtattaaaggaggtagtgagggggcggaagcacttaagagtcagaatccatattagactctggggagtgaaaaattaaattaaatcagtaagatggggagtgggggaagagtcagagggaactttgcccacctttgaagatsaaatcaagaaatcagggaaagcaaagacttaggagaggagaaagacattctctcaatccatcctccttccccagggcagagaattaaacaacgttactgagtgagcctctgagcagaaggctctcccatctatgcacagacttcactcctcctccccaggccttcctggacaatgtccagggctggccttagccaacagaaatagaggggtcaagggggtccaggagtacggaagggtcagcagggaccctcaatactgattcttctctggctggaggtgggcaggaagcagacatagctcaaatactgagcagccaaaaaaagaagaagatggcgagaaacaggaagagggaatcctgccagctggaggcygggtgaccctgtcccagatccacacctgtgggagagaggaaagctgtggaagcatatgctcctaggctgggagggggcctgaggggattcacagggctccctsatgggagctgagtgtgactcttacctgtaccccggcggaaaggctcatgggcattgaagacggtggtgaaaaagccaaagggaaaagcaccaacaccaaatgagaagtggaagcccccggtatcaccaaatggctggaatccctagggaggcagaaaaagtcagacrggaagccggcaaatctgtcaaggaagggacacaactggacaagaagactcacccctctgctctcyggagctggtctctggccctgggggcggggtggagttttyaatctgaggaagtggagagagaaagttaacagggatttttctcctcccatcttccacaccgttttccaagggcagaagccttcaatcttccctaagcaacacctccagtctctcacctgggatcctggggcttctggctccctcgcccataaagcgggacaaccttctctctgctgatmccagctttacatactggacactcttgccgttctggccgtgtctccagccactggggagaaaaaaggtggtttccagtatacaagagggtcttacagctcctcagacctccccatttccctcttcatctcctgagtacgcacctgatgaagacatggccaactggatgggggagaaaaaaaaaaaaaggtcaaactagctacagaaaagagagacacagaccctagacttcgcagaatcccatctaacccctcttcccaagcaacctgctgttgcttttcagattttctgcaacctctaccatgccagccaacttagttagccttcctgcttgtctgatcttccaacacctaaagctctgtccatcctcaacacactcaaccctctcctttctcctctccccaacaaacacrtacaaattttcgtgccctctcttttctgcctttcaagttaatttctaatttccttcagccacctctttcygggtctcctcttttcaaccccaaccccatcactccaaaccaaacccctttactagcacattcccccattactcactttcaagctcaataatgtccctatctttatgaccctttaacctttcaagtctgcctctccacagtgcccttataccagccccctcccagatctcatctgaatgtgatccatatttcctggttctccccgactcaactgatgcgtgcctcccttaacctttgtgtctcacttgtttccacctgcacagctaagacccctcacttctctggggtaaggtggctcgggtctcacattgtcctgccaytccccgccccaccttctcttctcagcacatcacgtgcctcagctcctggttcctaagacctttctttccacagatctcgaccgttatactcccacccacacataccagcaaagtcttatgtctcctgtcgggcttcacctatgggaacgtgccctccgattatctgtatgactgtatgattattckctcctagcctctccagtatataagcgagacccaccacctcccgcccccctcctcgattctcaccagtacaggtggccacacacactgaccacagcttcccgagcagtctccaaacatatattacattcgaaggtcgcgcccgccccgccccgctcgcgatttggcccttcggggcccccgtcctcctcctccgctgctgccatggccggttttgtttcgccccacgtacccttcagtccccccaaatacacatacacacgccccaacaaaccagaaaccacctcctgcccacgatcgttgggcaggcttcaaggtttcctaatcactattggtctgaatgcctgccagtcacaaagaattcaaaagaaaggattggcccaaagggtaggggcgggaaaaggttagtgcagtcctgccttcgcacaatggctattggctgatacggtctaagtcaatgtgcaatgccaagggattggtaataactcgctacacsctgtcscctggccaaggagggctttattcgtctgagtagttgtcagtcataaccaaagccataagcaatttgctcgggactacctatagacctcgcccactataagcccctttctttccttcgcttcctcttytagagaatgtccggattgctattggactttggagcgtatggctccaaatcaactcattggctaaaacttgmcggaaaatggtggttaggtaaaacgcgcctgcgcagcacgcggcgggacgggggtgggccaatcctgtgagggtttaaccttctcttkttccacctcttcacccctatcttgtcgccatggtgactgctctacaattggcgaggcttgcacttcaaagtcctaggctcgcttcatccgggtccttcrgctgtggactttctgctgattgggccttttccttttcccctgattggccgacatcgggaaagacggcgaagagctaggaaaagagggaaaacactagggtcgcagggttcaaaatggctccaacctcctttggtgacgtagagagcagaacttgggtctgcccctcccttttagttaagggagcagaactgggattagcccgacgtttggatagtgggaacatcgatctgcggcgctggtgttaacccaactcattcggctggacgactcagccctccccatattaggtgatttacagagcaaaactgaactaaaggcccacccctttcttaatgttgtacacagagtagaacaggattgacttcaactccgttttaaaccttcagagcaggaaagctctggrctcaacccctttgtgagtggtgcaaaagggacaaagcccgccccttttaaggagacccgcggaggctagacccgccctttcctctttataatttgcccatcagaaatagggtcttcttcccaggttggaccccggggagtttgggcttttcctacaatcactgaccctcactgtgactaaaggagcagaattaggtaacagtcctcccactaccaatcctcttcccgagggcatgtaaactaatgcagggtaaaggtgtggctagaggggggaccttgataaaagatcccatgtgactcaagagtaaggaaagatgagaagttagcagttgcgtaaagaaggactggggcagatgaggattcaggaagcttgaggtttaggaaggaagatattgagagggaaaggtggaaatgaaggagagtgaagtgatggaatgatcctagtaaagggataatgggagtggaggaagagaagagggggtggaaaactagatacatggctaccaaattaaggaggcacgcgcattccagaggaatcggcattcttcctcactttttatttttctagaaagcacccctgaagccaaatttccattggaagaaaagatgtacccatattgtatgttgtgagaaggggttgtctcagcttgggcaagtaaggagactgatacgaagraagtaggaaagaaaaggtacagaggtaaaagagcatggaaaaggaaagggtcagggataaggccaaagagatctcttctctttaaaggccagagaaggcaggtggaggggggagctggactgctgggagatagtgagggacaaagggcaaaggaaaccagaccagaggactggagagtgagatggagtgagatggagtcctggagagaaaaagaagagaggtgaacttaatgcttgtcatatggtaggtagatgcttgataaatgtttagaattgaatgggtacgggaaaaggggtccttaagaatagttggggggaataagcagcagataaccggagttgagaaaaaaagagaccaagtaaaagtggcagttaaaagagagctgatggagaataaaggaaggaatgtgcggaaggaggaatacagcaccaggggatccagagctgaaagggagttagagaaaaaaaagatgcagctggagccagagatgggggcaaagaccgagggagagccctgggscggggctcgcaagaggacactggtagatgtggggaggagatgccagagtttctgggagacgattggcaaaacaggctgcccatcaccgccctccacttcctggccggccccggaaaccagcaggcgttggggaggggtggcgggggaatagcggcggcagcagccccagccctcagagagacagcagaaagggagggagggagggtgctggggggacagccccccaccattcctaccgctatgggcccaacctcccactcccacctcccctccatcggccggggctaggacacccccaaatcccgtcgcccccttggcaccgacaccccgacagagacagagacacagccatccgccaccaccgctgccgcagcctggctggggagggggccagccccccaggccccctacccctctgaggtgtgggcgggaaagggatgggaggaggagggaagagggtgctgaaagcgactaggatgaggggaaggggagagattgggtctgggagggccgactgggggagagggttgctggggaaaggagaggggccgactgggaagagggttgctggggataggagaggggacctgagagggaggaaggatggaagagacctgggagggaggagaaatggaaacccttgtgaatttgggactgggagcgtgcacagggaatcctggagagggaattccctacaccttccccaattccttttcttgccctttgaccccacatgactcttgaagggtcatgaggggagaaggccagcagaatttgcctcttaggaatacccttaggtgcctctgtttccatctaggcacaggacctcttgtttctcagtggccttccacactgctagacccttactgacacacaaatgccttatgggagccatgttttctacattgagtctgtgtgcctttgacatgtttaatggcttgtgtgcaactaggttgtcccaatgctatccataggctgtgtagaaatggtgtgttattttctatcagaattgcccattcttcattcttgtgtccatgtctcacatccagttttgacatgttttaagtaccgcatgtgtgtgagttttcatatattgcacctgttctataatttcatgttacttgcacattttatgttttggcatgtttatttcagcatgtgaaggttatataccttattttgctttggctgacatgtccatggtcctaccatttgcagtagtcttcatgtgtgggatcccatggcttggctgaataccccacactctgatgtctgactgaattggcctgtttgctgtgttttcccagtcamagttcacagaacacatgtgtatgcgcctttgcatgatacactgatgtaacaggaccatagaatgtgtgttataaatttgtcatcagtatattttgtgagccgtatgctcattaaatttggccctccattgcatttctaaatccttggacttttgttctccaaagagggtcacttaatatcaagtgttaagagaagaaggtaactgggtctccaggtctgcaaagaaccatccctgcatgccttaccttggtgacctccctggcccatacctctctacacaaacattatctttccagtggctgtgtacagtctgtgtccatgagctcaatgcatgtcacagggtcaatcctgctgtgaaccccattgttggtatttatttatggacattatcctccattctttgcactgttggcacacatttgatgagagcagcatctttccctgtggcatcttgatcccattcggtacatttctcttgtgagatgacctcttcctgattattgttactctgccttcattatggctatgtattgcatgtatctattcagagtcggttaccattaggcttggtgtgttcgttactttctcagtgacttcttttagtagtcacttctactcaagaggataactatctaatttgtgatcagaaccgccatctctgtcattaactgtggctctatgggtgggtatacagccttagaatctgttcagcaagtgtttattgagcacctactccatctcctattgtcctggcactggagataagacagagtccctgtccttaagctgcttacagcctaaggagggaaacaaaaaygccagtcaacacatagtgtgttgtcaagatcagtggttcttaaattcaggcgcacatcagactcaccagagggcttgttgaaatacagattgctagccagccacgatggctcacacctgtaatcccaacagtttggaaggctgaggcaggaggatcgcgtgagtccaggagttcaaaaccagcctgagtgacagagtgagaaaaagaaaaacagattgctggacctaatgcccagaatttctgattcagtagatctggggtgaagtctaataatttgcatttctatacttcgagacccgctgatcaagataaaagtgtaaggaaagcacaggcctggaggggttcaggcagccctccaaaaggtgacactgagctgtgtgaggcaggagaagagacaggcattccagccaaagggaacagcatgttcaaggtggggaagcatgaaagatcatggtgtctgaggaactgaagtgaatcagtttgactggaacaaagagttttgtgaggatgtggtcgaagatgtaagcagaagtcaacttatcaagaagagcctttaggcaagacagggaaatgctctgtgtttcagaaaaatctgtgctaacagaaaaatctctgtggttgctacgtggaagatggattggagggagttgggagcctactccacatagttcaggggagaaatgatgctgttctgaacttgtaggggcagtgggatggagcagctcagaaagcctacggtattccaactggcagggtctcctgtttcctctattgcctgttaccttctcgcttggcaataggcttacctttgagcatagcccttcccatcatgggaagacagtgcctgtggcctcagtaggaatgacaggtatttgccwgaacaccctttttgtgaattgttaccctgcccccaacactggggcagagtggaggaaggaggaagaacctagaacacaggttctgtgttcctgcctctcttcctcttgagccctttcctctcccagggcaagtgctgttaggtcacctttactccattccctccttttttcacttggtgaggcctcacacactgtacctgcccacgcaaagtgtcactagaaggaagggaaagggtagtaggattcgtttgcctgtctggaggtaggattggtctttgtagctattccaggtatgtccataagtttacctaggaataggggagctgcctgggtggagagggatttttctagttatgcatttacattcttttatctgtcactgggtgtaattataaatttgtgtctatgtgtgaacatgttagtctttgtatgactgtgtgtctgttggcattagtgacacgaacttttaatcttgccatttggcccttgggtatatggctgtgagtgttctgtcacartcaccatatatgctgtgtgctgtgttcgtatatatatatgcaatacataccagtgtcagcgtaatggagtggttaggaacacaggcggcttagatttaacctagaaactgctgtttaggagctgtatgacctcaggtaagttatttagcctccctgggcctatttcctataaaatgtaaatagtaatagtactttctagactatcatatkcatcattttaagagtttaacttaatgtatagaccagtactgttctacagaaatataatgcaagccacaatgtaatttttttatggtagccacatttttacaaggcaaaaagagtgaaattaattttagtaatatattttcttgaatctgataacatccaaaagattataatttctttttttttttttggaaatggagtctcactccattgcccaggctagagtgcagtggcgtgatcttggctcactgcaacctccgcctcccggattcaagcrattctcctgcctcagcctcccgagtagctgggattaaaggcatgcgccaacaggcccggctaatttttgtatttttagtagagacggggtttcaccatgttggtcaggctggtcctgaactcctgacctcgtgatctgcccacctcggcttcccaaagtgctgggattacaggcgtgagccactgcgccyggcccaagattataatttcaaaatgtagtcagcataaaagattagtaatggatatctcacattttgttttttattcagtctttgaaatctgatgtgtattttacatttccagcacatctcagttcagactagctgcatttcaagtagccacatgtaggtggtggctactttctcggacagcacaagtatagaccattataagacccttaccagctacaagtgttagctattattcttgttgtcatttrttatcaggtatctgtgaattgtagatgtctgtgtcttgtgtctcttgtctgaatatatccggagcctttgggaagagtggtgggagagcagtcctgagctctttctccaccaccctcatcctagagagccttcctgggaaggtttcaatgagacccctgccccagtttgtgtctcaggcccttgtcctcatagcaccagcccccagccctgccttctgtgccttgcctaccccactctcctccagaaaccaggctgattgtcccttgccccatcccctgcaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgtcgagaacatgaagtgaggggcaaggggtcttgggcaatgagggaacctaagggtacaaagtgagtagtggattgggggaagggggcatggtgtgtgtagaaaagactgagagagaccagagacagggaatggggagaggactgcaaaggtggtcagaaagacagtaaggtggggggagctgaggcatgcagatggacatcaatggatcccactgggaccccttgccatgaccccacaggatcttgcgtctaatgctgctccacatcaaatacctgtacgggatccgagtggaggtgcgaggggctcaccacttccctccctcgcagccctatgttgttgtctccaaccaccagagctctctcgatctgcttggtgagaccccaccacagggcacacctcccccagccatgcctcccctcctgaaaccttccctagaatatcttctcctagagatcctcaattccccttcctctgggacattgcccccttgcctcccactcaggccttcattccctgggtagaactgccctcataagcagggtacatatacttttggtcaccctttccttcacttggggcccccctccctgcctagtctcctccttcacctccagtccctaccagagggtgatgagctgggtgaggtgggttgccttctgtgacactctgcctccaccccgatcctcacccactcccaccctgcccaagggatgatggaggtactgccaggccgctgtgtgcccattgccaagcgcgagctactgtgggctggctctgccgggctggcctgctggctggcaggagtcatcttcatcgaccggaagcgcacgggggatgccatcagtgtcatgtctgaggtcgcccagaccctgctcacccaggacgtgagtcatcctggggaaatgggggattggagggatacagagtagaacagttgtaaataaactgatatgcagggccagtgggcctcaaaggtcccattataacatcacacctattctgactcctccatatgtatttgtcttctttgaccctctttctcccccaggtgagggtctgggtgtttcctgagggaacgagaaaccacaatggctccatgctgcccttcaaacgtggcgccttccatcttgcagtgcaggcccaggtgactactgctcttcgttctgctactcagctgccaacccccaccattccctcatctctgggcaggggcttattgtaggagtctctgaagagagctgtggactgacctgctttaacccttccccaggttcccattgtcccyatagtcatgtcctcctaccaagacttctactgcaagaaggagcgtcgcttcacctcgggtgagggctttgagcagttctggggtagggtgtgtccggagaggctgggaggacatccctgtgaggcagggggatcattcagtgtcagagccatgagatgtctacacagtcatctagtctaaccccacatcagccaataagtctttactaagcacccaccataccctgccagatgggtagcacttggtcccaccaagagaggctgttactaatcttaacaggaaagataaggcctgtgtgcacaaagctgtaatgaataacactcattcagcagtaaatgccaaacccagaggaggggggctggaggggtgctgaggagatgtctgaactggggattggagaaggctttgtataggagaagggcctcagaagtggcagctggcaagcccagggatggttgtccagggttgggggaagagaactgaaaggttgaggaagagtatcactcggaagctgggccccacctgtgggcaaagacctgggtggacaggccatgatggtgctccccttgccccaggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctmtttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcmtgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatcyggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctggttaatgacatggcagacacagtggctgtggtcagcctggagtggactacactgccactctcaccaaacaataagtgaaactgttgggctggggacaggatttcagaagagaacgatggtaaagtggagaggcatgaggatagtgaatgttggagaggggcttggaggaaagagggaatgcctgaatggagaggggtcttggggaaagttggggaatagaagtcaaggcgggaggagtgtgaggactcacaggcacmtagcctctcctccagcagcagcacctggtcgctgagagattcgatccggtcaccccggccccacagctcagccacctgttctggctgcagctcttcaggcggcacgggcagcaccgctctgacccaggccccagcctgaccggcccactagaaaggaagagatscctcagggtattgacagtgacgtctggcctcgccccacccagcaggcttggctcacctgctccagccgctccaggcgccctcgcagctcgtgaatctcctgcttcagagcgcgctcatctttttcykcctcccgaactagggacaaaggagaccaagagtgtgaccactacccgagcccggacgcccgtcccgagtccctcgggtggcccgtactcctgcccactcaccggccacgctgagtatgctggcactggttgggggctctggggacccctccatgcaggtgcgcccgtccacgcctagcactaggtcatgggggcagccgcaggtgaagctgcctgccgtattaaaacaatggtgcgagcagagggtgatgctggtcctacattcatccacgtctagttaccgaaaaaaggaaggggctgagagagggrgcrggggcaagcacctgggtaggtggggaggacaagctgactcacccacatgacagtgcttccctccccagccgggggcgcactcgcactggtcaggcctaacgcagacgcctccgttcaggcaaggcttggcgcagatggctgaggacagaggaagtggggttcagactcraaccgacgacccagctccccagctccgtggggcgcgcctcccgcaaggcccggaagacccagcctcaccttcacaggtgagcgcccccgggtgccgcttcttccagccctggcagcacactgcatgggtctgctgaacctcccgcytcacctcccgccacataacgcggtacatggtcctggaacacagcgcccggctcaggaccctgagtacgggtcctagttggggttcttggggtcccatctccccatccctcacctgtaagtgctgcagatgcgcctcccagcgcacaaggtcaggtagggcttgtacactggttggctgtaggactcgttgtagtggagcgggaccaccagtgtctgcttggagcagactccctgactgcgtccatgccagaggatgaggtgggagagattgagtaggccaggccctggggagccaggagtcccacttccctcaagaggctactgaggccccccgctctccctccagatgacagcctctcacccccattctaaacttacagttatgttttgcctcctgtgaagccccacccccagcagaaggctcctgagaagagctcaccccgggccctaccccctctgttgtcacctctctctgagggatccacccttggccccctcgcctggtatcagtagcaggaggaaggagaatccgcctaagagagtgcacagctcagccctggaccccatgattcgctttgacgctggaccctacaggctgcaggcaagaaaaggttaatggatgcccgtcccctctcctattaatttctccagcactagtccctccaagggcactctgcaggtaccctctaagggagtcaggacattcacttttacatactagccaccaggattgcctacacctgtgtgtacaacccaacactatcctgtccttagcatatcatgatcctttcagcatcataaaagctcacaccccagcacactccctccacctcccctctaacctacttacttctaatcccctctgcacaacctggagggacacacagtcaaccctccccttatgaccctcctgtctttttttgggtttttttttgtttttgtttttgagaaggagtttcgctcttactacccaggctggaatgcaatggcatgttcttgcctcaccgcacgacctccgccccccaggttcaagtgattctcctgcctcagcctcccaaatagctgggattacaggcatgcgccaccacgcctggctaattttgttttgttttgttttgtagggtgtgagggtatatagctagggttttttttttttggttttttttttgttgttgttttttgagacggagtctcgctgtcaccctggctggagtgcagtggtgcgatctcggcttgctgcaagctccgcctcccgggttcatgccattctcctgcctcagcctcccgagtagctgggactacaggcgcctgccaccacgcccggctaattttgttttgtatttttagtagagacggggtttctccatgttggtcaggctggtctcgaactcccgacttcaggtgatccgcctgccttggcctcccaaagtgctgggattacaggtgtgagccaccatgcctggccaaccctcctgtctttaacatgccctcttataacttcataccttcaaaaccctagctggttgggcgcggtggctcacacctgtaatcccagcactttgggaggctgaggtgggtggatcatgaggtcaggagttcgagaccagcctggccaagatggtgaaaccccatctctactaaaaaatacaaaaaattagccaggcgcagtggtggacgcctgtaatcccagctactcgggaagctgaggcaggagaatcccttgaaccctggaggcagaggttgcagtgaaccaagatcatgccactgcactctagcctgggcracagagcaagactccgtctcaaaaaaacaaacaaaacaaacaaacaaaaaaaacccctagctatataccttcacaccgtacacacaaaccaagcacctggaaactccacacctttcacacactgctactcccctcatatacccacaccgtcacataacgccctaaatgcacatcccttgctccaacaaaacaccccgcaactcatgcccaccctaaggctctgagtaaaccccactctttccccatttgaaattctctccccacttgccttcctctctctctccattcccacctggcttctttctcctgggaggcttcaagcagaccagcctcagcagaagcagctcagactggtgggtgggcctggcaggctaagaaggagaggaggggctgggccagagagtcctcccattcctgccccctcccacaagcctcctccttagctccagcagggtcagctcagtagggtcaagtcccactaccctcatccccaccccagcaaagggctccctagaagtatctttccaaccctctgaggcccctatttctggactccccagatcagaagctatgagctctgtaacaccaccagtacccccttgaacccaaaacagactaggggagagttagggggcagggagagaaccagctgcagggaacaaagcagttcaggttatgggagaaaaagcaagatcagctgaggaaagctagaagggcaagtcgtcacaaaggggcaggggggcagcccagggcaccaaggggaaaactgcccccctctcttcatgacatttgttagggcttagggggaacagaattgagtcagccaccaccccccatgccagaacagacagggccctattgtctcagccaaaattccttctttcaaggaagaggaggctcattgtccagccctacacccagctctggcccacaaagctcaaaagcggcacaacgaatgcccaccctgaccctctgccccctcgtctagcctgggggtggcaggcgcattccacccatgaggctgaggcccaaaccactggagccctgagcttaaccccccagtcttggggactgggagaggaagagaattgtcttcagcaggaaagaacccgcagagaaccaggaacccacaaagaatgggcattgagagagagcggaaacaccaagggggtccccaccctagaccaggcatctgggcacccaggcctcaggctccrcccccaccctccttggggagccaggtcccctccacctggaaatgagccaagtcacactgaggaaatggaactttatttccataaatacagggataacacctattcaaaggtagttaaaagagggcctggggcctcaaagaaactaggctctcccaggggggtactccaacactgatcatagggactgggggatccccaaacctgagatgggcctcataggccacagatattccccaacactgacacttcaagaacggaactgtccccataggggagcctcakaaccccactctcatgggtagtccctcttaggagttgggagggctgatgtcaggggactttagagaaaaaagggaacatggggaggagagaagctaaaaatgtcctgagtggcctggaaggagacccctgtggtgggcagggggtgggttctccacccatacagccagatacggaggagyagcagcagcaaaagcagccacaagttaaaaacatggtttctcacttcccaacttcggccttgagagaaagggacagcacggagcaatcccccaaatgagaggacatgaggtsggggaggcctggaattgtcattcatggaggagcagaggaagggggttctgggaggccaagtctctactaaaaccccgtctctactaaaaatgggggataatatgggagcaatgaggtggtcacaggcacaccaaagcctgacatctgctttccaaggccaccacttggtctctggaccgaggagttcctggggacccctgaatatatcctcaggagagccaaggttcaatgcaggtctcataaagggtacggttggagtgccaggctgtgtgggagataccggccattggacacctcactatggccccccgggccaatagagtcttcaacccaaaagaatcccgcagataaaccttcaaggtggtcgaaggggcgtggaagyatggaagagagacacaaggagagacaaagtgagttactgctgggatcctggacctcctccccacagggtgaacccttcagctcaggagtcacagagagggctctggaataaggtgggacagcggctagaaggggaagtaatcccagggggctcaccagttgctcctccatctccaggacggtctcatttgcatcatagaaaccaaagaagctacaaagagatttgsggggaggttatcagaagagctggagaaaatctggccgggcgcagtggcacacgcctgtaattgcagcactttgggaggccaaggagggcaaatcacctgaggccaggagttcaagaccagcctgaccaaaatggtgaaaccccatctctactaaaaatacaaaaattagctgggcatggtggcagatgcctgcaagcccagctacccaagaggctgaggcaggataattacttgaacccgggaggtggaggttgcattgagtcgagatcgcaccactgcacttcagcctgggtgacagagcgggaccccatctcaaaaaggaaaggaaaggaaaaaggaaagaaaaaagaaaaggaaaaaagaaaggaagaaatcaaggtgggctaaggtcccaaaggaacccaaggcctactggggagacaggtagcagggaggacactcaaaactaccttactggatataatgtacttcatgaggtgatacactgaagatacgacctcacttctgtagaaaccccatcaaaaatgcattactggccgggcgaggtggctcacacctgtaatcccagcactttgggaggccaaggccggcggatcacctgaggtcgggagttcaagaccagcctggccaacgtggtgaaaccccatctctactaaaaatacaaaattagctgggcgtggtggctcaagcctgtaatcccagcactttgggaggccgaggagggtggatcatctgaggtcaggaattcgagaccagcctggccaacacggagaaaccctgtctctactaaaaatacaaaattagctgggcgtggtggrcgcctgtaatcccagctactcaggaggcagaggcaggagaattgcttgattctgggacgcaaaggttgcagtgagccgggatggcgccactgcactccagcctggcgacagagtgagactttgtctcaaaaaaaaaaaaaaaaraggccaggtgtggtggctcatgcctgtaatcccagcactttgggagaccaaggagggtggatcacctgaggtcaggagttcaagaccagcctggccaacatggagaaaccccgtctctactaaaaatacaaaattagttgggcatggtggtgggcgcctataatcccagctactcaggaggctaagacaggagaatcacttgaacctggcaggcggaggttgcagtgggccgagatttgccattgcactccagcctgggcaacaagagtgaaactccaactcaaacaaacaaacaaacaaaaagatactaaagagacgtaacaagatcatgcaactcaagatcctgatttggatcttccactgtatatttttttctgtaaggacagttggaaaaatttgaataatctgtgagcgcatattcaggaaaatttgaatctatgtttatatttaaatataacattaacgtatataaataaatgtatatatatttagagaaaaaagatattaatgtaaacatgacaaaatgttaacatttgcgaaatctaggtgaggagtataaatgactgctttttgctattttggtaacttttttttttttttttgagacagggtcttactctgtcacccaggcaggagtgcaatggtgagatctcggctcactgcagccttggcctcctaggctcaagcaattctcgtacctcagcctcccaagtagctgggactacaagggcacaccaccacgcccagctaatttttgtattttaggtaaagacagggttttgccatgttgcccaggctggtctcaaacccctgggctcatgcctcggcctcccaaagtgctaggattacaggcgcaaacttttcttaagtatgaaattatttcaaaatagaaaggtcttaaaatcctttttttcttttttttttgagacagagccttgctctgtcacccaggctggagtgcagtggcaccctgtcggctcattgcaacctccgcctcctggtttcaagttctcctgcctcagcctcctgagtagctggaactacaggcgtgcgccaccaggcccactaatttttgtrtttttagtagagatggggtttctcaatgttagccagctgttctcgaactcctgacctcaggtgatccacccgcctcggcttcccaaagtgctgggattataggcgtgagccaccgcacccagccagatggagttaaaatcttttaattaaaaaatattggccaggcaaggccgggtgcgtgggctcacgcctataatcctagcactttgggaggccgaggcgggtggatcacgaggtcaggagatcgaaaccatcctggctaacacagtgaaaccccgtctctactaaaaatacaaaaaaattagccgggcgtggtggcgggtgcctgtagtcccagcgactcaggaggctgaggcaggagaatggcgtgaacctgggaggcagagcttgcagtgagccgagatcacgccactgcactccagcctgggcgaccgagcgaagactccaactcaaaaaatatatatctatctatatatagagagagatatatattggccaggcgcagtggctcacgcctgtaatcccaacactttgggaggccgaagcaggcggatcacaaggtcaggagatcgagaccatcctggctaacacagtgaaaccccgtctctaccagaaatactaaaaattagccaggcatggtggtgggcacctgtagtcccagccacttgggaggtgaggcaggagaatggcttgaacccaggaggcggaggttgcagtgagccgagattgtgctattacactctagcctgggcgacaagaacaaaactctgtctcaaaaaaaaaaaaaaggaagaaacagtgacttggaacattaaaaatgttatataaccatgagctatcactgtcattcatagggttgtggtagatgtgaaatgacatgatgtacataaaactcatcacttactattatattattacaatattttaagagatgtcctgccttcactgaaaactgtccagtgccttcccatctcactcagaatttaaaaaaaaaaatcaaaagcctggttaccgggactgtcgggaaatagggatgaggatatatatatatatatatatattttttttttttttttttttttgagatggagtttcgctcttgttgcccaggctggagtgcaatggcgcaatctcagctcactgcaacctctgcctcccaggttcaagcgattctcctgcctcagcctcccaagtagctgggattacatgcatgcatcaccacacccagctagttttgtatttttagtacagacagggtttctccatgttggtcgggctagtctcgaactcccgacctcaggtgatccactgcctcggcctcccaaagtgctgggattacaggcgtgagccaccacacccagtctattttttaatgggtatacggtttcagtttggggaaaaagaagttctggagatggatggtgctgatgggtgatggttttacaatgatgtgagtatacttaatgccacaaaactgtacatttttaaatggttaaaatggcaattttatgttatgtatattttatcacaaaaaaaagaaaaaaaaatatcaagggccttaccttgacctgctaaggtttgacatgcctggtcccctgctaccacttttagctcctctcctgtcctctccccagctccttgtgcactagccatgctggcctccttattgctcacacgtgcttcagggcctctgcaggtgccagaccttctccctggggggttcttccacccagagcacaactccctccttcacttccttcagtctctaattgaatggtgacttttccaggaggacttcttcggccactattgaaactaggccccggacatcctctaatcctttcccctgccttattacctgacatatatatttgtatgtatgtatcagctatcttacaaactagaatataagctacataacattagggacttctcttttatttaccactgcatccctagggcccagaacaagcctgcgcccataatgttgaataaatatttgttgagcaattcaagtagctcaggtgacattacagatcacacatggtgacctataacacaggcaagcacatagtaccatggagccatggatttttttctaaggaataggatggaggggacaaagctggaggctgttataatagtccaggtaagtaaagaggtggtaggaaatgtgataaaatggtataaaactacacacacacattgaaccaatgtgaatttcctggttttgatactgtgctataattacataggatgcaaccactgggggaagctgggtgaagggcctcgctatactatctttgcaatttcctatgaatctataagaatttcaaaattaaaagtttttataaagtgggggagggggtgatagggatggagaggagaagagtcagcaggacttagtgactggcttgatacaaggggttgggatatgactcccaggttttggtcttgggtgacatgatgaatggggggaggagcactaactgaacagtggaaggagcaggccagtttaggcatgagataaagaccaactggggttgggggatgtctttagccaatcttcaggccacaaaatcccttattacctggactgccagggagtaataacaccatcatcagggcccccaatcagcaccaggtggcccacacgcagaaagttcttccgccatactgtaggatgggaagaagagaggctgagtcagccacaggggtcaggccaggttggagagggagacatagggagtcaaagaagcagaaaaagcaacacaggtaggagcctgaattctcacctgtggcattgggatggtctctttccccattgatcagggccaggaagctgctggcattgaggtacaagtcatcgtggtggggatctgggtacaaacagcagttagaaaaagaagcagaaaagggaggcaagactggtggtgaaaagcccaataaggaagctgcagcaatagtcaaggtggatagtaataaaatagtagtgataatgtaggccaggtgcggtggctcacacctgtaatcccagcactttgggaggtagaggcaggtggatcacttgaagtcgggagtttgagaccagcctggctaacatggcgaaaccctgtctctactaaaaatacaaaagttagccaggcgtggtggtgcatgcctgtaatcccagttactcggggcgctggaatcacttgaacccaggaggtggaggttacagtgagccgagactgcaccactgcactccatcctgggagacacagtgagactccatctcaaaataataatagtagtgataacaaccgtaaacatagtaacaagtacttttttttttttagatgaaatctcactccgtcacccaggctgaagtgcagtggcaggatctccgctcactgcaacatctgcctcccgggttcaagcaattctcctgactcagcatcctgagtagctgggattacaagcgtgtgcccacattcagctaaattttttttgtatttttagtagagatggggtttcaccatgttggccaggctggtctcgaacccgacctcaggtgatgcgcccacctccccctgccaagatattgggattacaggtgtgagccaccacacctggcaatagcaagtacttctatctagtatctactatatgagccaggtactattcaaagtacattgcattcatttatttatttaatccttacaaccacctggtgaagtacatgctataatattttacagataaggaaawctgagtaacagaatggttaagtaacttgcccaaaggcacccaatagggtcaagattcaaacccaagtattctggccccatggtctggtctagargttggcaaactgtgaccaaaggaccaaatccagcctgctacttgtttttgtaaatgaagttttactggaacacaggcacattcattcacatatggtacatggctgctttcacactacaacagcagaattgaggagttgtgaaacagactatatgtcctacaaagtcaaaaatatttactctctggccctttatagacaaggtttgctgactcccacatcagactaaaccttctaaggcaataaggtgacacacttaaaacattctgggccaggtgcaatggttcacacctgtaatcccagcactttgggaggccgaggcgagtggatcacctgaggtcaggagttcgagaccagcctggccaacatggcgaaactccatctctacttaaaatacaaaacttagccgggcatgatggcgcctgcctgtaatcccagctactagggggactgaggcaggaggatcacttgaacctgggaggcggaggttgcagtgagccgagatggtgcactgcactccagcctgggcaacagaacaagactccgtctcaaaaaaaaaaaaaattctgaacagagcctgttcaaataactcaataaatgtaagttatctttattgtcatcactgctattggttgtagcagaggtggaagcaactgacctgatccatggaagccccagttcagcatccccactcaccatgccagtagttgcagatggagaattcctggccccaggggctatagcagatccgatagaggttagaccgcatggaggtggggaacagccacttcaagtagtccgtgtctggcaagygaatggcaatgctaagtgaccataaacctctgttcccccaaaactcagggcattctatggagtctagtgcccactcacctccatactgtcccatctgtggagaggagagggagatgaaagaatccacgttgtgatcatccatgacagaaagcagagcccggcacacaaggccccctgtaagcagaacaccacattgggcaggcacttaaggacagcaaagccagcagcaccccccacccccaccacacacacacacacacacacacacacacacacacacagagacacacacagacacacactgtacacaaaggagactgaggcttacagaaggcaggcacaccctgtgccaaaaggtcacacatcatataagtgactgagcccgaattagatgctgggcctcctgcctctagttctaggatgtttttacctgccccattagcccttatgtccaagaaccatgggtaacaggaagcaaaagggcagcagtgtagggagcctccctcccattcaagacagagatgagacccaggtgctgagggaagtcagaaaggaagggctcaggtaccagggttgtgcctggagcaatgtggttcagaaaaagggacgctaggaagtgtccctcagataaggatcaagcctcagatagggcttaggagttaggggcaggggagtcgcctaccctgcgagtagcagatgagatgcaccccttgaggggcctttgccatgatggggaccacagcctctcggaacccttgcacctgttcccacaggggtcgcaagctctctctcccatcgaagagatcgagcactgtcaccacagtcccggggtgtgtctgtgggaagggggcaatgcagccaccggggataggctaagaagctcccacacgccaccccctggcccgcgtccacaggtctattgtaccctgctagaaccagggatcccgtcccccaactctcccccacgccagcaccagctccctgaggaactgggcaggcccagaggggtggctttcagttccccgctctccctcccctgccacagtagacgcctctaacgccctgcacccaggtgtcccctgccagacctcattgatgtattccagcaggtggcggaagctgtacgagctgtcgaagagcccatgcaccacgatgaccggcttgtaggackcgcggtggggcgcgggggctgcaagcagcagcagcggcaggaaaggcaacagaagcaggacccacgccgcggggagccgctgcccccagagccccagcatgctcccgcctgagaaaggggtgataagggcatgtgagggagatggcaacaccctcctccctcggaacagacgcccggcaatcaagccacctcctctcgctcccacaccaggtccgtgtcacaaaatagcctacttttaacttactccagccctctccctacaaacacacccccccaccacgttgacgcaccaacgcgcacccgaagtcccgcctccaactcagcgttcgggggacttgttctctaggtccaggatcttcctaatgcatcgcctcagccatgaacaacgcggagttctttaatacccgtgagcagcagcccaggccccttgaagagtgcagactcccacctggcctgggtccgtaggcctcgctccacccgctgtttacttatcccaagtctggaacccacggtggcggggggaagggtgaggaaagagagcgcaggggaatgacggatgggagggggaagggcgggctgcttggggtcgcgcaaatccgtcacgtccggggctttctctggcaaccgcgcgagcgttccccgcaacacagacccaggacaggaggggcaatggaatattccattgcgccctaggtgctggggaggaaacaggcggagcgatccatttaggccagtggggagaggaaaaagcagcaaacatattctgggaatggaaagaaggcctctccaggcttcgttgcccccagcgacccaaaagtccgatttccccgccttgattctccccacttcccaatacaggmgtctggctccgcagcagracacgaagtttgcattccccaaggggcggccagggggcggaccagggaaaggtagtcctctgcattttgccgtgtgctgggtgagtggcagggtggcctggagggctgatgccagcccgggcgtgcccctcaacacccaccccaccccaccctccagtccgccccaggtcagcgacttacaactcttcattctgaagtgcgtgtagtgcccttgtctccagagacgcagagagtcctcgaggccccttgagctaagtgcagcctggcccagtttctcctgccctactctactcccctccctataagcgacccaccctcaaggggcggagggcgcgtagggatgcgctgactcatgcccgcgtaatttcgaccagtctttcaacctgaacgacccccagaatctggctgtctgagttatctgtgggtggctccctaccgaaacccccaggcgccccacctctccgcctgtgacccctaaccgacaccctagtgcctcagggcttttacttgctagggcttttacttagcatttaaagacgtttctctagagataaggatttctcagcatgtctgagcccctctctctgtttacaaggtcattgcttggtctaaatttgtctcaatcaaaacatttttgcgctcagaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggacgtaagggaagaataatrattatctggctgtgtttttgtttaaaaaaaaaaaaaaactggtgtaaatctccatagacttcctatcctcgctcccttcacccacccacgcgctcccaagatgcaataagcaaataaaaagactaataacgctgtactgcaggtcgactcaggagctggagatgcgtcttggtgggaggtggtgggtgggagtaggggggtttagggaatggatctgaacattgaccagcccagagactctaagcagcctcaaaagcaaagggaaagtgggggaacaagcacacattaccaacagagctgccagaaatgagcagttaagtcataccccctaccccctccaaaagagcttcagctccttagtcctggacgaagaaggtatgtatgcacaccgcccaaactctctctcccttttccctccaaggcccagctccccctgatttacagacctgggcctccctctttactgctaggttggtaggttcaccaaaccctgggaacttttcagaccatcgcagttctgaactctgcacaattctctctcacacacaagtatttatctcttctaaagaggaggaaactggggccaaggatttgggagaagaccctggcaccttgcagggagctaagagggggagacgacctgcctctggaggcacctgggttattaactccactgagaacctgttcacttcctcccacaatacaatcactgagtcttggtgggggagactccagagagttctccttccttcctttccttagtcccacccgcctcgcctggtctagcctccgtgtttccatgacaactccaaaggagcccaaactgggggcttgaatgccggggtaagaggaggagagaggtggtccgagagcagagagagaccgagtgggaaacatctgaagcgctccccctccctcgcctcggtccctttaagctccccccctccccgctctccctccgcccgccccccccgccccccccccccgccgctgccttcatctctccatctctgcgctgctgccgctgcgccatccagcacccagactccagcaccggccgaggacccccactccggctgcagggaccctgtcccagcgagaccgcaggcatgtcatccgaaaagtcaggtaaaaacaataacaaaacctcccaccccctccactgtctccagactctccgtcccccttgccccaaccccctcccttacccctcctcagctgtggttctatttcattccccttctctccagctctcaacactcccccagtccccctcctctttctgtctccccctttctcttcctttcctctttccagtggcagcctctgccccttgccaacaacatggtcaggggggtaggttgagagggtgaaggaggtacagccaggttttgcagggatggcatcattgggagtgacagatggacaatcactggctggcatggagacatcctgtgaggaaatatggagacatgaccagatgggggttgtcaagggagcaaaatccagagggctcttcttaatctgccctaaaasaggtcccgagattctcacagaggctggggcactcctccccccactgaaggaacagcagagtggaacacatgtcatcccacatgtgtttatacaactgttgaattgagcacatattaacacagggttgcatgtctacgcatacgcacacacaggactagctcggataggccagcccaaaggcagctatagcaaaggagaggggattaggtctgcaggtgagagctgggtgcatggtgatgaaaaagacagaaaagaagcagaccagagttgtgacctcaaaactagattggaaggaagaaggaggggggcagatggcctagatacagcccctctcttgcccctcaaattagagatggtttctcacccgtctctctctatgtgtctctcccattatctttctccatccctgaccggctgtgtttccccttaccccctcctcaactcatcactgtgtcatctttcctcttatactctcctccactcacctcccccaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacggtgagtgccgggcagacagggacatgggaaagagggggacgcgatacaggacttgaaattggggatacgctgggggctggtaggatagaggaacaagggcagggaacaggtagtgttcccgggacaagccctagaaagaagggagcctgagacaggaaggactagggagagacacgggagtaggagtctactggtgcccagagtcagggcctgggagggggatcggagcctagaggttcagaggaggtctgaaagtaggaaaccgcctggcgggggacggggggaatggaagctgggaaccaagagggatgtgggagaagcctgggactaagggggtaggggaggcctggtaggtgtctggagggaagaaagaaggtctgacctgaggccaggacagccccagtgggaccataccttgcgggagagaatgtagaaagcccaagaatatggtggttaatgaagcaaggaagggaggagaggggcttargtggaatttatgggtgtcctggaagggtaatgggtgctttattttgagaagccataggtaaaaattgtgcttttaaagccactctgccagccgcccaacgctggtaggctgggagagggtcagagtgatgcccctgccccccaaatttccttccacagccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtagggggcaggggcatactcggtttgggggcggggacagggagttctgggcgttctggggaccatcttagagaaaggctgaggcgttcgaacgaggccgcagctctttgacctccttcccccacccctcctccgtaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttatcgcccgcaattccaaagactgcggccccgcaaagaccctccccacttttgattccgcctttcacttcccttcatctcctcttccaaggaaaaaaaaagaaaacccgacagagactaacgtgagggacacagattcccagatcgccagagagacacgtgaatatgggggacggaggggagctccctgggaatccaccaaggaagaccttggggtccattctcagtgaggctttattttcttagtgaggctttatttccccagtaccccttttccattccctactatccccagaactccaggaagacaagagaacagagagggcagaccatggtgaagaagctggtcaaggatagagtgatgggggccaagaagagatgccagctgcccatagctgttcctgactgtgggctggagggtggcagataacttggattagagccccacatgctggactgtagggggtataggaaaggcaaagagagcagattgctgtgggagcccagggaggaggtcaatggcctctcaagtctccctgggactagttgccctctcctatcctgaggtcaaccaataggcctcttttctgaggggagtggtgattaggggatgctgccagcagtgggcttgggtctttggttgtacacccacaggacagggtcctaacctaatttatgcatttatgcaacatgcagactccatgctggatgctggtgagacatccacccagacagcaggtgtgacccctgacctcatggagcttacaatctagaagggaagccatgcactgagataggaaatgtgataggagatgtgggaggagggtggggtgaggtgtgaatatcatgggttcgcccttggatgtttcgcatttaatgtgcctaccttaccaaacttcttgaaaaacagaattcacggctgggcacggtggctaacacctgtaattccagcactttgggaggccaaggcaggcggatcacttgaggtcaggagttcgggaccagcctggccaacatggtgaaaccccatctgtactaaaaataataaattagccgggcatggtgacgggcacctgcagtcccagctacttggaaggctgaggcaggagaatcgcttgaacttgggaggcggaggttgcagtgagccaagatcaagtcattgcactccagcctgggcaacaagagcgaaactccatctcaaaaaaaaaggggcaggggggtgcggaatattgctatcagagatatgtctgtatctgtctttttttcatacccactatttcttgacttattggaatatgcatccacaccctattctcctgaaacctccctctcaaatggcaaccaattacccagatcccaaatcaatggcattttcacagtattctgcctctctaagccctcccatgtttgtcccttgaccctgaattccccacatacccaggttcaagaacgtattacctcccttcccccgacacacacacagacctctaaccattccgcctctgccttccctccttgctttttctcctcccttcccctaagtgtccatctctgattttttttccttctctgagactttcctttgaaaagctcattcactcaactcagctaatcaaatgcttttccaacctgtattttacatgcagacgttttttccagtgcctgaagatcatagccacatggaagatgcttgctggtcctctaaaatcaacacattccaaaacaaactgatgaaatgccacagaaaacctgcttccctgtctctgttaatagaccattttcccaatcactcttccttatctagaaatttgccgcctcctccctctccctcctgccttatttttggtgtgctctcaagcctagtcagttctgccaccacaatgtcttttgaatctgtaatttttccccagcccttgctggaaaaattacctcattaggattattgcatcagctttcccaacaggtctccctacttcctacttctccctacctcaagtctccctccacactattgtcagatcagcctccctaaacacactttcataactccactgctcaaaagcccttcaaggttccctattgcctactcaattatttacaaaattttaatctggcctttaacaccttccataatttaaaatcatccagcttctctgttcattctaatttctaaccatactgaattactcatcattcccacctccaggtatttgcccagctgttcccaaatcttagacctccttcccaaatctctgcctattataaaccaaattgtttgcagcttgtcacaaatttcagaggctttagaccacatctaggctcttgctcatgatgttctccccctcttgacatctgcctctctacttggtcaaattttatttacaatatctttcaaagtccggatcaattcatccctcactgtagcaaaaaggtgtctctctttcctctgggttagattaaagcagtgggtttccaaacagagcttcaggcattccttggagcaacggttcttaccccaggttacacattagaatccactggggagcactgaaaaatctgaaagcccatgtcgcatcctaaaacaattaaatcagaatctctgggctcagtgccagtggctcacacctgtaatctcagcactctgggaagtcgaggcaggaggatcgtttaagcccaggagttcgagactagcctgggcaatatggtgagaccccatctctacaagaaagtttaaaaactagcctaggccagatcgagaccatcctggctaacatggtgaaaccgcgtctctactaaaaatacaaaaaaattagctgggtgtggtggcaggtgcctgtagtcccagctactcaggaggctgaggcaggagaacggcatgaacccgggaggtggagcttgcagtgagccgagatcgtgccatgcactccagcctgggcaacagagcgagactccgtctcaaaaaaaaaaaaaaaaaaaaaaaattagcctaggccgagcgcggtggctcacacatataatctcagcactttgggaggccgaggtgggtggatcacctgaggtcaggcgttcaagaccagcctggccaacgtggtgaaaccccgtctccactaaaactgcaaaaatcagccgggtatggtggcacatgcctgtaatcccagctactcaggaggctgaggcagaagaatcgcttgaacctaggaggcggaggttgcagtgagcccagattgcaccactgcactccagcctgggtggcagagaggcactcagtctcaaaaagaaaaagaaaaaaaaaatttagccgagccccatggctcacctgtagtcttagctacttgggagggtgagacgggaggattgcttgggcctgaggggcagaggcttcagtgatcagaacacggtgctccagcctgggcaacagagtgagaccctatctcaaaacaaacaaaaaagaatctctgggggtggaactctggcatcagtatttaagacataaccaggtgattccaaagggcagccaaggttgggaatcacaggtttacagacactttaaggaccacccagggagaatggaaaggccaaaaaatgacttcaacccgggcaattttctttaggagaaaagtatctagatctaagattcatgttatctgcatattttctcatctcttcccacctgatatcttgacatacacagtttaccttgtgagctacttgaaggcaagagtcaaatctggcttatctctgtttttcagatcctcatcagataaaacctcctctaccaatctttgaactcaattgaattgaaaggaatcaggcaaagggagagatgaataaaaaatgacttagctttcttttgcttttccttaggaatgtttgtttcttaatctcagatctcttaacctcacccagactcctccctcatgaggaaataaaatgttacaatgtgtggccgggcgcggtggctcactcctgtaatcctagcactttgggaggccgagatgggcggatcacgaggtcaggagatcaggaccatcctggctaacacggtgaaaccccatttccactaaaaatacaaaaaattagctgggtgtggtggcaggcacctgtagtcccagccacttgggaggctgaggcaagagaatggtgtgaatcccggaggcagagcttgcagtgagccgagattgtgccactgcactccagcctgggcaacagggcgagactccgtctcaaaaaaaaaaaaaagttacaatgtgatcctcttcctatctgactcacctccctctgcaggtgatacccttggctgtggcacctctactgacagagactccatcctctaggagaggctctgccctcccataacatctgtatgggtgctctcatacagatgggggaaaaccatgattagattctgggtcatcattccccctctacaatggaagattcagcacctgatcactctacttccaccgctcatttcattttcttctttttattatttatttatttatttttgagatggagttttgctcttctcgcccaggctggagtgcagtggcgcaatctcgtctcactgcaacctccgcctcctgagttcaatagattctcctgcctcagccttagtaggtgtgattacaggcatctgccaccacgcccagctaatttttgtatttttactagagacagggtttcaccatgttggccaggctggtcttgaactcctgatcttaggttatctgcctacctcggcctcccaaagtgctgggattacacacgtgagccaccgagcccagcctctttttcttttttcttttttttctgaggcagggtctcgctctgtcacccaggctggagtgcagcagcaggatcatagctcactgagcttcgatctcccggtctcaagtgatcctcccagctaattttttttatttttattttattttttttttttgagatggagtctggctctgtcgcccagactggagtgcagtggcacaatctcagctcactgcaaccttgcctcctggattcaagcaattctctgcctcagcctctgagtagctaggattacaggcgcctgccaccacgcccggataaattttgggtttttttttttttttttttgagacagagtctcaccctgtcgcctagcctggagtgcagtggtgcaatctcggctcactgcaagctctgcctcccgggttcatgccattctcccgcctcccacctcagcctcccaagtagctgggactacaggcacccgccaccatgcccagttaattttgtttttgtatttttagtagagacggggtttcaccgtgttagccaggatggtctcaatctcctgacctggtgatccgccctcctcaccctcccaaagtgctaggattacaggcttgaggcaccgcccctggcctgtttttttgttcgtttgtttttgttttttttggacggaattttgctcttgttgcccaagctggagtgcaatggtgccatctcagctcactgcaacctctgcctcccaggttcaagcgattctcctgcctcagcctcctgagtagctcggattaccggcgtgtgccaccatgcccggctaattttttgtatttttagtagaaatggggtttcaccatattggtcaggctggtctcaaactcttgacctcgtgatccacccgcctcggccttccaaagtgctgggattacaggcataaaccactgcgcctggcctctggcctttgatatttaatagagatgaggtcacactgtgttgcccaggacagtctcgaactcctgaattcacacaatctgcctgcctcagcctcccaaagtgccgggattataggcatgagctacagtgcctggccccgttttattatttttgttttcaatgttcatgcagattctctagcaccctgcccttctcttgcagtgatttatttctccctgcttccctctcgccctatgtcataccttcaacttggttgccaccaatacctactgcccttctaaaatct

SEQ ID NO: 10649 - DNA, 80239 bp, Homo sapiens
  misc_feature (1)...(80239): n = A,T,C or G, or insertion/deletion polymorphism (see Tables 1-2)
ttggagctagttactgggagtaagggagggtggggtgggggggagttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctggggtatatctgtgtctagcaacgatgtctcatggcgtgacagactagaggatacgcatccctggaatgtgagtcaacaggaaagatggggccccacgcccttcagggtgagcagcctctgggtctcctgctctcgagcaggttctccccctcttcttgctgtccaggatgagcagctcaaacaaacaacaagagctggggccagaggctcagagcccaggaagtgggggtctcggtgaagaaggggtgatatttggaagggaagggggatgtggcaggatatcctctaagccctaaactggaggggactgagacttgagagtccagatgaaagacaaagacaagagtggggcaggcagaaaaagctgtacattcttatgtttttaattttttttttttttttgagacggagtcttgctctctcacccaggctggagtgcagtggcgcgatcttggctcactgcaacctccgcctcttgggttcaagtgattcttctgcctcagcctctcaagtagctgggactacaggtgcacgccaccacacccggctaatttttgtatttttaatagagatagggtttcaccatattggccaggctgcccacttcggcctcccaaagtgctgggattacaggtgtgagccaccatgcctggctaggctgtgcattctaattaggaggaaggggagcaggacaaagtgagggattgagtctgaggccaacctggaagaatccccctccagctgctcctgttcagcagtgcctcaggcctgaccctgcaggagtgtcctgggtcagctggagggtgtgagctgggcctgggctcaatgcccagatgactggacaggggctgcctgggccataagcccaggcctgaaggagggaggaagaacctcatgtgtccagccaggcaacccccacacccctcccactgccctcacccattactgtgtttggggtgaaaacagaccaagtaactatggcaacctggaaccagggatcccaggaactagacctttcctccctccagagggcagcccagcttctcagctatgctttctatcccagagtccttgagccttatccaccgtatctctggagggggtgcagtgagaacaaggattttggaagcacatcacctaagctggattccctaccctgcctttcgttagtagatgtccttaaacattctgagccttagtttgcttatctgtaagatgggatgttcctacctcctaatcagggttgatgacaggatgaaagacgacgtcctcagtgcctggtccataatagatacaccttttcctcatcccttgcccctttctgtccccatctctgttgtccttctctcttccacttttatcccatttgggttcattactgtttcgttgtcccattgtcttcctccttcctgcccccagttcgggaaagtacttgaagtgctggcatctcaggggtcaccctggggtgggacatcctgctcctctgctgattggcaagggacagctggcactttggtgtggatgagacatcagacctctcttggctgagggattgtggtggcaggaaggattgagaaggacggtgagtgggtacctgatgcagggtgaaagccgggcaggctctgggctgctgccttctaggcccatgtggatctccattcctctggccacacccccaaggccactcagcatgccaggtcgctgtcactcctgcacctcattggcccctcctgccctatgcccactttgtctttctgttctgctttccttgtgccaccatctccttcatttcttcctcaggatcccaccttttgttctctctcatccctgacctcatcatccctcccttcctctttctagacttctttcctgcctttctttgctctctacctcattagcagttatcacaacctctttttgaaccattattcatcactgtttttttcttcttttgtatcttccccaccccatccactgcttcactgtcttaaattttttttttaatttaaaaatagaagtggggtctcgctatgttacccaggctggtcttgaactcctggcctcaagcagtcctcccatgttggcctcccaaagtgctaggattacaggcatgagccaccgtgctggccttatttaaaaatatatatatatttttaaattcactgtctttttcctttgtttttcttggtcttctcatctgctgctgctgctgaccctgtgcttgtctcctccctttctcatgccgccccctttctatttcccattctgctccctcgtccacatttcttgcccctttccattatgtcctctcttttcccccactttggtcctctcctcctccttccttcccccactccctttacttcccacaccagttctccatcctcttcccagctgtgggggccagcactggggagcctgatgtttgcctcatcgttctgctatggcttctggatacagcacatctggattccggggcccagatgtgtggttrccacagcgacctgggtccctctggtaaatacaggcgcccacccgcctcagagcagagaacaaaacaattgtgtgactttcttttgtcacgagatagaaatgtccttcctcctcccttctccccacacccatgtctctaggcaaaggaagttttaagggtccaaacccttccttctgaggctcccttgcccccttttcagctgtagcctcttagttctctcccatctttcatcctgcgctctgtctttacattctgtgttccccatcctcacccgacccccagttctcaataatggaatgttgaccacccccttccccatctgatgccatttcttctaagtgaatctacacaataactggatgcagaaaagtttcaaaaatctggattctccacccttctttgtacaagtgcttcaaagaagccacttcatttgttccctaagtcttcaatcctttcctttcctggagttgtttggggagaagagcgaatacaggcttaggaatgagaacacctgggtgagacccaccttcaccactactgacttagccccttgaacaagacccttaatgtctatgagcctccgtttcctcagccacaaagtgggattaatgcccgcactgtgtaggaaactgttttgtaaacggaagcccggcacaagtgttttctatctttcccctctctgggactgctttcttggaccgcagcccctggcatctcttgttcccctgtcttcatccttcaggtccttgccctcaattgcccttactcttatgtgtctgccttctctcctccctatctttcctttccttttctctatctttcatcccttttcctcctgaggtcaggacaggaacttggaggatcattcaaggagggaggctcagagctgaagacacagggactgaggttacagagaacagccggagcttgtggacagttctggacaacactgacctttctacccaccaccacccagacacctcagtgaagccaaccccagctctgaccactgggcttccctgccttcacgcctgggctccttaccctttccccctcctctctcccagtcctttcacatttcagtgttgacttgcatttattggtcacctacactgtgcaaggcttggtgcttttcttacaagatgtgaacatacaagacatgagcttctccatgagcctggaaaccaaagggtgaatcaaatggtaaacaaagataatttcagaacctgaaactatatctgctaagcttccagtggcttccccaaatgccttataagcttgtgtacatctggaatcccacatttctctctgagaccccaacagtgggcttccagaacatcccaggaccatccttcttgctgtcttctctgaggtccctggccactctctgtgccaaatgtacttatgttgaccattcttcctaaataataaagccaggacatagggcataggcacacgcgcgtgcacacacacactaaaggatatgaccatggaacagaaatctgaaggtgtcagaggaaattcataccctgtgttctgccctctgtgtgatactgtctccagaccctccctcttcctatcactgcagggctccccacctcctgccaggagatccttgggaagctgctacctactgctggctctgggggcttcaggccaaggcagaggaaggaagctgagcctggctctgtccaagatgctgacttcatcctccccatcaaagccaggaaaaaaacagccacacacacccagacacacggacacacacggggacacccacgcaaaagcccatgtgtgcctttgccctcggccacatggagcttactgggcatctggccacagccacatgcagtgcaggcacgccctgacccaggaacaccacacacctgccaccatggggatctgacctggtgtgcagacacctgggccgtcacccatgtggcagaatcaagcacatatgggctccctcacgtacctttcacccgtgacttggccaagttacacctcagtggtgaggtctgtagcaggatagagagacccagtcctcactgtgaagctgggggtagtgggttcccactcagctgggatatttctcctctgtagcaaagtctctttttcagctccttgtcagggcagcacatggggagatgaagctagggaaacacccaacagacttatgtggggtgtgtctgtctccctgtcccccctgtcctctggctgtcagtcttctgcctgggaccagagacagcgtgtccgtttcctccagcccctacctctccccgcctctgttcctgctcccccgcagcacccaggcaccagccccccaccctgctttccaccacttcaccctctattcaggtgacccacccttatatttgcctcctgtctctagccctttcttcaaccctaaaccttcctcctaaccttcaggctttccttccttgtccgccccaaccccagcttcctccccaaggcttgtatgtcccagtgttcacccaagcccttgccctgccagtgcccaagcctcacctgctctttctctagggacttgctgaggtaggagaatgcaaagggggcagtgacaggagagggactgaacagaacagacagcaggagtggctcggggacgggataagccgagaagatagaaatggtgggactggagcagggtggggacttggggtcccagagacggtcccagttggagaaagaggttgcctcttgcctcctgccctctgcccctgctccctgccccagactgccaggggagaactggtgagaggatgagggagccagcactgggtgatagacatggggtgcgatccagagatccaagctagagcagtggctgggaagagatgggagaggagcatgggggagggaggggaagggggctggccatgaggaaggatataggctgagaggaaaccactggggtcagagaggaggggcagcaggtggagaaatggtggggaaaaaagaaatggcaggaagggtgggggrtgtcaagttgggcaaaaattagggtgagctaaaaatggcatagggaaaggacgtgggaggtaagaccggggctgggggttgagatgagggtatggtgagacagtgatgctagacagggagtgggggctggggtgggggcaggagaagaggaggggtggcatgtggkagggcctgggaggggtgggaggacctgccctatctccgctcccctccctgacctcatcctggtcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccaggtaaggaacagagttctggggagacccagaaggagaggcaagggatttctcgcctatccccatgccccaggtgaaggtgtggcaggtgagctctcagcagtgcttccagagcaaggacttctgttcaggacagaggacataggagcattcgctgggaaccaggctccctgtgaaggagtgtctgggaggagagggtggtatgtgtgtgttggggtgggcagtatgtgtcagggtttggatgggatgcagacaactgagaggggctgggaacaaaccgagggactccgggagtcagatggtggaaccagggtagaggtggttattggtgaggtgagcccctgggccctggaggtgctggggctagcgggaagataggactaggctgaactggtggccagctgaaccttggaaggaaagtgcttgcggaatcccaaatgtcgggctagagcagctgagccyaggctctgggggctccaggctccaggaggtgccagagggtgcttctttgggcatccaaatggggactccctaggtggcagcgtgagagttgcagggagggaggtctgggagatctctttaggaaatactgaaatgggacagtcaggactcgggtctgggacgtgcacagagcctgcagagaggatcctaaaacttgttcttggccagagctctgcactcatgactcacggttcagcagggctgggatggmtgagagatgcctctgggggcacaggggctccgtcttcactctgtgccccttccaggctccccttgcctctgtctgtctgaacccgcactctccctcacctcgccgcccccgccccccaccaccagtacacgtgacacgccccgggtgggaagggcgggccccttatctcgcctggaaagaatttaatggcatagaaacaactggaagtggaactgagaggaactactgggaagcaactcggaaacaccacagctgctgcctgccctgcccctgcttcccgcatctccagcccctcctcttttccctgaccctgccttcaagtccctggggacccagcacctcaattcctcaaacttcctttgctcactccagacctagccactaggtgcaggaccagaaactgccttcctgtrtctcattgcacccctaaccattttcagctggggcctggaaatcctttctcttaatttttccattcccaggccgattagctccccagaataaggggtatctggattccccaacctacccctccctgacacctccttcctacctggttccagcccaatatctgagacccccacattccctttttagtctcactcctagaatccttctaccttcacctctcattgccagattcaactgagggtgtagcaggagggtcagagggaggcatgggggcnggaccagaacccccatctgtggaacatcttttatggaagccagcccctctccccaccccttgggacctatacagtccctaatgagcaaagtgtcaaagttggctacaacacaaaatacccaggaagctgagtcacagtttgggaagatgcccccatccctgccagccctccaactgtggggagggtgccaagagggtgaggccatatctctctccaaacacacactacagagaaccaccccagacatagtggcagggggaatggtgaaggggagacacaagagacacccaattctttgcttgcccagtaccgagagaagagcagaattatcccaggagctggaatggggagctggagggctgggtggtggcaacagggcagggagggagattgggaaggagcctctgggtgtgtggtcaatggaggctgctctgctcttctagaccaatctcaccagctttccagaaaagctggtgagctctcttcactccttcctggtgcaaagaccctctctgctttcccccactgtgcagggaaagatgaggaatccacttatttggggaggggcactggacaactcacagaggcctccaggggtacggggaagtatggtggaggccatgtgtccgctgcttcccactgggaagggcctcctgctttgttcctctcacaccatccaggttctttcactcacagagctgccctcggagccaacaagaaatcagccttcttaggcatcacccaatgactaggtgtggrggaaacctgaaggggagattgggtgtgtgtgcacgtgtgtgcatgggcacccatatgtgtacctacaaggatgcaggttttgggggtggatttgtgtgtctgtgcaggtatgtttgtacttgtggatgagcacacattaatatatttgtaagtgtacatgtgtacacatctttgtgcaagcattcccagggtgtgggagtgattagcatggccttagacacaaagtgacaggatttgagggtcggtcagagcccatctcttacccaaggctacactccaggctgagagaagggctggggagacaggaaagggcagctctctgtatgccaggcctctcggcctgggctttcttgggtggggagcctcttggtgtggaaacactctgtccctgttcagctccctttccgtctcttgctggctggtagcagaatgtgatggctggtagccccaattactcctttttctctgatccaggagaaaagtttaagagtagaaagccagaagatgtgtgcgtgttgggtggaggtgtgtgtgtgtcacagtcacctccgcctaccagtgacacatcccccactcctcaccggtcagcatttccacacccaccctgccctcctcctttccccagcctctggtctggaagagctgggcacctttcaacatctctcctcaactcttcaccctagctgaatcctgactggccccctcacactcaggtttgccatagccctgtctcctgtcttatcctgggacccccctaccacctttcctcccacctcttgtctctgtgtgctccccaatccctgcctcagtaaactccacaaacacatacaactgggtaaccgtcatccagatcaagaaacaagacacctttagcaccccagaagcccccccccccatgcccctactagtcactaccccctcaagagtatcacacttctgacttggagcactacagattaatgttgcctctcctcaaacttcacataaatagaactgtgcagcatgctctttcctgtgtctggcttttgttcaacatcatcttagtaagatccatcacactactgcatataactatagttcattcctgctttattttattccacggtgtgaataaaccacaatttatttattctactgatgtgaaatgtttgagtagttcccagtttggggctattatgagctatgttgggtatattcctaggagtggaattgcggggtcatagggtttgcatgtgttcacctttagtacatttagtagattctgtcaaacagttttccaaagtgcttgtaccatctggtcctgccaggatcttccctggcctggcctctgattctgcctcagccctggtggctgtgtctaaccaacttccagtcccagacactgtccgtggtcctagccctgaccttggtcctgcccttggttccagccttaatgctagtcctgcgtttacattgaacttttcattcattcatatagtcggtaaatatttattgagcaccagttatgtgccagatgcagggatacagcagccaagaaaaaaaaataggtgccatgcctgccctcatggactttatagtctagtgggcaagaaagtaataaaataatctcacagtatatttattattactttggacttcaaaaaaatatttgtttatatatgattgcaaattgttataaacgctacacatgagaatggcatgatgctgtgatatcacatgataggaggacctgacctggtcaggaaaacttccctgtgaaaaaaatggcgggctgagacctgaaggatgagaaggccaagagagaagggaacagtgttccacacggatggaacagagtatacaaagatctggggttggggatggrcacagagagtatgagggacttgaaggtcagtggagctggaatggagggagggagggaaatgttatgggtggtgaagtgggagcaggggatacatgatggtagggctgtttgtcagtgttctaagagaatttggaagggagacactgaagcattttgaggatagggacatcctgattgcgtttgtgagactgtagagggcaagagtggaagcagagggaagggtcagggctggacacagtggctcacgcctgtaatcccagcacattgggaggctagggtgggaggattgcttgagtccaagagttcaaggccagcccgagcaacatagaaagatcctgtctttgcaaaaaaaattaaaaattagctgagcgtgatggcacacacctgtagtcccaactactcaggaggctgaggtgggaggattgcttgagcaacaggaggtcaatgctgcagcgagctatgatcgcaccactgcacaccagcctaggtgacagagtgagaccctgtctcaaaaaaaaagaaaaaaaaagcagccaggaggcaattgcagttgtcaggcaagaggcggatggaagcttggattagaatgaaggtaagtgggagagaaggaaatgaattaaagagatgtttatgagaaaatacaggtagatacaaggaaatatggtagccttgaatgggctattaggtttctggcttgtaaagctggatgaatggtggggtcctgagcttcaatggggaattctgggaggggatgggatacaggaaggtgaccgtgagttcaggttacaggcatggtgaatttgaggtgcccaagtggagatgccaagtaggcaggtggatatattgctgtggagcgagaggaagatgactggggtgttttacaaattggtgtatagtttggaaattgaagttataagtctggatgaaggtaccaggtggatgactagagcagtaggtctattaatttagtagaaatttgttgcacattacaatcatctggggagcttttaaaaatactgagtaaaattcacttacttggtcgttctagtcacatctcaagtgttgcagagcctcatatccctcctggctaccatattggtcagcgtggatacagaatgttttaaaagagaagggccaggtgtggtggctcatgcctgtaaccccagcactttgggaggccgaggtgggcagatcacctgagctgaggagctcaagaccagcctggtcaagatggtgaaacctcgtctctactaaaaataaaaaattagctaggtgtggtagcgggtgcctgtagtcccagctactcgggaggctgaggcaggagaatcacttgaaccccaggaggcagaggttgcattgagccaagatcgtgccactgcactccagcctgggcgacagagtgagactccatctcaaaaaaaaaaaaaaaaaaaaagatgcggtgaactgtgtctagtgattttgagagaagtcaaaggtcaagcaagatgaagacaaatgtcccttagattttgtggcaccgaagtcattgggaagccctagagggagctgtttggtgggttggagggagtagagtggattgaggcatgcataggctataaggaaatgtaaacatcaaatacaaataaattttgacaactgtggccatgaagtagaggagagaaatatgtggtggctggagsgggtgtgagattggggataggttttttaaggtttcatttttttttttttttgagatggagtctcgctctgttgcccaggctggagtgcagtggcacaatctcaactcactgcaacctttgcctcccaggttcaagcgattctcccgcctcagcctcccaagtagctgggattacaggcacctgccaccatgcccagctaatttttttttattttttatttttagtagagacggggtttcaccatgatcgccaggctggttttgaactcctgacctcaagtgatccgcctaccttggcctcccaaagtactgagattacaggcatgagccaccacacccagccatggttcaatttttatacagcaaaatgccaaagtcttaagtgtgcagctcaatgagtttttgaatatgtatatatctatgtaaccacccagattaagatacaaaatatttccagaaatatgactccttccggtcaataatccctacaagtaatctgatcctatcttctaaaagcaaagattaactctgcctgtttttgtttgtttttttgtttgttttttgacatagagtcttgatctgttgccaggctggagtgcagtggcattatcttggttcactgcaacctccgcctctgggattcaagcaattcttttgccttagcctcccaggtagctgggactacaggtgtgtgccaccatgcccagctaatttttgtatttttagtagagacagggtttcaccgtgttggccaggatggtctccatctcttgacctcgtgatccgcccgcctcggcttcccaaagtgccgggattacaggcatgagccactgcacccagcctctgcctgtttttgaacctcatataaacggcattattcagagtgttttcttttttcttttttctttttttggtagctcaggaagggtatataagagtataagagcattctctttctgtgtgtgatattttttactcagcactatgtgtgtgaaattcacccatgttgcatgtagcaatagggtgttttttattgctgtatagtattccattgtatgactctggcacaatttatttatccactttatgaatggacacttgagttgctttcagttttagctaatataggaataaatctcatgaacattatggtctacgtcttttggaagaactatgcagtcattcccaccggatatttagttatagatatctgggttatagactatatgttttagcagatactaccaaacaactttccagtgtttgcattaatatatgctcccacttgcaacagatgacaattccagctgcttcacattcttgccaatatcaagcaatgacagcctctttgaagagggacaagcattctggaggatatttagtggcatcttattgtggttttaacgtacatttacccgataactagtgattttgtgcatcttttaaaatgctgcttggatctgggtgcagtggctcacacctgtaagcccaactactgtggagggtgaggcaggaggattgcttgaggccaggagttcaaggccagcctgggcaacacagcaagatcccatctctacaaaaaatttaaaaattagccaggcatggtgatgcccatctgtagttccagctactctggaggctgaggcaggaggatcacttgagcccaggagtttgaggctgcagtgagctgtgattgtgccactgtgcttcagcctgggtgacagaggtagagtttatcttaaaataaaatgaaatagggtgggtgtggtggcccatgcctgtaatcctaataactttgggaggccaaggcagatcacttgaggtcaggagtttgagaccagcctggccaacttggtgaaaccctgtctctactaaaaaaaaaaaaaaaaaaaaggctgggtgcggtggctcacgcctgtaatcccagcactgtgggaggccaaggtgggcggatcacgaggtcaggagatcgagaccatcctggctaacacggtgaaacctcatctctactaaaaatacaaaaaaatgagccaagtatggtggtgggcgcctgtagtcccagctactcaggaggctgaggcaggagaatggcatgaacctggtaggcagagcttgcagtgagccaagacgcaccactgcactccagcctgggcgaaagagcaagactccatctctacaaaaaaaatgagctgggcatgtggcgcatgcctgtatcctagctactccagaggctgaggtaggagaatcacttgagcccaggtaaaataaataaaatgtttattggctctttggctatattcttttctggagtacctgtttgtcttttgacaatttaaaaaactaggtttcctgattttggcttattttgttttgcagagatttttttttttttttttttttttttgagatggagtttcactcttcctctcaggctgaagtgaagtggcatgatctcagctcactgcaacctccgcctccagtttcaagcgattctcctcctcagcctcccgagtagctgggactacaggtgcccgctaccacgcccagctaatttttgtatttttagtagagatggggtttcaccatgttggccaggctggtcttgaactcttgacctcatgatccgcccacttcagcctcccaaagtgctgggatttcaggtgtgaaccaccacacccagctgccttcttattctcttaatgatgtaatttgatgacctgaaattttgttttgtttttttctttttcttttttttgaaacagagtatcagctctgttgcccaggctggagtgcagtggcatgatcacagctcaccacagcctcgacctcccagactcaagtaatcctcccacctcagcccctgagtagctgggactacaggtgtaccaccacgcccagtgaattctttttgttttttgtagagacagagtctcactatcttacccaggctggtctccaactcctgggctcatgcaatcctcacacttaagcctcctgaagtgctgggattacagatacgagccactgcacccggcctatggttaggttttgtgtgtgttttacttaagaaatcttgcggctgggtgcagtgactcaagcctgtaatcctagcactttgggaagccgaggcgggcggattgcctgagttcaggagtttgagaccagcctggccaacatagtgaagccccgtctctactaaaaatacaaaaaatagctgggtgtgggagcagatgcctgtaatccccgctactcaggaggctgaggtaggagaatcacttgaacctgggagacggaggttgcagtgagccgagatagcaccagtgtactccactctgggcgacagagcaagactcagtcttaaaaaaaaaaaaaaagaaatcttgcttactccaaggtcagaaattttctgtaagatattgctatgaaagatattgctttacttttcttatttaggtcctgggttcatctcaaattaatttcggtatatcagacataaggtggagaatgactgtttttttttttttttttttttttttacttagggatgttggattgacccagcaccaggaactaaaaagaccatcctttctcctcttaactgcaggggcacttttgtcgttaattagttgaccacatatgtgtgggcctgtttctgggccctattctgtttcatctgtctatccttgcacctttaaaataagtcttgatatttgatcatgtaagtcctgaggaagaggatttttgttttttttttttcaattggagatatttgagcaaggatccagttgagagtgaggagttgaataaaaaagagagagaagcsaagcatggtggctcatgcttttaatcccagctacctgggaggctgaggtgggaggatggcttgagcccaggagttcaagtccagcttcaaccagggggttgagcaagatcctgtctctatattagaaagaggtcgtgcggtgactcatgcctgtaatcccagcactttgggaggccaaggcgggcacatcacttgtggtcaggagttcgagaccagcctgcctacatggtgaaacctcatttctactaaaaatacaaaaattagctgggcatggaggtgggcacctataatcccagctactcaggaggccgaggcaggaaaatcacttgagctaggagacagaggttgcagtgagccgagatcgcaccactgcactccagcctgggcgacagagtaagattccatctcaaaaaaaaaaaaaagtgagagagagagggagaagataatctgcacttttcttagaagacagtaggagctgggatccaggtgtttggggaaggattggccctaggtactcatccactaattcattcaacattgatgtgtcagatagaacatttatgtgccagacacaagtatacagcagtcctgggatagatgaggtccttgttctcatggagctcccattgtagcattgagagaaaggtaataagtaaactgataactcagrcagcagtaaatgccatgaagaacaggaacaggatattgtgatagagagtaatggaagactgccctaactgggagttaagatttgaagatggagccagcctttatgagcagagtgaagagcatcccagacatagggaacacacaatgcaaaggcccttggagtagtgagagcttgtagtgctcgtgggaaaaacaaaagaccagtgtagagccgggtgcggtggctcatgcctgtaatcccagcactttgggaggctgaggcgagcagatcacctgaggttaggagtctgagaccagcctgaccgacatggagaaacccggtctctactaaaagtacaaaattagccaggcatggtggggcatgcctgtaatcccagctactcaggaggctgaggcaggagaatcgcttggacctgggaggcggaggttgtggtgagctgagatcgcaccactgcactccagcctgggcaataagagtgaaactccgtctcaaacaaacaaacaaaacaaaacaaaacaaaacaaaacaaaaaaaccagtgtaggrgaacacaatagaaaagggggtgaggagcagggtaaataaatgatatcagagaggtagagaacagacttgcccagggagggtatcctttagggttgggcggaatgtgaatttttacatgcatgtgagttgggtagattacttgtgggtggtgggaccgtgggtatgtgctggagaaggggggattcattttgtctcctttttgaagctgctctcatacctaccctttctccctgcagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtgagcaggtgatcacagaagagggtggagaggtggggtggggtgggcattgctagtccataaaggtccttggtatgaattagaagaaggcactccttcctcaccatgaggggtgtggatgcagcccagaacacaacttggagagcagagctgggctacatgtcaaccaaagcatatgcgagggccctgagaggctgcatacattacacatactagcaactgggagcagacatggccttatgagatgaggctagcctggctaggggcctgcacataggagcactacataggctcagcctctctcccaggagagagactgagacttgcctctcccctcctactccaggtcagacagatgtgcggaccctctgcagtctccatggtgtgtttgatctgagccgctgcacctgttcctgtgagccaggctggggtgggcccacctgctcagaccccacagatrctgagatccctccctcttccccaccctcagcctcggggtcctgcccagatgactgcaatgatcagggtcgctgtgtccgtggtcgttgcrtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacnctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccnctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggayggctactctggcgaggattgcggtgtgaggcagtgcccgaatgactgcagccagcacggcgtgtgccaggacggtgtgtgcatctgttgggaaggctacgtgrgtgaggactgcagcatccgcacctgcccctccaactgccacgggaggggccgctgtgaggaagggcgctgcctgtgcgacccaggctacaccggccctacctgtgccacccrcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaaggtgagcaggcagccttccccagtgtactctgggactgtgattctgtgaacaggagccatggggaagacctgagcctgaggaagagtggagggagagcatgtcattccaaggagccagtgcccaccaggggcagcagaaccacaggggtggggctttccagtgggcaggactggccttcagatctctgaggagcaggttggggcccatttagttgcatttagggagattctgtgctcctgaagatggagagaaggtgaaggcgatccaagccccgttcagccctctgtcagctattctccactagcagagaggagtgggagttaggatgggcctcttcgatgtccctgagtaaaaggggctgtgggtgggggtggttgccttgtgctaaccagctttccctaacccattctcttgggcagaggtgccaaccattgagggcatgaggatgcatctcttggaggagacaacagttcggacagagtggaccccggctcctggccccgtggatgcctatgaaattcagttcatccccacggtgagagagatgccaggctccaggaggggactgagtgggcaggacaggggggcagggctcacctcctggaggaagttccaggtgatcattggttgagtccagatggctgggtacctgaagctgctgtaaaggctttcttagcctgcttgacactgggcactgaggnctctgcagcatctccagcaagcattggtcccacacagttggaacacctggtaacagagagctcagtacttcctgaggctgtccagtccattgttggtcatcactgttagctgttatcattgttgcagaatccgtctgcccctattctagcacctgtccgttggccctagctgggtattcatcagcagctggaatgttttttgctttccctgtgtcctacaccacaggccttcaggtatttggagacaccagcctgatgtcttcattcctcaggcaaaacctcccagtttcttcgccccttttccctmagtctttattctctgaatcctttaccttcctgtgattcttgcttttttcatgtgcccccaaaatgtggggacagagaggggcccactgacttactctgaatttatggacacttttctcagagctggcgtatagcaatttgtagtcacacaagcaggcagctgttttggtcatatttggttttttaagtaacttttaattataaaagtaatataggccccgtgcagaaaacttagaaaatacagattagcagggaaaaaagatggaaggaaagaagacaacattcaactatatacacttttttttttttcacctaaatataggcctttgcatttggccctgttcaatgttatcttttttggtttgggccaagctgtctaggctgttgcaataattttgagtctgtgaacttcatctcccacctccttgtcatcagtacatgcaaaccagttttttctctgtctccctccaacttgctctttttttttttttttttttttttttttttgagacagagagtctcactctgtggcccaggctcgagtgcagtggtgccatctcagctcactgcaacctctgcatcccaggcttaggtcatcctcttacctcagcctcccaagtagctgggactacaggtgtgcaccaccttagcctgctaatgtttgtatttttagtagagacggggtttctccatgttgcatgcccaggctggtcctgaactcctgggctcaagtgatctgcccgcctcagcctcccaaagtgctgggattacaggcatgagccaccactcctggccatccaacttgctcttaaaacattagagggaacaccctaaggacaaagccttgtggtcacttatttggggcctccctttgtgcagactgggcttttaagatatggtcgtttccccagctgcaaatcttctgacatttctaccatccaactcatgttttcctgcatcatcccacaaatgccatatggggtgtgggccatgtcatcctcatcttcatcagcttagccaggactctgtaaaaataaacaactccctgggcctaaagcctcggaaggcactaggacagaaggggacagctcagaggaactgtcatcctcactccactttgctttgtcttgtcattatgctcctcaggccagccccctactatgttctgcctctcctcactctccagccaaagcagaagcagaaatctcaacttcgtggcgcaaccaagatagcttgaattttttcttctgtttaaacatctttttttgttgttgttataaaaatactttaatcacgagacaagaatttggcaactagagaaaagaaaaacaattcctggctgctcctcactaaaacaagcactgctaacattttaaagtgtttctcccactctcttcttctctgtatatattatttacatagctctaatcttgaaagggtgggacttcgaaaaggaagtttcttaagaaatttcagggaaagaagaattaaaataaacacttgagataagaggagcttttagggcagcagttgtctcctgctctgagtaaataaatacaaaccgytccttggtgttgtcaagggcgccgctttccagttgaagccctagactttctccctcactcagagccaggatggtggtgccaagttggcctgtgccaggcttggccatgttcttagctcatccattctgctctcggtatgggcatctgtcacattctgggtcttctctgagcctgggtgtggaaaacactcctgtaaaattggtccccagacactcctcttgggcctgggctacccaccctcagaccatgctttctgctgtctgtagctggtccctggcatcgtaccttctgccttggcaagtgccatctatttcttttcttttctttctttcttttttttttttttgagacagagttttgctcttgttgctcaggctggagtgcaatggcgcaatctcggctcactgcaacctctgcttcccaggttcaaacgattctcctgcctcagcctcccaagtagctgggattacagacacctgccacaatgcccagctaccctttgtccatttctgtgggtacagagtatattcaatagctgtctgtcctctggctgctgctgtcatcctagaagcctatctctacctcttaccttccctcttcscagaagcacttctctctcaaagcccaaactctgctattccagatcaagggacatacctagttattggaattatttttcagaatgcagaagaagaaagtttctcctctccctgtatatgtggcactgttactctgactcagtggttctcaaagtgtgttccctggacctgcagcatcagcatcacctgggagtatgttaggcatgcaaattgtcagactcccccactagatctactgagtcagaaagtctgggcacagagcccagtaacctgtattgcaacaagccctccaggtgattctgatgcccctccagcctgaggccccctaagtgaaggaatgttgctatyttgcaaagtgctagctccactatgaatgtgagagaaagcatggggaaactgagggagatgagttcctgaatgagaaagaggttcagatattccttgtctgggtgtgtcctgcagcctggaaatcagggctaggctaagtgttcactgggactcaaaacctcacagcctcagagaagtttttgcttgggtctagtctaaaaacagcaatgagggtgagataagctccaaggaccagccaaggtagagttcatctggagccacgaggttaatattgagataaactctaaaacttcccaagaacaaaatcagtgaagcaggccaggcgcagtggctcatgcctgtaatcccagcactttgggaggccaaagtgggtggatcatctgaggtcaggagtttgagaacagcctgaccaacatagtgaaaccccatctctactaaaaatacaaaattagctgagcatggtggtrtatgcctgtaatcccagctacttgggaggctaaggaagaatcccttgaatcttggaggcggaggttgtagtgagctgagatcgtgccattgcactccagcctgggagacaagagcgaaattccgtctcaaaaaaaaaaaaaatcagtgaagcagccaagctttaccaaggggcagagccagctgccagcatctgtttagaaagactgcttcagggccaggtgtggtggctcacgcctgtaatcccagcactttgggaggctgaggtgggtggatcacctgaggtcgggagttcgagaccagcctgaccaacatggagaaaccccgtctctactaaaaatacaaaattagccggacatggtggcgcatgcctgtaatcccagctactcgggaggctgaggcaggagaatcgcttgaacccgggaggcggagctcgcgatgagctgagatcgcgccattgcactccagcctgggcaacaagagcaaaactccctctcaaaaaaagaaaaaagaaagcctgcttcagaccagtaagatggtgctaggagacgtaggagacatgggttaggttgatggactttcaggggactgttcccagatggatctcaggaggaaccaagaagtgtctaaaggatatatatagggagaaggagaactctggggataggcttgcctcactgaaagaaccagacatcatcagggagcatccaaggtgtgtgtattgcggctgtggggatggggtgggtgtggataaagagaaagagacatacacacacacagagaaaatgaacaaataaattctgggaagggtaaggatttcatgggtcttgagttgaggccaacccaaggcttcctaggctggggtattctaaggcagggtgaataggagagggctggaggtcctatgtgcccaggaaaacttttcaacccagaaaactgacaaagctttacttcatcctcaacccagaaatctctacgtggccttctcatctggttttatacttcggtatttactatgttgatttccccacagttctcttggtttaggagagtaccttttgaaatttccaatcctacttggctgaatggaggtgtccccatcacagccaacatagctaggcagaacacagcatccttagcggctgtcctagctggacagcacagcaaaatgtggggctgttagaatgctcacagatgtacagttcctcctgtttccccagtggtgggcattccaggagaccctgcctggagcagggtccagtagattccctttggaggcaccacacataatcataattccttaaatgtacacttgtaggagtgttgttttctcacaagcatttgctaagcatagagattgttgtaagtatctcatatattcaagatgtggccatacatttagctattagagtctcagctacctgaggacagggaccatatattttatttttgtgtctccaatgcccagcatgatgccaggtacaaaatcaacaatcaggaaacatatttgtggaactttgagcaggtggttcttgttttgaggagcctacaacccgggtgaagagacaagaaaagtccctcaagggaaaggttgtgatgcgggtcccactcctgttacacagccatgagcaggcatctacgaggaggttcagggtgaggcagaccctttaaggagaaagtgcaacttgaaggggcatccttgatctacttcatttgttctgacaggaccaagcttaggaaaaggctcctcatgcccaggtagtcagagttgccarggcaaagctggagggagagtcctggtgcatgttgggtggaattctggcagatgaacacggggtgcccatgagaggggactctgacagataaatagggggtgcccatgagaggggactctgggatcacactgctagggcctaaattcttgccattttcttggtgttggtgacgttggcaagatacttgtccttctgtgtctcagtttccttatctgtaaaatgggactaataggacctgtttcgtagggttgttgtgagaattaagtgagttcatgtgtgtacctcgcctagaacagtggctcacaaggagttagcgctctcagcatgtttgctccccagcttgtacagggtcaagttccacacagtaccatgctgacactgtttagaattggagaaagaagagataagggggattgagcagcagaggcaagagtgccagcccctgagccacctggtgctctctctcacagacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccagtgagagctggggctgtggggaggggtgtcctgagtggagatctggactagagagggaatctgccctccgggagggcagaaggaaggggctgsatgggggctrggctcttggaaggaaagatgatgattgaagaaccagacacccacctgagtcctcctctttaacctggctagtgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagctkctgtcagggccaacacaggtatggctggccagaggttagggaagggccctggtttcccagccttggatcctcctcctcaggagcccaggctcagggctcacagactcctctgaatgcttctggcaggtgtgtggcagtctcgaggcacctgctgggggccttgctctgtcctgaggccactggggagacagagccctcagatgcctggagtcctgtaggaaggttacaggttagcctatgaaaggaatggccccagggagagaagtgaataggagatgctgcctgatccagtcagttaagggaggttcttttttaaatttaggtaccgggacaggccttgtgctgatagatcttgtgggactggaattaggcagattagagatcatcagtcctgttgacttttggattgggattgctgggaggtgggtctcacagcagtgattttccactaaacctcgaggtttcttaacagatacctggatatttttcttttcctgtgacagggggacacccacctcgctgtagctcatgttctcttccccgactcccctttctctccttcagctacagggccccacccacgggcttctctcttctttctagggcaccaacagtggtgggcttggaggggaatgggggggctgcgggacactgaccgatttccctccgttctctttccaggtggggctggggcacagggaagaggcctctggctctggtgggagggatcgagggaggggctgccgcgggaaggagtgccgggagggagctgccactgacctgttctccccttttttgcccctggcagcaccaggccactacagttacccggaggtgcgccccccagccccgccccccaagtcccggccccggccagccccagccccgcggcccccacggcccccttggccctcgaggccagcagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcgtctgttggccgccgccccagccggctcccccgcacccccgccccgccacccccgccccaccgccagccctgatcccggcaccaggaaacgggactccaaccagggaatctacggcctctcgcctgaaggcgtcgaccgggtggctgcgtcccgccaccccaagccagaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggtagtgtgggctggggccacgggacacctatcccttgtccagcctcacctgccgttggagcctgcattcatgaattcctcccactgccaccccycactgcccccttctaccttcaggccctacctggccggggctccagggggsccccaggacaaagcacgagtccattgtccctagaagacgtccccaccccagggtcctggcatccatcctgtggatgcctaaggtcaaggcagcgccttctttggggtttcccgggacacttccaggattgttattttaggcaatagagggtgatgtggttggggcacctgcaaagattcactggagcagtttgagtgggctgggaattgaaaacagtgattcccgttctgactcactgtggtgagagtggctgaagactgtggttagtggttactgttttccacaatttggccttgaccttgaagggacacatcagaactgcgtgggggtggcctgggtgccatcaggcagcaactgtatattggggaggtgaaaccactgcttcttaagctggcttttcagaccccctggctcactttatgctggtctctcccacaggaacgatgtctgggcttggggaaagggcaccctgtggctgctgtggggagggtggtggacctcttcttcccccatagggcccagatgccacctgacytggatgtccacccccacaccctctctctcttcccactgcccactctcctcttgcatcctccctctctaacaccactgtctttcttccaggcttctcactgcagcactaatggaagccacctgaccaccacccagtgggggggatgtatgtggggagggacatggaagtctccgggggctggaggtcatggaagccttgtggggtgaaggatagcaggctttattttacctattacctgcctgaagcacaggcccgtctgctcaggaatgtggtagatgggggtgtttggaggattggctgacctttgggaggagggagtggcccaggtgagggaaccagaagtagaagtagaacaaggctcttagaggctggagggcagaacctggggactggggattcctttctagttctcatactggactctcctctttttctcaccctgccccttcccagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatgggtacatcttggactctgctcagatcaatatcctgagattgggggaggagctggggttattgggacttcagaggtaggatggatattgaggggccagtgaagggcagggctgatgtttggggctggatagaggagaaaaggagagaaaaggaattgcaggttcagcaggaagatggatcgagggggatcttaaaacaatgataaggatgggtggggagaggggaaagaggcagaggtaaaaaggccgagggtgggacagagattccaggagagaggctgaaggtccctggccctccacctgcagctttccttgccctgtcccctgcccccactcttcggttgctcctctgcccttccctgccctataaatctttcagggtgggcatgggaaggcctctggacactgaccctcagcccccaatacctcgtccctgggagcctggtttgcagtggacagcagtccatggtcccatcagccagtttctgctgggggtgaaggctccttggggcagggggctccacagccatcaggacttcagacatgratgaggtttgcaggaccagtgaaagacaggtcctggggtacctggctttcacatcccctctttgttcctctctgtgggaccaggrtggctgactcatcccccagctccaggtcaagctcaccactggaagagagggtggtaagagagacagcagctcaggtgggcagaggagctttcagactgctctgatgctgcagcagggaggcttgaaactctcattcagaaccagggggacctgaaacccccgcaaagatcctggtgtgcagagagaccaagaccttgtgagggatggagaaactgtcacaagggaagaagcagagattgagagggaaatgcccctcttccagaagagctagtcactgaggggtgggcagatagagtcttccggggagggatctatccaggatggagtgaggtgggcaggggagagggaaggagacacagacaagagaacggttgagtccactatgctttgcttttgcctctcaaactccagacaaggatgaggagaagcctgggaagtcctcaggcccaccacrcctgggtgagctgacggtgacagacaggacctccgactccttgctcctgcgctggacggtccccgagggcgagtttgactmcttcgtgatccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatctgtgagtgacagcagtaacaccctgccctctgtactgccctgaagaggttttctcagtgctttgggaacctgctttgggagctccgggaaggcttcctggaggcagtggtgcatgagctgaattctgaagggaaagtagtggtggggcaggcaaagagtttgagaagctcagtgcagcctgagggagtcacggtgagtaaggtggggagagcatggccagtaagagaatcactgttacagtttcctctggctggagaacagggcatgtggggggtgccaaagggcctggtctcagggcttcctgtgctgtgctgaggggcttgggcctcattcgaaggcccctagagggcctctgaagggtaaagtgggagagtgatgagactagatatttatcttgcaaataaccgggtggctgctgagactagctggagaagtgagttaagagctggtaaaggctagcagggttgatcctgcctataatcccagcaccttgggaggccaaggcaggaggatcgcttgaggctaggagtttgagaccaacctggcaacatagtgagaccccccatctctactataacaaaagatattagccaggcgtggtggtgcgtgcctgtagtcccagctacttgagaggcttgaggtgggaggatcgcttgagcccaggagaccgaggctgcagagagccatgattgtgccactgtactccagcctgggtgctatccacactctgcacagagcaacaccctgtctcaaaaaaaagaaaaatgatgatgggtcagctgggatggtggcagtggggctggatgggggaggcgaaggaaagcaaggtgtaccaggcagcccccagggttctggatgagacagtcccattccctgaggcagggagcagcagaggtggggaacaacgccttagataaacttagatcaatatctaagagacacttacataaataccttttgtgcatttattgagagtcagttgtgatcaagatgttctctaagtggatcatcacaccccataaagcacacctgggaggcatgcctactttataggtcaggagaattgaggcaccagagtagtcgtgtggggttggggaagagacagggccactggaaccctgtcgacagcctacactcacagcggaggcagaggaagaagagcccacagggtagcttgcggagtgacttgcagggaggggcagaaccagggagggtgctgtctggactccaggaaggagggtgcggttggacttgtcagattccggaacagtgattcaagggctacggagcgtccacagaatttagcaatggcaaggccacccctggcctgcatgagagctgctgcctggtggaggggtggagctggatcgggagggtggtggaggtgaggacatggctgcaatcagtgtagacatcactttctggaatctggnctgggaatgagagcaaagagggaagatggaggctagagagagatgcacacagagtgggggtgaggaggggtgtgacagtagcttgttgaaatgctgatggcacagctgctggggagtgaagggtcagtgctgcaggcgagggagtccatccatgggtcaaagttcccaaagaggaggagaggcctgcagcatagatgagggaggctgtcccacattaaaacgcttcaaggattgtgctctcctctcttggagaagaagccagctagtagttaggcttggaagcagtggaggttgtactgggaagatttccctggctatggagatgtgaaagggcctggctgggctcccctctttctgaagctccctgctgctctggtttgtggttggaggcagagccacactagtccacgcagtgcttccatgccgtttgaaagaaggcacccattccttaaagtggacaccactcctcaccagggcacacagctcggcaagcagagtgctggctggatttcagtccctctgtactccctcagcaaatgcacttttgtgcagtgaacaacctgcacagcctcacacagcattcctatgtgggatttggcttccccattctccttggacctaagtctctcccttctctctacccactcttcctagtgcctcagagtgacccaagtccagggactccaccccncctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactggtgagtagcagccacctcagcccccatgtgaccccttctcagccccatgcacacttcccttcagcccaaaaccagctggggtcccccagcaagacagctgactccagcttcccggccccactccagggctgaggggcagccagactcccccgcactgctgggccccttccatcccaagcagcagctccccgtggcccagaaggtgtgtcataccctggctgtgtcaggcttcccagaagtttagcactcgaattaatggactagtgaccccccaccccccataggtgtgacatcccgtcgaaaccccaagccccagtcccaggctgccagttcagcacctggctggatctccttgtttacagctccagagaggaaagaggagcccccccrccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcrtgtggggcccgagtctgtggtggccaagactggtgagtcatggctgccaggcctccctcccctgctagccccatcctgtgagcgggacttggctggggctccttccagcctccctccatcttcgccttctcagctcattttgccaaagcctccacccacttcctcccgcactgctctcctgtcctctgcatgccaggtccccctcatccagcctccacctcctcatctcttcctcagcctcacttcttcatctccaagggcaggtcctattttcccccattccaaacacctggactcatccttccacctggggctgtcctccccacagatgtcctcaccattcggtcactgtgttctcacccctcagtttttactgggctccttcatggtctggtttgggccatggtcacttctgggcttctgtcacctgctgcccacaacctcctgccatttctgctgtgttcagaggtggcagatccaagtgacaagagcaccacgtttctctagcctttttgcagcatgaagaggactcctctcagctcccgactccttgactcccagcccccttggaacagggcaaagggattgtgttcagcccagcatcccagcctgttcctccatgtccccagcctttccctgtccagtgccattcccctggcctgtgaattatttgatgagagatagtgtggatagtggttaggagcaaagactccggagccaactgcccgagtctcactaccagccttgcaacttacttcctgtaggaccttgtgcaaattgcttaacctctctgtgcctcagctttcccttctgtcaggtggctggatttcagtccctctgcacagagctgttggaattacatgagttaatatatgtataacacttagaaaggccaggcacagtggctcatgcctgtaatcccagcattttgggaggccaaggcgggtggatcacgaggtcaggagatcgagaccatcctggctaacacggtgaaaccgtgtctccactaaaaatacaaaaaattagccaggcatggtggcaggtgcctgtagtcccagctactcaagaggatgaggcaggagaatggcgtgaacccgggaggcggagcttgcagtgagccgagatcgcgccactgcattccagcctgggcgacagagtgagactccatctcaaaaaaaaaacaaaaacaaaaacaaaaaaagcccacacacttagaatagtgcttggagcagcaaagcattttcagagtgagctgcaatttctccctgactctctcacttcccagtaatcttttttgctccccacctccctcccttcctctgggttgtcattcttgccaattctttcctcaatctgctatcccaaagtagtcccccatgtagcaggtcacagaagggctggtttcccttgtgccacagtctccccactccatggagcctcagcagagacctaactgtagggggcgggtaggtgcccacagggctgtgattccagagccagccagggaaggacatgtctctccttggatcccactcaccccagaatttttctcccactcatgcctggagccctgccttagcaattcattccttggggttaaaggggagggaggggcagggctgcctggggaggccacagcaagagcacattccatggtcagatcctcatatgaggggtggggcagccagagtgccctggggagggcacaggtaggaagaggcctcactgccctcctcactstctgaggtcagcactgtcagtgaacgtggtttggaagaaccctcagaggcttcctctcttcccatctcagctcctttctcagacacgaagggagacccctcacccccacagaacccaccagagcaggatggggcaagggctgtctcagccttctccatccgtgagtgaccgaatggcaaatacaaaggctacagagcccctgagcccacagcgtaagggcatttccatggctgtcatctgtgggcagcagcagcaaagccagcagccctttatgcctctatctcttctctcagctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccrggcggtgcgtgttgggggcaaggagagtgaggtcaccgtgggaggcctagagcccgggcacaagtacaagatgcacctgtacggcctccaygaggggcagcgcgtgggcccrgtgtccgccgtgggcgtgacaggtgagtgaggggcaggggcctgctttggttccctcccactgctggctcccagcttccctgtagccagttgctctccttgctccagtggaaccttgaggctgcctgccaggggaagacctagaaagagcatgtcactggggactggcgtaccaccagctttcatggccctgagcaagttttaaactttctgcacctctgtttccttgtccgtaaaatggggacacctacctcacagagttattgtgagggttaagtgagttaacagatgtaaagcatcaagaatgggcctggcaaaagtaaatatgctgccagtgtctgctgtgagaattgttataaatattcttactctgaggtctgctttgtcccctttggctggttcagttacttggtcagaatgcacatgaatctaaggccataccaccctgaaggtgtcctatcatctcctctgatctcagaagctaagcagggtcaggtctggttagtacttggatgggagaatgcgcgtgagacattggcctcttcatcagtacagcttgaagcaagctttcttttctttcttgtctttttttttttttttttttttttgagacagagtctcactctgttgcccagcctggagtgcagtggtgcgatctcagctcactgcaacctctgcctcccaagttcaagtgattctcctgcctcagcctcccaaatagctgggactacagatgcgtgccaccacacctggttacttttttgtatttttagtagagacggggttcaccgtgttggccaggctggtctcaaactccagatcctcaagtgagccacctgcctcggcctcccaaagttctggtattacaggcgtgagccaccacgcctgaccacaaagctttctctttcttctttctctctttttctttctttctttctttctttctttctttctttctttctttctttctttctttctttctttctctttctttctgtctctctctctctctttctttctttttttcctttctttctgttttttgagctctgttgcccaggctggaatgcagtggtgcaatyttggctcactgcaacctttgcctcccaggttcaagtgattctcctgcctcagcctcccgagtagctgggattacaggcatgcaccaccacacctggctaatttttgtatttttaatagagatggggttttaccatgtcagccaggctggtctcaaactcttgacctcaagtgatccacccgccttggccttccaaagtgctgggattataggcataagccaccacgcccggccacaaggctttctttaatactcatccagtgagtgactttacagcaaagaagaacatcccttccaccctttctctcaggcctggttacagggccacatccaccaccacacaggaccagcctgggcacctcctctccagggcctcagcccaagaggctgagtggacagcagtgcctctgggaccctcgggctgacctgcccggtttagtcacagtgaggggaatctcttttttcctttgctcacagaaacaaagacacacctttctcaaaaataacttttactataaggggaaagattwaaaaattaaaagtagagaaatagatagttttccagaacatggtttctgtaattccaccaagctcagcctcatcatgacttggttgatttcatttccagaaccttccaccctcaatttattttctttgcctcagtcagccctgagaagagggagacggcaaagccaccctgagtggctgtccttggggcctgaggttgtagggtggaggctggtgccaggcccagacatgctgccaagtctgctcctggagtgaccctccctctgccgctctgtcccagggacccacactgggctctgtgaggccctgtgcctggtccctggggtaaggatgggctctgtcaggcactgaccaagtcggtgcagtagagataaatrgagtttgggaatctgasaaactgagttccttcctgtcttcctctgttctcagctgtatgatttttatttttttattttattattatttttttgagacagagtcttgctttgtcacccaggctggagtgcagtggcatgatctcagctcactgcaacctctggctcccaggttcaagcagtcctcctgcctcagccccccaagtagctgggattacaggcgcccaccaccacacccggctaatttttgtatttttagtagagacagggtttcaccatgttagccaggctggtctcgaacttctgacctcagatgatccacccgccttggcctcccaaagtgctgggattacaggcgtgaggcaccgtgcccagccagctgtatgatcttgaaaaacttacctcctctcctggaacctcagcttcctcatattcaggagggagtaaacgctgcccagcttgttgtcacggttaaaggtggtgatgtaacatgtctggcatcttctcagctcattcatcttttgctcagaccttcccgygagggaatccctgtatatccatgttctaatgctggatattttgaaacatgtattttacacgtcctggataaaatagatgaggccctttaggaaagaaatgggcatcagtgcgcattatcagagcagcaaaaggacgaagcagctggagtccgccaagctgggggctgtgtctggcagcacacacagtgcagttgccagggggagaggtgcgtggagctcattagacacacttctaaattggaaaaggactgtcccacatgcagcatggggactgccagagtcatgaatcgttataattgtacctttccagttaatccaaaccaccagcaataaagcttgatggtgaaggacattttcattccctcatggaaagaagtgcagagagggcaaaaaggagcagggaatgggtgctgcaggaacaagtaaggttagaaggcaaatgaaatgagagaaaatgcccagcctggtacctgtacatagtagatgttcaatacttggtggtcactctgctccctcccaccacctcagctgcctccatgcctgccctccccagcctgactcatttctgtctgcccgaggcctggtcaccagcctgttttaagcagttgtcacttgcttggagccttgtcttgccctccggaggaagccagagaaacaagttcttgggagccccacccatccagccaccttctctgccattttgcctcttgggaccaccttctagtttgctcactaatgagtgcttcctcatgcgggagtggtggggatctgcaggtcctgagcccagacctgtagaccactcattattttacagacatctgtggagcacctactgtgtgccagggactgggacacagcagtgaataaagcagagctcctgcctgaggagctcacattctagtggagagggacaggcaacaaattgcacaaatatgtcagtggcaccggatgtgacagtgatgagtggtggggaaaagcagagcctagtagggagacagcaagggcctcactgcgagggcagtgtctgaggaaagccctgaaggaggtgagaggacagccacctaggcctttggggaaagagcatcccagacagaaggaagagcaaatgcagagactggcaggcgagaagcagccccagatgtctgcagacagtgaggnatgcagtatgttttgtggtggagttggaggagggcaggcaatagggaatgatctaagagatgaatatgggacctcagaggccagtgcaggacttggatttcaccctgagtgaggtagaagccactgcgggaaccagctctggctaatgtgttaacaggatccttctggctgcagacccaacagactaaaggggggtgagggcagaaggcgatgacctgagagaatgttgtgataatccaggaggagccagtggtgcttggaggtggcaaggaggggtcagactctgaaggtagtgacaacaggcggatacccacagggcggatgtggagtttaagagaggactcggggatgactctggcggtttagatctgagcagctggaagaatgaagttgtaatcctggtcaggcgtggaggatcatgcctgtaatcccagcacttggggaggccgaggcgggcggatcacctgaggtcgggagttcaagaccaacctgactaacgtggagaaaccccatctctactgaaaatacaaaattagccggacgtggtggcacatgcctgtaatcccagctactcaggaggctaaggcaggagaatcgcttgaacccaggaggcgtaggttgcggtgagccgagagggcgccatcgcacaccagcctgagcaacaacagcgaaactccgtctcaaaaaaaaaaagttgtaatcttactgaggtggggaggctgtggcgggagcaggtgtcaggaagctcagaggctcagttttggacttgttgagtttgacacacaagtaggcctccaaggaagacgttgcacgaacactagtctggggttcaggggaggtctggacagagggtgtaaatctggagtcattggcatatagatggaatttcagcgctctcccagggtgtcagtgatggttgatactcttctcccccaacaaatgcagcctcagacaccgagcagggacctagtgaaggactgttgaccagacagatgttcagatcaatgcgcttttacatcaaaaccatcatgcgggttccacaaatgcaacagacatcgctgggtgtggtggctcacacctgtaatcccagcactttgggggctgagrcaggtggatcacctgaggtcaggggtttgagaccagcctggccaacatggcaaatgccrtctccactaaaaatacacacacacacaaaattaggcaggcatggtggcgcacgcctgtagtcccagctacttgggaggctaaggcaggaggatcgcttgaacccgggaggcagaggctgcagtgagccgaggtcgcccactgctctgggtgacagcragactccatctcaaaaataaaaaataaaaaataaataactagacatcattactataagaaaagggggattctttactaacagccccctaccatctctgtcccagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacgggtgagtaatggggggactcagtcctcatctctggttacccagagctcccccaccccatggcccttcttccagccctgccttggtaccaccgcaccctcactgaggggctagatcccctcaggccctggctcggtgaccctgccagtctttctgttccctgacccctttactcctcccagggctagagccttctcagccctccagctccttccccatctccactctgccccccgcccaggggaatgtcttatttccatttggcctaaatccagccacagactttctctccccctctccgactgcccacagctgtttccaccccttctctttacaaccctgctgtgacttggacacagctgccacctcctgcttctgcccttktttgttgaggcgaagtgctttacatcctgagtcccttctcaggagtcctctgccacctgcctgcactgcattccatcccagccctggagagttttcatctctccaggaggcygcctcactcttgctctgggctccttcctgcccctcatggcttcctgggcacaggttctccatgattgttgtgctgtggcatctggtgaaacccctaccccacctgaaggcaatgtttttaaatctgtaaaataagctgtataggattacaaaggaaacattatatttatagacagttatcaaaatatttcttttttatttttgagatggagttttgctcttgtcatccaggctggagtgcaatggcgcgatctcggctcactgcaacctccgcttcccaagttcaagcaattctcctgcctcagcctcccgagtaactgggattacnggcacgtgccaccacacccagctaattttttgtatttttagtagaaacagggtttcgccatgttggccaggctggcctcaaactcctgacctcaggtgatccacccgcctcggcctggcatgagccactgcacccggcccaaaatatttcttaaaaatccaaagttacgatttagtaatacttggacttatttactagttcattaaataacaggacttggtggcgcgtttactaaactacaaaatttagaagcagtgatggatataaaaggtattttaaagtttctgcaataactctaaggtgacatgaaaacatctgtggtttctattggtaacaaagtcacaataattctactctggtgggttttctatattagttttggaaagaaatgctgcatttcagttagaggtctggaagtaaaggtgtaactattccccatctcagttcacagcccccctgaggccctcaaagcccaggggttctcccctcagagatctcaaccatgttctttgtcttcccaaatcccagctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacgggtgagatgggcccctacacagctgagcctgaggccacagccttcccacccttctcttcactccctctgctgagtcttccctttgtccacctgctctgtctcatttgaaaagccacatggggctagcacagtgactcatgcctgtaatcccagcactttgggagtccaaggcaggtcaggagtttgagaccagtctggccaacatggcaaaaccctgtctctactaaaaagacaaaaattagctgggtgtggtgatgggtgctagtaattccagctactcgggagtctgaggcacaagaatcacttgaacccaggaggtggaggctgcagggagctgagattgcgccactgcactccagcctgggtgatagagccagactccgtctcaaaaaagaccaaaaaaaaaaaaaaaagaaagaaaagccgcaaagcagatgaggaccaggagagtggggccagttcctgggtctgctgtcccctgctgactctgcctctcttctcgtaatttccacttttgttggatgagggaagcccctacaggcctcttcctgcagggtggatgtgggagcctgggggtgctgggagaaggggcgaggggagccaggaacccttcctgccttgcgaatccatcacctcctgagagtctttgttgtctcccctgtgactctcacccaggttctcaccctcctagctcaggcctgtctgggcccatatgtgcctcctacagaggctgcccttccttctctgccctcctcctgaagtctcagaaattgggaaccagaggagcccagcccagctgtgcccctttccgagggttcagtccaagccctcccctgcccctgggggctccctattgccagaaaacttgcaataacaatgtcgtcagcgtcctcaccgtccaggaaggcagcaggccagctccttctcaagccctgggatggctcctcaggcagacaccagatcccttccctgcctgagctccccggcatcatccccctcaacattctcacaggcagcccacgctccttcaccaggcccagtgggagccttagttctcccgggccagccrgtgcagaataagaaagggaacggagaagggtgagaactacctgtgtcgtaacatcctgcctccctgacctgccgagtgcccccatcagggatcctgcgctcctcggggccggccaaatcacccctttcctcaggggccggccaaatcacngccaaatcgtgtgctcctgggtaagaggagatagagacccagtctgtaagaagctgcaccctgctggggaagcagtctgtgagaggcggaaagaggctggacagaaaggggagtaagatgaggcagggagctagggaatctcttttcctggaggtgactcaggacaggtgaccctccccacttgggtcaaggggagagaggcatggaccagacggagatggtggtgaggatgggaggtgatggaaatattttggggaagcactgagcatttgggcagttctgggtttttccagccccagagggaggcagtcaaggagtcgttttggaaaaaataaacacaagaacctttcctctccagttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacgggtgaggggcattccctgcaggtccctgctctgctcccctcaggccaagcagcagacggtcacttgtggtggctgccattaccattatttggccccagccactcggctcagatccagctccccacgtccctgcacaagcccctagcacagcccggcaggactcagccacgcaaagccctgtctccagacctctcaatcctgcccgtcgaggtcacccagtcttccagaaacagctcagccgtttcctctccgtgtctccatctcagaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactggtgagtgtgcggcagctggaacacctgtgcctccttcccgcctggctctcctggtctgactgagccataagatctctgagcttcccattttatatcatttccattgatccagaaagtttccttgtgcccctttagagtcagttgccccagtcccagcctccagcaaccactgtctgctttcgatcatcctggagacagcattttgactctccatgtaatggaatcacaatacgcagtctcttgtgtttcatttcttgcaattagcacaatgcttttgaaattcacccatgtgcagcaaaagctggtctttcgattgctgactgcttgccctcactccctctcctccctcactcctcctgagagtctgggtgcagcgacacaccagccatctgtctctacctgtctctgtgaaccagccggcagggaagaaacggaaactgagaccacggccccgacccctccagcgcctgagccccacctcggggagttgacagtggaggaggccacgtcacacaccctgcatctctcctggatggtgactragggagaatttgactccttcgaaatccagtacrcagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacaggtgagaactctgcccactatgcctcctttcagatggctgggagagtccagaggacagcagagtcccgcggataccctgcccacctcagtcctctctttccatgtctctgtccagtcccggaggaggagaagccttcagaacctcccaccgcaacccccgagccccccatcaagcctcgcctgggggagctgaccgtgacagatgccacccctgactccctcagcctgtcctggacrgttccygagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacaggtgagtggatgatgggagccccagggtgggagccatgggagggtcaccctcttgctctttggwgatgactggtggggaatgggacaagggtctggtcagcaccacagacctgcttgtggctggggctggggctccccttgggccttcctgtgaggttgaccactggctcctcctgaacagagaggggccatcgggaattttgctgtgctggtggctgtcccaggtcccccacagctgaccctggaacttgtcatgtgtgttagctgtcagctgagcaggaccacccagccccaagagtaggcctctctgaactgacctcgggtcccccagtcatagccttggcttctccctccttttccccagtacccaaggacatccccctcactctctcttcctccttctcagctgcagaggaagagacccccagccccacagaacccagcatggaggccccggagcccgctgaggagccrctcctgggggagctaacagtgacaggatcctcccctgactcgctgagcctctcctggacygtcccccagggccgcttcgactccttcaccrtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacgggtgagtgtgcrctgcagagccctctgggttgggtcttagcaaagtacagcctccagcatctcctccactagggacccagaaccccaagacctcaaacctgtaatacaccctgttcactaaaggctcaggacaggtgtgatctggggacagagagagcaaatccaggagaagtgtcggagccatatgggaaaggcccccagggactgaggcctcttgggaggtgattcactggctggtttgtggctctccgcttttccttggaactctatacataactctttttgtgagattggaacacatttttgaaatacaaattaattaaattaataagtatttgttaaataaaatttcaaatgtataaacagaaagaatagtacaaagaccctgccatcctccttcaatcaaatatcgacttctggccagtctggctcatctctgccccacccacttcctccactagaatcactagaatgttttctttctttctttctttctttctttctttctttctttctttctttctttctttctttctttcttccttccttyctttctttctctttctttctttctttcattcttttcttttctttctttctttttagacaaggtctcactctgtcgcctgggctagagtgtactggcacagtcacaattcactgcactgcagcctcaacctcctgggcttaagggatcctcccacttcagcctcccgaatagctgggactacaagtgcactccaccatgcccagctaattttttgtattttttgtagagacagggtttagccatgttgcccaggccagtctcgaactcctgggctcaagttatcctcccacctcagccaaagtgataggattccaggcgtgagccgccacacccggcctgaatgttttctttattaacacctttatggagatataattcatgtggcataaaatacacttgtttttagtgtacaacttactgattttagtatctttacctacttgtgcagccatcaccacgatctaattttagaacttttccatcacccccaaaagaaatcttgggtccagacccattcctacctcagccctagtttataactaatctacttttttctctgtagattgctgttccagaacatttcgtataaatggactcaaacaatatgtattcttttgtgtctagcttctttcactgagcataatgtttttgaggttcatcaatgtagcatgtagaagtactatacttactacattgctattgattgattgattgattgattgattgattttttttgagacaaattcccactctattgcccaggctatagtgcagtggcatgatcatagctcactgcagccccagactcctgggctcaagccatcctcccatctcagccccccaggtagctggggccacaggtgctcgccaccacactcagctaatttaaaaaaattttttgtagagatggggtctcacagtgttacccaggctgatatcaaactcctggcttcaaggaatcctcctgcctgggccttacaaagtgctgggatagcaggcatgagccacctgctctctctcagccactacactgctttttattgccaaacagtattgcattgtgtggttatactactgcagtattttaaaaacgaaccacagacatcctatgctttcatcactaaatatttaaaggtatatctctttttaaaaaaattatttttaaaaaatccacaatatggccaggtgaggtggttcacgcttgtaatcccagcactttgggaggccaaggcaggtggatcacttgaggtaaagagttcaagaccagcctgaccaacatggtgaaacccygtctctactaaaaataataataataataataaattttaaaaagtacaaaaaagcggagcgtggtggcacgtgcctgtagtcccagctacttggcgggggttgaggcacaagaaattgcttgcacccaggaggtggaggttgcagtgagccaagatcgcgccactgcactccagcctgggtgacagagtgagactctgtgtcaaaaaataaataaataaataataaaattccacaatacaattagcataccttgataagtgaacaatcatgccttgatatcaagtatccaggtagtgctacagtctcccgagtgtctcataattgttgtttcccaatttgttgctgaaatcaggtctatagaaggaggatacattgcaattgagaaaactgaaattttaaatagagtaatcagggaaggcccacagaagaaggtggcttttgaacaaagacttaaaggaagtgtggggatgagccatgaagatatctggggaaagaacatttaggtagagggaacagtcattgtaaaagtactgaggtaggaggctgcctggcatggttgagggaccataaggaagccacaaaatctgattatgattataatcagaaatcgatcttaagttagggccagactgggcccaccttctgacctgaattcaagacagctggggcctcaacacctccttgcagcaagagaaaagattctgtttctatctcttcctagcccccgaagaggagtcccctgatgctcctcttgcaaagctgcgcctagggcagatgacagtgagagacatcacctccgactccctcagcctctcctggacagtccccgagggccagtttgaccatttcttggtccagtwtaagaatggggangggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactggtgagtgtgcagtagggcactgggccctgccctgaactagactcagtttcccttttattgtcagtatctggtggctttattttactttccctgagaccaagcctcccaagctcctgggaatggttctgctggtgccttcactccgagactttggtattgccccaggtcttctgcccrttacacatgggctttttgggttcccaaagaggtgggggaccaggaaaataacacagactgaggcacacctggggttgaccatagcttcagcccatttgagctgtgtgtcctcaaragactcacacaacctgtctgggcacggtggctcatgcctgtaatcccagcactttgggaggccgaagggggcagatcacttgaggtcaggagttcgagaccagcctggccaacatcatgaaacccccatctctactaaaaatacaaaaattagctgggtgtggtggyacatgcctgtagtcccagctactcgggaggctaaggcgggagaatcgcttgaacccaggaggcggaggttgcagtgagccgagatcgagccactgcactccagcctgtgtgacagagtgagaccctgtctcaaaaaaacaaaacaagcaaacaaaaaacagacacacgacctctctgtacatccttttcctcatctgtaaagaaggaataaccatacctgtcgtgaagggtgggcgggagtgtggcttggctctcacacacaatgagagataactgcagtctttcccttctgaggaaggtaggtagttcctgaaaaccgcttagggcaaattctcataattatcactgatttcagtgggaaaaattgtatgtgttctctaagctcccaaattaatacccatttatttttaaaacaacactgaatcctgttaacatggatactattactttaattgtaaatattggccatgtgcacaacttaataaggcattttcctttcattaccctgtaactcggctctttgatgcttttgtaagctcttttatagctgttaccccctagatgcttaagactcagttctcaaaaagaacagacaaatgaaatgtgatgaatttgtaataccactatcaaggcagaataaaaccctatgaagagcagaaaagattaaagaaatcaatgaaaacaaagcaattgatttcacacgggccaaaagaactggcatcactggaggtgctctctctgccgtaagttagcagagctactgcaggtccagagacaactcagctgcaaagatgccctcatgtggtctcatctctctaccctcagctataaaatctaagttggtttctaaaaatgctcaggattaggtggaatttccaagcccaggtggatgaacctcctgatacaacttgcctgttgtgtttggttggtgttctttgttttcttttttttttttttctttatgttgagatggagtctcactctgtcacccaggctctcaggctggagtgccgtggtgcgatctcagctcattgcaacctctgcctcccaggtccaagcagttctcctgcctcagccttccgagtagctgggattacaggcatgcaccagcacatctggctaatttttgtatttttagtacagacaggatttcgccatgttggcsaggctggtctcaagctcctgacctcaggtgatcctcccgcctcggcctcccaaagtgctgggattacaggcctgagccaccacgcctggccctgattgctgttttttgtttgtttgtttgtttttgtttgtttgtttttttcttgagaargagtctcgctgtctcccaggatggagtgcagtggcgtgatcttggctcaccgcaagctccgcctcctgggttcatgccattctcctgcctcagcctcctgagtagctgggactacaggtgcccgccaacacgcctggctaattttttgtatttttagtaaagacggggtttcacagtgttagccaggatggtctcaatctcctgacctcatgatccgcccgcctcggcctcccaaagtgctgagattacaggcctgagccaccacacccggccctggttggtgttcttataaagcatcaattctgtcctgcaaaacaaatttgcttggcagctcctaagggtcccaggcctgcacactgagcatcacagggatgccacctgagcatcatgacttcaccacaggtgtggtgttaactgaacattcaaagcagaaaaatgatattctaagcttggggcaccagcatccagactgtgggcccttggtgtgtctaagagaatcccagagtcccttggttaaaaggaggcccaccaggcatgccyacccattctattttctgatgcagccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacaggtgartggacgatgggagmcccagggtgggagccatgggagggtcaccctcttgctctttggtgatgactggtggggaatgggaygggtctggtcagcaccacagacctacttgtggctggggctggggctcccattgtacctttttgtgtggttgacccctggctccccctgagcagggaggggccattgggagttttgctgtgctggtggctgtgccaggtcccccacagctgaccctggaatttgtcatgtgtgttagctgtcagctgagcaggaccccaagaatgggcctctctgaactgacctcaggtcccctagtcatagccttggctatttcatatgtcccctagtcatagccttctccctccttttccccacgacgtaagcacatcccccagggaccctgccatcctctctgtgtccctttttctcagctgcagaggaagagacccccagccccacagaacccagcatggaggccccggagccccctgaggagcygctcctgggggagctnacagtgacaggatcctcccctgactcgctgagcctctcctggaccgtcccccagggccgcttcgactccttcaccgtgcagtacaaggacagggacgggcggccccaggtggtgcgtgttgggggygaggagagcgaggtcaccgtggggggcctggagcctgggcgcaaatacaagatgcacctgtanggcctccacgaggggcggcgngtgggcccggtgtccaccgtgrgcgtgactggtgagtagtgcttggagtctcggggtaaccacctttccctcatgggtacctggtttactgctgtgccctttcaccaagccctgtgggtccagacttgtctcctgtgtcctgccctccctctgtgccctgtggctgtggcctatgctagcggtttgcttgttcactttggcgtggcctccctctaatggtcaaccactgataacctccaagagtgaaatatgtcaggcgcacaccaagcctgacttacgagaattttcctttctttccatcttaataacagcattctttgttataaccacatacacaaatgcacacaagaggaacaatccaacgtcaaaccacgttgggatgactaaataatttaggcaacatctataaaaagagctattatgccgccactgaaatgttttaacataagacccttactttataatgttacattgaaaaaagagagcctaggctgggcacagtggcttacgcctgtaatcccagcactttgggaggccgaggcgggctgatcgcctgaggtcaggagttccagaccagtctagccaacatggtgaaaccccatctctactaaaaatacaaaaattagccaagcatggtggcacatgcctgtaatcccagttacttgggaggtggaggcacgagaattgcttgaacccgggaggcagaggttgcagtgagccgagatcaccactgcactccagcctggcagatacagccaaactcagtctcaaaaaagaagaaaaaggagcccaaatttttgtaaggatgctaatcacaaccatttgaaagtaacaggcatggcaagaagactggaaagaaacacatcccacgggttgcctgatttgttagatagaatagaatattccagcacatttttttctgtattattctattctgcatagtccaaattttcttaaatggcaaacatttcttttacaatcagggaaagggaaaagagaaaatatataatgtcttctccttctttacactccatctgtcctactcctctatcgctsttgtggcttatttcatttatttccttcttttttttttttgagatgaagtttcgctcttgtcgcccaggctggagtgcaatggcatgatctcggctcactacaacctctgcctcctggattcaagcgattctcctgcctcagcctcccgagtagctgggattacaggcatgcgccaccacatctggctaattttgtatttttagtagagagggagtttctccatgttggtcaggctgctcaaactcctgacctcaggtgatctgcccgcctcggcctcccaaagtgctgggattacaggcatgagccaccgcgcccagccagacttatttcatttctaattatgaggaagttcaaaatttctagtccataagaaattggaggggtggagatcatgaggttaattgaattccaaatgctcagtcaggctgccttttctaagtcatcctcagccaggttgttatgcctggcttagagtatttttcgagaattcctaccgatggggaagaatcagccctgctgagaggcggtctcttgcagggcaggtcgccacctctgtggcaccaagtgaggtgcgagctcatctcccaaaggccatccagacagaggaagcactctcaatcggcatccccgattcctgggggagaggcctcatttccatatgcatgttcagaggaccatctgagtgttgggaaacagggggaatagggaaattattggaaaatgaacattagaaaaattcacattccgggggtaagctgtcctggtccacgttcagttttgtgttcctgtctccactgtggggaaccacagaactgacagaggacaggctgagggacccacccctgcccctcctgttctatgtgtattgctgccccacccccaccccacactctattattaattgttgtagcccagaatttctttctttctttttcttttttttttttttttttgagactgagtctcactctgttgcccaggctggagtgcagtggtgtgatctcagctcactgcaacctctgcctcccaggttcaagtgattgtcctgcctcagcctcctgagtagctgggattacaggtgcatgccaccacgcctggctaatttttgtattttcagtagagaccgggtttcatgatattggccaagctagactcgaattcccaacytcaggtgatccacccgcctcggcctcccaaaatgctaggattacaggcgtgaaccactgctcccagcccagaatttcttttttagcccacgtttttctagtgaaaataatacagcaacattatgtggaaagcttgaaaaacagaaaacaagaatctcatagtcctactttctcycccagctgccggcattaataacaatgtgtgtagtgcacattcccttcctgtattttgcatgcagagcgtgttttaaagttgcaatcagtgttcataaagttcttggcacttccttttttgtacacaagtacattgtaatcattcacctcacggctacacaaccagcattcatcatcgtttcaatggttatttgatgcgttgcggtgaaagcactataacaaaattaatcatcttctacgggtcatttgtgttcctgacacatctgctgtcatgaataaccccatcgtgagttcttccatgctataactttttcctgctttaataattttcttaggacagatgcccagaactgggattattgggtcaaaggaaatgagaattactttggctcctgacactatgtctcagttgccttctggaggtttctaacagtgcagctctgccagcagtacaggccgggggctcggggatacctcaccggctcttattccaagagtcactgaacggcgaacacaaagctgccccagccctcagcctgctctggaggggcgcatttgatgtatgacctctgttgacagcaccagcaaagcaagttgcccttaaacccttaaactctgtatccccctatattacctttcagccccacaagaggatgtggacragacccccagccctacagaaccaggcacagaggccccagrgccccccgaggagcctctcctgggggagctgacagtgacaggatcctcccctgactcgctgagcctttcctggaccgtcccccagggccgctttgactccttcaccgtgcagtacaaggacagggaygggcggccccaggcggtgcgtgttgggggccaggagagcaaggtcactgtgaggggcctggagcctgggcgcaagtacaagatgcacctgtacggcctccacgaggggcngcgcctrggcccggtgtctgccgtgggcgtcacaggtgagtgagtgtgggtggggcagggttggaagacagccctagaaaatgtgcccttctctaccattttcctatacatatttctgtcttgatggggctcacagtgaaaggaatatagcaacattatggaaagacatgtcatggagagacaggctgcaatccagcaaatgaagcaaaggcgggtgagcatgtgatagggaggcccagggctcaggtcaggaccagacagggacgcctaagtcaccctgcccatgggtacccaggggacagccaggacctgagkccaggcatgccttagcttggtgacagctttagagagaaggtgaagtgtgtcagataatcacagctggtgcaaaggccaggaggctagaaagagcatggcacgtgagaggcactgaggattgagtggggtgtcctttacggtgagtatctcatcctgaagtgtgggagcagaggaggggaccactcaccaggcctggggtctcccagggatgaggatgtggttgcccaggtctgtgctgagatggccccagcagctgtgcctgtgtgaagctcatccgtgggggctgaagatggggatggggtggcagggagcctggaggcagcgaggccagtaggcagttggtggccctggtgagaggtgacagtggctcaaactaggatcggggactggaggtggggtaggaaggtatccaggggaattcagggtaaagatgctctgaggctgctggcagctggtgaggagctggatccaggaacacaccccaggctctggcctcgggaggagtgtgctgagcttgttgcggagcaaagacagaagcccagtgaacaaaagatggcgaagagaccccagtgctgggaggccaggggtgcagaggccgagtggggctgtgctcaaaagagaggcggtgctggagggacagggagaggtggcctgggtgttgggaggtgggggtgaggtgggggctgagggcaggagggtcagggtgagggataggaaaggccacaggagaggagaggatgaagagctgtgctggaggggctgtgggcagcatcgtcctgctcttgggcactttgtgttttgtgacacatcctttctatgctgaactgaggagccagggacctcactgtccccacacgtgtctgtccaactccagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcrcgtgggccccatctctgtcattggggtgacgggtgagtggatgatggcagccccagggtgggagccgtgggagggtcaccctcttgctctttggtgatgactggtggggaatgggccaggggtccggtcagcaccacagacctgcttgtggctggggctcyccttgggccttcctctgaggctgacccctggctcctcctgagcagggaggggccatcaggagttctgctgtgctggtgactgtcccaggtcccccacagctgaccctggaacttgtcatgtgtgttagctgtcagttgagcaggaccacccagccccaagaatgggcttttctgaaatgacctcacatacccagtagtggccatggtttctccctccttcccttgaagacctgagcacatcccccaggcacctggcatcctctctatatctccttttctcagctgcagaggaagagacccccagccccacggaactcagcactgaggcccsggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacaggtgagtgtttgtgagtgaggaagatggccctagaagatgttgctttctctgcaacttcatgaaaacaaaaatattctcaccagccgggcttcttttgcacgtttccatgcttggggatcttgctaagaggcagattggggttcaacaggtttgggctagggccagagattctgcatttccaacaagaaatgatgcggatgctgctggcccatgatcacgccccttgagtagcaaagttcttcacgacaaaggaattggaccctcttttgaaatctgttgaagagaatttttctgcgtccctgattcctggtagtgtgctttctctgtggagttgactaggggccgtgaaggaagacagaaggcagtgaggggcagcgcgtcgactgcacactctggaagcccactattggaataggaataggaacagacctttctcaccaatgggccaatttgttcattcagcaaagaattccttgccctgatccggacactgtaattttagggtatcaatgtcctctggccaacgacctccagaaactcacctaaaattgaatggatggaattatgctccatgcagtgcaggaggactgtggggtgacttaggaagaggctttagaaagagattgttaaggaactgggcttgtgtttggtgttttaggaaagcatttaaggaagcaaggttttgctctttattagacgctgtcaggaagaagggataaccctattaccnggcgtctcactaagtcttatctttggggaggtcaactagagcaaggccaaagctgccattggtaaagaagcagctatcactcagattagctggatgggtgatgtttggttatttttgtgctttggaaaatgttagagttcatccttactgagacatgatcacagactggccttgttcttgtcttgatccatcctactgacaaatggcctagtctgatgttgatgttccatgaaattgtctgttcaactggaccacgccaagaccagactgtgccaggccagccccaagcagccgtggcctggcagagggaaagggcagctcacgggtgtcagggctgcctttttctttcataggcggaagctggaaagtgacacacacaagttcatgttttcatggggctcacaattgtgggcacaagcagaaaaccggaaagtaagcaaagaaggatgagcatgtggagcccaggagccaagccaggattgggaagggacagtgaagtcactctgcccacaagtacccaggggacagccaggacctgaggccaggcaggccttagcttgatgacagctttggagaggaagtgaagcatgtcaaatcatcacagctagtgcaaaggccaggaggctagaaagagcatggtgtgtgagagacactgaggattgagtggggtgtcctttgcagttggtggatcatcctgaagtgtgggagcagaggaggggaccactcaccaggcctggggtctcccagggatgaggatgtggttgcccaggtctgtgctgagatggccccagcagctgtgcctgtgtgaagttcatccgtgggagctaaagatggggatggggtggcagggagcctggaggcagggaggccagtaggcagttggtggccctggtgagaggtgacagtggctcaaactaggatyggggactggaggtgggggaggaaggtatccagggaaactcgggggagaggtactctgaggctgctggcagctggtgaggggctgggtccaggaacacaccccaagctctggcctcgggaggagygtgctgagcttgtwgcggagcaaagacagaagcccagtgaacaaaagatggcgaggagacaccagtgcagggaggctaagggtgcagaggccgagtggggctgtgctcaaaagagaggcggtgctggagggacagggagaggtggcctgggtgttgggaggtgggggtgaggtgggggctgagggcaggggggtcagggtgagggataggaaaggccgcaggagaggagaggatgaagagctgtgctggaggcgctgtgggcagcatcgtcctgctcttgggcactttgtgttttgtgacacatcctttctatgctgaactgagaacccagggacctcactctccccacacgtgtctgtccagctccagaggatgaagcagagaccacccaagcagtgcccaccacaacccctgagccccccaacaagcctcgcctcrgggagctgaccgtgacagatgccacccctgactccctcagcctgtcctggatggtcccygagggccagtttgaccacttcctggtccagtacaggaatggggatgggcagcccaaggtggtgcggkkgccggggcacgaggacggggtcaccatctcaggcctggagccagaccacaagtacaagatgaacctgtacggcttccacrgtggccagcgcgtgggccccatctctgtcattggggtgacaggtgagtgtacgatgggagccccagagtggggcctrtgggagggtctccctttctctggtgatgggtgaactggcccaggaagcccctctgctcttggctgagccatggtacttttttgtctttccccacttccctgaggactgacagatcttcctgggtggagaagggccctgtgagctctgttggtggctgtcccaagttccccagcactgacctcagagcttgtcatgtgtgttgactgtaaactgagcaagaccacccagctccaaagatgggcctctccaagctgaccccaggacccccactcatggccacagcttygctctccttcctcacaagacccaaggacatcccccagggaagctgcctcaccttctctgtcccctcttctcagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacargatgcacctgtacggcctccaygaggggcagcgcgtgggcccagtgtccgctgtgggtgtgacaggtgagtaagtgtgagtgaggcgaggtggggaagatggccctggaagacactgctgtctctccagtcttcgtgaaaacatactctgaagagtattccttcctttgtgtatccaaatgcctggagatttttgttaaaaagcagatttggattcagcaggcttggcctagggcaagagaccatgcatttctttctttttctttctttctttyttttttttttgagatagagtctcgctttgtcacccaggctggagtacagtggctcaatctcggctcactggaacctccgcctcctgggttcaagtgattctcctacctcagcctcctgagtaactgggactacaggcgtgcgccaccacgcccagctaattttttcatatttttagtagagatgggtttcaccgtgttagccaggatggtctcaatctcctgacctcgtgatctgccctcctcggcctcccaaagtgctgggatcataggcgtgagccacggcgcccagccraccatccatttctaacaagattctcatctatcttgatgccactggtccaaggaacacactttttttgttgttttttattgtagtaaagtacacttgacataattcgccattctaatcgctttctagtttgcagtccagcatgaagtccactcacattgctgtggactgtcaccctcyacttccagaactcctcttcccacactgaaacttcctacccactagacacgaactcccattctccccttgccccagcccctggcaacaccattctactctctgtctctatgaatttgactctaggtacctcatataagtgcaatcatacaatatttgtcttttttgaatggttcatttcattaaatacaatgtctttaaggttcatctatgtcgtagcatcagtcagaatttcctttttattttattttctgtggcaatgggggtctcggtatgttgcccaggctggtctcaaactcctggcctcaagcgagtctcccaccttgacctcccaaagtgctgggattataggcaagagccactgcacctggccagaacttccttccttttcaggctgaataatgtttcgttttacacatacagaccacactttgctcatcctttcatccattgatggacatctgggttgcttccacctcttagctatcaagaataatgctgctatgaatatttgtgtgcaaatcacagaacacctttgtagcaaagctcctcccagtaacagatttggaaactctcttagaatttgttgaagcgaatttttcttgcattcatgaatcctcacagaggttaggctcagagttagggttcctgtcctaatgggaaaagttcctgtcctaatggggctaacgtcatgggggacaggctgtggaccagtaagaaagcaaaggcgggtgagcatgtgacaagaagcccagagccaggcaggaatacctaaaccaccctacctgtggatactcaggggacagtcaggatctgaggccaggcaggccttagcttggtgacagctttagagagaaggtgaagcgtgtcagatcagcacaggtggtgcaaaggccaggaggctagaaagagcatggtgtgtgagaagtactgaggattgagtggggtgtcctttgcagtgaatagatagtcctgaagtgtgggagcagaggaggcctggggtctcccagggatgaggatgtgattgcccaggtctgtgctgagatggccccagcagctgtgcctgtgtgaagctcatctgtgggggctaaagatggggatggggtggcagggagcctagaggcagggaagccaataggcagttggtggccctggtgagaggtgacagtggctcaaactaggatcggggactggaggtkggggaggaaggtatccagggaaactcgggggagaggtaactctgaggctgctggcagctggtgaggggctgggtccaggaacacaccccaggctctggcctcgggaggagtgtgctgagcttgttgcagagcaaagacagaagcccagtgaacaaaagatggcgaggagaccccagtgcagggagggtaagggtgcagaggccaagtggagctgtgctcaaaagagaggcggtgctggagggacagggagaggtggcctgggtgttgggaggtgggggtgaggtgggggccgagggcaggggggtcagggtgagggataggaaaggccgcaggggaggagaggatgaagagctgtgctggaggcgctgtgggcagcatcgtcctgttcttgggcactttgtgttttgtgacacatcctttctatgctgaactgagaacccagggtcctcactgtccccacacgtgtctgtccagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggkgccggggcacgaggacggggtcaccatctcaggcctggagccagaccayaaatacaagatgaacctgtacggcttccacggtggccagcgcgtaggccctgtgtctgccattggggtgacgggtgagtgaatgatgggagccccagggtgggagctgtgggagggccacctcttgctctttggtgatgactggtggggaatgggacaggggtctggtcagcaccacagaactgcttgtggctggggctgggactccccttgggccttcctatgtggttgacccctggctccccctgagcagggaggggccatcaggagttttgctgtgctggtggctgtgccaggtcccccacagctgaccctggaacttgttacgtgtgttagctgtcagctgagcaggaccacccagccccaagaatggacttctctgaaatgacctcaggtcccccagtcatagccttggcttctccctccttttccccaggacccaaggacatccccctcactctctctccctccttctccactgcagaggaagagacccccagccccacagaacccagcactgaggccccggaggcccctgaggagccgctcctgggggagttgacagtgacaggatcctcccctgactcgctgagcctctcctggaccrtcccccaggkccgcttcgactccttcaccgtgcagtacaaggacagggaygggcagccccaggtggtgsgtgtcagggkcgaggagagcgaggtcaccgtggggggcctrgagcccgggcgcaaatacaagatgcayctgtacggcctccacgaggggcagcgcgtgggcccagtgtccaccgtgggcatcacgggtgagtggggggacaggccctcgtccccaggtttacctctgcagcccccttgtgtttctcctttggatcttggcacctcttttgactgggcctctaggtttctgtcttttctcccatgttgctaatgatcctgcctcatccttggattcatggagactgtgtggagtcagatgggcaggtagtccatgccctgtttgttgtagcttccttctcccattgtgatctggaacctccatgttgctcgtgtgctcatttgttagtcttcaggctcccttaaggagtattttagtggctcagaaagtgcttcagatccagctgcccagatctgcatgtgccttcgaatgtagtgattgtgcgactttgcaggcgtttcctaaccttgtgcttcagattcctgcaaagttggggtgatgataataatggcacccacttcatatgttgtgcgagggttaaatgcaccactgtttgtgagctgcttacagcaatgcagggcacagattctaaaacaagcgttttagaggaggccgctaagaaatgctcactccagtcctgggagagcactgcctcccttgcgcagggtcctgcctcctgacccatgggcctgctctgctcttttcagcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacrgcccagtccctgtggaggccaggaccggtgagtgagggctggaggcctcccgcggccagagccttcgcccccttgtggcacctgttggaatttcacgttctgtgccccacactccagtcctcagcacccactgatttattgggtccaggaaaacccaggccctgagctctcctctcccactcacactcatccctctccctactttccctgcaccccaggggacacttgctttcttgtctggctcctcttttattcctactcctggcccagtcaccctcccgttcctgggaccggctcacagagccatagcagcccaggaagctccgtggcccctttgcctccatcccactctccatgcacctcactgtcttttccagccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacaggtgagtcccagtccagcctccaccttttccagagctgcctctcatccgagccctcagagctggccctgcagccttcccgtgagattccctctatcagccctgacacaaccatcttaactccgaaagtgagtccctctgtgtgtcaggcacagttctgaagcatatgcattacttcctttcattcgctgactgctgaggaaataaaagggacacgggctttggggccagcagatctgtgttccagttccagtcctagcctttgccagggtgaccatggacaagccgcttcatccccgggacctcagtgtcctcacctgcataatgctgggaatggcgctggactcagtagtggttcccatcctcctccctcctccctgactcggagccgaggggtggaagaaaagggagggcttggctatggaaagacgatggaaaaacctggtgtcactatgcctatgactcagctccctgaggaaggggtgtggtgggtcaccgaccctcaccccactcccaggaccatgagtcactatgcccagaggaggacagagcagccggccagtctgggcctgggtccctgggactccgtaattctcttcccaaaccctcactgtggggacggggtacagatccccacccatcggccccagccccacccgggcaagcctctgctctgccctctgttctcccagctaatcccctgtcttctccctgccccaccctggctgccccggcccagtggggtcagtgtggggctggggaagcaggaggcacggatgttcaggctgatggccacaaggggacaagggggagatcacagcctggcagtgatgggagccgtgcattggccggctgcccagaccagctctcgatgtttggggtgtctccgtgacaacccagagacctccggggagtctctctcagctctggcctcattcrtgctcaggggctgggggtcagggtaaacaaaggccctctctgcacccccagccacccatccctcgggagatgatctgtaatgaatttggcgcatcctcgatcacagcagggaaggggcrgggcaggaaggagtttgggcagcagcctccagaggaggagggggctgttctccctcattcctgtggggcatggcgggagcaggcctgtgtgtctcctcaaggagctgtccctggggctacactggagggaccatttcccagaacctcacacctccgggaggctgccagggcttaggcaaaggcagcatgtgactaagagctttccctcctccctctgcacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacaggtgaggctgctgtgcctggctatagcaagccagcttgtgtgggtttccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccrctgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccngagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcmtggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacaggtaccaccaggcgtctccggcctctagcctaggactcagaagggagaaacgggggctcagaaggggtggtcgcagggaaagagcgtgaggcgggtaccagggagagaggatggatgggctggatgcgagtggcctttagctctgccccacaggacccccctgtggctgcaagtccctggttacagatagagaaacyggggcagggaggggggtggaagggacgtgctctgggtcaccaagctggtgtgcttctgtctccaatcccttctcccccacccactccgtgcagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacycggcactcggccgtgctccgggacctgcgttccgggactctgtacagcctgacactgtatgggctgcgaggaccccacaaggccgacagcatccagggaaccgcccgcaccctcagcccaggtaaggacccacacacactctgccccaaagtgggggtctttgtacttcacgggggggacctagtgcctcagccagcggtgggggtgggcgagttggtggtgggcctggaggaatctgcagagcgacttccattcctggggactagaggaaaaggggtggtgagcctgtgctggagcagaggcgagggggggactcgcagggagyagcctccctgcccctgcctgcgtcattgttccttgacccctctgcagttctggagagcccccgtgacctccaattcagtgaaatcagggagacctcagccaaggtcaactggatgcccccaccatcccgggcggacagcttcaaagtctcctaccagctggcggacggaggtggtgcctttgccatgtgctcatcgcctcgcatttcctctcccccctgcactctgcccaccctccagccgccctggggttccctgggtaaccctcgatccccaargttttcaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacgggtgagatggactgggacccggggcaagaggtgggagccaagaaaacggcatgggtgggagttgagagagaacgaggagggtgaaagggaggtggtggaggctccnattgcggacgggaggccagtggagtctggggaggcacggagtagagagagccgcggggacccttctgagcccctccccttcccccagttcctgacggtcccacacagttgcgtgcactgaacttgaccgagggattcgccgtgctgcactggaagcccccccagaatcctgtggacacctatgacytccaggtcacagcccctgggggtgagcaggsctgaggcctctggaggggacttgttcagggtggggattgcaggggggaggctggactctggccgaggatggagggggcaggccttgatgcccctctctacactcccagccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacaggtagggtctgtggggtgtgtgggacagggagaggaggtagagggagccaggttgggcctcatccccatctcctcttcctgctttccctcctagggctagaggcccctcgggacttggaggccaaggaagtgaccccccgcaccgccctgctcacttggactgagcccccagtccggcccgcaggctacctgctcagcttccacacccctggtggacagakccaggtgccccggccccactgacccaactcccctccctgggtgattccaggaggtgctgcctctggccctcccggagggtctccacctccctctcccctgacccccccttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtacctggacrcacgggcccggggccgggggctgggtgggcagccagggcctaaggcttggaaaaggactggcccctgctctcctctcccaggtgggctgcggatccccttccccagggactgcggggaggagatgcagaacggagccggtgcctccaggaccagcaccatcttcctcaacggcaaccgsgagyggcccctgaacgtgttttgsgacatggagactgatgggggcggctggctggtggntggcattgggaagcccaggggtctgtgcagggcagggtctgttgccccgggagccagaggctgatggtgcccccacttgcttcccaggtgttccagcgccgcatggatggacagacagacttctggagggactgggaggactatgcccatggttttgggaacatctctggagagttctggctgggtcagtgcctcacagggactggggaastacggatggggatgggggccctgtggacaccaggaccctgatgagggcacgtatcccacccccaggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggctaccacggcaccgcaggtaagcagaggctgtgaggctgggagggtgaggctgggaggggaggccctcatggctccttcctccaccctgcccaggggactccatgagctaccacagcggcagtgtcttctctgcccgtgatcggraccccaacancttgctcatctcctgcrctgtctcctaccgaggggcctggtggtacaggaactgccactacgccaacctcaacgggctctacrggagcacagtggaccatcaggtgaggggtggggaggyggctcagagctggggtggctggggctcggcctgcctaggtttcagccccacagtgtaacaggcaagggactgagnggctgggtgaaatggaacaatcatgccagcctcgcagagggagctggagttgatttattggctggaaaggnccagctcagaattaagcctcaatcctctgcagcggagggtcaggaagggagctctgcggggaggttggttgagtgctgggagctacctccttaaggggaargggaagagcagatgggacatccggctttgactctctcttgacaacccctttcccagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacrggagcaataaaggagaaactgaggtacccggctggcatcggtcctgccccatcactggctctggcccgggctgtgggcccccatcccccggggctgcagccgcacttggaaaggctgcatcttgaggatgacactgcagtggggcaggggctgcagggagggcagggcgtccccggaggrcagcagcgtgaaggcctgcagcagtcgggtcagcaccacgaagagctccaggcgcgccagcggctcgcccargcacacgcgggcaccgcagccgaaggccagagctctggagttcttgcctggctccaggaagcgatctgcgggcgggtggacaggtrggtggggaggcgttcagcggcagcggggaccagcctccaccacattttcacggcaggcccccggccccccacataccaggccagaactcatgtggcctctcccagaccgtctcatccaggtgggcgccttggaggttcggaatgatgactgtgccctcagggatgtcgtagccrgagatgctgaagggggctggagttagaggctggccaggacctccctgggctcgggctttcctcactcatccccaaccctcgggagtcacctgctgggccgtgtggtgcggtggggcaaggctaagggcacaacgggccncaggcgcagcacctcggcgatggtggcattgagcaagggcagccgtgcacggtccttgtaggggacccgggagctggaggcaccagggcccagttcgtggtctagctcctcctycagtcgctgctgaatctggggaatgatcgggtggagtcctgccccagcagcccacagctgcccagcctccagccgctccctcagcaacccagtgagcctgagtgccggtgaggcaagcacagccccagccgcacagtgctcagagctgagtgagggtgcccaccgccctggccaggttgctgggaaggagccttttgcttgtccccaggacgcacctcagggtggtgaagcaaaaaaaccacggcccaggagagggtgtttgctgtggtctcagtgccaccgatcaggaggtccactgcagccatgtgcamgtgcccttccaggagctgtccrgagccctcttccatgstcrgctgcgccaccccttggagcatgtagtccatcatgtccctccactggcctgccacsaggctctcctgcagagggtgaaaggagcgggctgagcggctggcctggggagaggagtacagagtggcaacaggcccataactggggtatgcaaaagaacccgcctcatagcaatgctgaggccggtagcatcactggctgtgggccgaggggaggccgtccacacacagtccccaccttgtgctgcctcagctgcwtctccwcgatgtgrtccctcttctctatggcctgcttcarcctccggagacctggattggggaagaactgcggcaggaagcatgagaatgcagctgtgggaaggagcctctccctccaccccagcctctccccyacaayccaggggtgtctaggctccaggtcctcaccctgagaaagggaatcaygtccacaatttggatggaccagtggctccaggtttttaacacctcctggatacatttgtaataggcaggcattaagttgtcstcctgccagnaaaggakggagtactttcagttcaggacaaggagaggctcagggaggggctgggggtgggcctgaggggctgtgaggcaccttgatcttgtctccgaaggtgaggtaacagwtgatgctgcaggtgaggagagagaattcctcctcaatggccacaggggtgccgggctgggctctcatgcgctgtggagaaacagtgtgagttcagcaggccgctgtgcagcgggcagggcgggggctactgtgagaggcgaggctgacccgaggtggcctcaggagcccagccttacctcacagaactcctgggtcagctgctccaccactggctccatggagtcacggatgcccagcagcagggctgagcgggtgagcttcttgtgggctttccagagcagggagtagtctcccaaggamaggtcsgggtagttcytagacaccagcttgtctgcaggaggagttgggggctggagggtgggaactgatgaaggcagctgagggcctgaccttcttcggcctccccaacccctgctttctccccaccagatatgcccccccaagagcttccagggacctggattggggatgccccaaaggtggctcacacttgaggctgaggtgggaggatcatttgagactaggaatttaagaccagcctgggcagcatagcaagaacccatctcttaaaaaaaaatttttttaagaaagaaaaaatgcccccagcccttacaggtaagtggctcaggtctgccagcaaagtctgcccactttttgaccatggcttcctcaatggtcctcttggagttcagcaccaccacatctgggagacagccaaagcagcgtcagcggagagaggaccctctccgtcacctccgccccctcctatggtgagggccagagcgagatcagcctctcaccttgcagcccaaggwggagcctgtagatgggcccgaatttctgagtcaggccaagcagatagatkgggaggtcgggctgcagcargtgcaagaagcccrgggcaagaggcrggaggtggaggctccggagcttccaccagttccacagcaggcgggygccagccagcaggggcagcagcagcagcaggcccaggagcagcatggcaagacgcccgtcagggccctgaggtgccacttatagctcaagagccccagccatccctcctgctgtgtagactgttttggggcctcccttgaccccaccctcaggtgccttcccaccgacccacccacagagtggcccttttctggaatgacaccagtctcattggccttgggacgtccgtatttcaaaaaaaattaatcacccatcgagaagcaaggaagggaaatgcaaccctgacctttttcctgcatccagagtcagctttctggttccacatcacccgtgcaggcaagggtgtccgccccgacctgggccctctccctctgccaccccaccgtgggccagtttactggcatgatgtttgtctcagagagaaaatggcagtccctgcctaataggccttcctgaatcgcctgaagaacaaaatgtgatttgtgtgggtttgtttgttagtttaagctacagatagagtaatacagtttaagcctggtttgcctggggcattccagtatatacaggtatcccagtgtgattgttattagtgcctcctttcactcacaaaagtgcccagaagacaaaggaggaagtggtttcccgctgcggagtaatagcatgtaccagacactgctctaagtgctttgtgggcactcactcaactcttcacagccatgctctatatgcaacacgggtattgttcgcatgttgtggagggcaggattccagcctggaaatctagctgtcgaatatgtacctttagccaccaggagcacctttctttggttgaaaggaaaacagcccaccttgagctggtttgagataaaaaataagaattggggaatttcacagaactcaggaaaaagaagcagaggaggggaccccactggtcttagaaagtcaaggatagggaacagaaaaagccccggagacgggcggtttcctcgctctgttcctctctcctctttcttctctctgcagtcaagtttcttgtgtttccaggcacaggcagaacatgactgccctcaggactacagtccacaggttctactccagccagggaaagtatggattcccagcacaactgggcatgcccccctcaaagtccaaagtccccaggaaggggctggatagccacagctggatcaggatcaagggtccagccctatttggggaactgaagccataaggggtgggggtcccactggactgacactcagagaccacttttgtgggtaaggaggcagtttggggatttgggaagaggccatgccaaagaggagtggccgggttcagtgagaggccagggcctcctggatggtacctgagaggtcagaggcgacccagccccataccttcccccccatttctggctctgtgccagaccctcggaccagtgggggtctctctcccctcagagcttttccagactgtgctactgcagagccagagtcaagaccctggctgtgccacccactacattggcgagttcgctgctgctgaatccatgatcaggactgagagggagaaaacaggattgggatttctggggttgggcaatgacagctactgccttcttcatggttgacctcccagaccgggccatgtcttgctgcaactgaatccctggctccggaaaatgggcttatgccaccaccatgctgagcagctactgggagaaagatctgatgagcaaccatagggccatgtatgcaagagcctcaggaaacctctgccacagtgggaaaggcccaaacttctcaaagttacgtgggataagacagtgctcatcggaaaggagcgcacctggaaggctgacgtgcttactacttgtctcaccatctccatctcttccaccacttccaaatccaaactccgaatgtggtcaattacatgcaatgtccccaaaggtaccctgtcctgcccccggcctctgggcctttgtatattctccttctgccccagatgccctcatctacccctgctctttgcctggctccttctcagtcttcagagccccacttggaggccacctgctccaggaagccttccctgtccctgcctggcaatgcccctgacttggttagatgccccacaggaccacactgctccctgacatcacatctttcacagagggtggggactgcccgtcctcttatctgtctccccagcgatgagccctggagtgagcagctgtatctctggcacctggcacagggcatggcatgaagtgaaagattcccgaatttctgtcgaatgactggatggcaggctgctgaactgtcatgacctctacggaaactgatctcaccaaacttctttggacagacgcggagtcatctctgaagaccccaggtgtgccactaaatgggggaaagttaggcaggtccggtgggaaggggagaccccaggagaacagcggcttcctcagaggattcacaaacacaccaaagtcagacttttggcttgtttgaaaccagtaactggaagaagacactgccggacctgaggattgcacaactccgggaaagtcacctcattccactgataacagaaccaagcgtcagcaggctttcaacagcccggaactcagctaaaatctgcagacctcagaaccgccagcagcacgaggacagagtcggggaggtgtagctggacaacagctcatgaggcagaagagctgtgtcacaggtgtcagctgagcacaagccctgtctgaggccgtggtgactggcgacagccgggcagtggagggccttggaagctgaagggtggtcttggcatggactctggtccttggggtgcaggctcttgggtcccagttctgctcggggtggtcctgtgaagcactagactcctagcgggtcatctgggaggttctagcagagctgaacagcccaagggtcatcagggctcagagagtctaaggttatgtcaacctggcctgcccagaactgcatcgggcaggggcactgctctcagccctagcaacacacactgacacttcgctgccaacactgacactttgctgccaaaagcctttaatatgccctggtcccaggctgtgttcatgaaagcggacacagcagtgcttccagcttcatggttcccaggttcaggttcctcccagcggaggtgggagggcagccctcacacctggcacccctgagtgccatactcctggaggaagtcgttgagctgggcacaggctgcccgctggcgggtgctccggcacaggcgttcagagggcatctcctcgatccagctattcr

SEQ ID NO: 10650 - DNA, 101001 bp, Homo sapiens
  misc_feature (1)...(101001): n = A,T,C or G, or insertion/deletion polymorphism (see Tables 1-2)
ttccttatctgtgatataggtatactagtttcacctgcaaagggttactataaggatgaaataagttaatatttgtgaagtatattgaactgtgcctggcttatagcagtactatgcttgctgattaaaaattaagtacctgcactgggatacagtgctaggagccagagcacaaagaggagcaagaccaactccctgctttcatgacactcacaatacaaaagacagatgaattacttttattcctttaccaaccatttcagaactaagaacaaaaacatgttttaccattactgggtacccaattctcagtcaatattaacataatattgagaataacatttaataaaaagtaatgttttcattaaaacatattcagagtagggaaacttattaaaatatattcaagaaagcgttaacttttaggaccatgagctaacttttaggacaactgtggaaaagagactgaaaggctgcttgagacctcccacatttagatctaagatgttatgatgtctcgatcacaggaggggcaaacccactaaaccaatggttcatttggtgttccagtgcagttccaggcacttccctgtaaactgcagcttcacaaactacatcacatctcgaagaagatgttcatgataatgccctaagagaagccattagagggagtaggagtgctaggcttgaaaaagactatactggacagtatttttttttttttcccagcttggaaatgttctctgatttaggggaaacaacatgttttcctctaggggacagtgtgaagaccagatttcaacaaacccaaagtgccagctaagagggctctgggctgtcttccaaaaagagaagatgactgaaaagagcattggctttgaagtcagaagggctgagtaccaaccccatctccatggagccatgagtcttctaacattgccccccaaccacgtctgcaatctcttctcaggttgtatttcagctggatgttgcacatcctttgcacgtgtgtgcgtgtgtgagtgtgtagaagcactaggggatgggggaaggtggggtgggagtgggggtgtcttcctgcttgaaaagcttttctttctttttttttttttttttttgagatggagtctcactctgtcgccaggctggagtgcagtggcgtgatttcagctcactgcaacctccatctcctgggttcaaaggattcttctgcctcagcctcccgagtggctgggactacaggcgcgtgccaccacacccagctaatttttgtatttttagtaaagacagggtttcaccacgttggccaggatggccttgctctcttgacctcatgatccgcctacctcgacctcccaaagtgctgggtgtgagccaccgtgccaggcccaaagctttgcttttctttgagtactcagtcaacctttttttgtcagccttttgagtctgcttttccagactcaagcagaagctgatcacagtgattaacgagacattaccagtccattcagactataaagtataaccatgtataaatttcctcacctactacaattacatattcatctgttgttcacatggtgagtctttgaggacaggggtatgcatctatttacctttctccttgcagcacctggcttctaaatatatgtgggctgaatggacaagtgttttccaatagtgattatcacatggcatagacatacttggatcaaaggccctaagtgttgggaattacagtcacagcagccacttgctactgaggcagacatgcttctccatttcaacaaacacactgccaagataatcatttctctgatgtccaggggaatctatccataaaatggttgctcttttgcaactgaaaaggtgttgcatgtgacacagtattgagtgtggtaggcagaacttaaggtgcagattcagagaccgaagacttcacatttctatttttttttttttttttttttgagacggagtctggcgcttgtcccccaggctggagtgcaatggcgcgatctcggcacactgcaacctccatctcccgggttcaagcgattctcctgcctcagcctcccaagtagctgggactacaggcgccctccaccacacccggctaaattttgtatttttagtagagacagggtttcatcacgttggccaggctggtctcgaactcctgacctcgtgatccgcccgcctcggcctcccaaagtgctgggattacaggcgtgagccaccgcgcctggccacacatttctagttctagccctcactgtccccttcctcagggatcatcttttttttttttttttgagacagcgtctcactctatcacccacgctggagtgcagtggtgcgatctcggctcactgcaatctccgcctactgggttcaagcgattctcctgcctcagcctcctgagtagctgggactacaggcgtgtgccacctgcccggctaattttttttttgagacggagtctcgctctgtcgcccaggctggagtgcagtgatgcgatctcggctcactgcaagctccgcctcccgggttcacgccattctcttgcctcagcctcccaagtagctgggactacaggtgcccaccaccatgcctggctaattttttatatttttagtagagatggggtttcaccgtgttagccagcatggtctcaatctcctgaccttgtgatctgcccaccttgacctctcaaagtgctggaattacaggcgtgagtcaccgtgccgggcgtaatttttgtatttttttagtagagacggggtttcaccatattggccaggctggttccgaactcctgacctcgtgatccacccgcctcggcctcccaaagtgctgggattacaggcgtgagccaccgcgcccagacaggaatcattatctttgcgtggcagggcattcattcaatttggatttttgcagatgatgataatttatacggtgggtattcaccatgctatcaaaacagattaacttttgaacttctaagaaaacactagtcagtgcacccaccaaaccacaatttcctttcctttttttttttttttttttgagacagagtcttgctctgtcacacagtctggagtgcagtggcgtgatcttggctcgccacaacctgtgcctcctgggctcaagcgattctcatgcctcaacctccccagtagctgggactacaggcatgctctaccacgcccagctaatttttgtatttttagtagagacggggtttcttcatgttggctaggctgatctcgaaatcctgacctcagctgatctgccctcctaggcttcccaaagtgctggaattacaggcataagctactgcacccagccttctttcatctttttgtctttcatcattttatgtgctgggctttctttttacattttatttattttagtaagaaataacttccagtgtaaaagtatgtgtaagtatgccaccttctggataacaagagggggtaaagatacttatatgtagtttcttgtaactctgcagaacatctttgtaaggatacagaggaatgagggaacactggttacctcccaggagaagagctgggtgtctagcaggcagggtgagaaggggactttttacttacacccttttgtatctttgggggtggcaccatataaattatctcacttccttagatatgcaacacaagctaataattttatgtctaatattttgaaggtgttattcaagtgccttcccatgaatgttcctgccaaattaacatagctgagggaaaatagggcttaggtacttggtcagtaaatgacatctgtggactgtgagggaggaagttcaactcagttgtctaacatctcttgggttttatggtcattttctatttttaaaattcttttattttcttcctgattcaattaacaagtttttatttagtgcctactctttgcccagtactgtcctaggaatcctaggagatataaaagaagccgtcatgaaacaacttttacagttcttgccaagtgtggagatcactgtggaatggtgtggctagaaagtcatcctggaagcagagtcttacttgcagagaagcagaaggcttagacaagtggaaagagggcaggaggggctgctggccaggggcaaagcttgacaggggcagaaagcgatataggtggtcagagaggcccgtttggaaagtccctataggtcaggcagaagaacttaaccttgggagtccattaagagtgataagagaaggaagcctggtattagcaaggaaataagagagaactgagaaaccagatgccaggagaccacccttgttgcaataatccggatgtaaaatgatgagggtttggatttagaatgttccagggggaacagaaaggaaacaaagaattcatgagacatttcaaaggaggaaataccaggtcttgatgacaggctggagatgataatgggagaagtcacacatgattccagtttttctaccttgggaagccagcaaagtgacttctttttagatctcttttctttgctcacacacaaattgaccccctcatagagttcagttgaaatatcaattacaaacagaattgatctattttttttcccttagaaacacaggtaatcttatttgcctttagctaaacgacccaagatgcaccttgctgggctttgctcttggatagcactcatacctctatgacaatgctccccactttggccttgtactgcgtgtgtggtgtgcaggtgcgtttatcacccactaaaccaaaagtccgtgttgtgcagggaccacgtctcatgcagagttaagtattcaaaagtttttgttaattgtttaagaaaatgagatttacatgaaacaatactttaaaaagctttccagaaacaacagcattaaaacaaaatcactgaaattaaaatttacataaattaaaaggttctgtgttccacatgccaagaaaagatcttacactattgtaatagtggtagggtcacacagttttattcctcagcttaagtgctgcaatacagtaataatgcagtacaagaatactgtataataaaccttaaacgaaacacttcatatatactttacacaagttattggatattgcttagtatttatttcccccacccctgctgtgcaaagatattaatatccctcttttataggagaggaaacaggtaaagagaagttaagaaacttgcacaaggtcatccagctagtaaatgttggagctgggatttgacaactttgtcaagtctccatccttaacagttctgctctatattgcataagcagacagctcccttttggggactgacaggttatttgaggcatatgaaccatttttggtgggggggctttcccacccagtactggaagtgtctagttatatggggcataaccttaggagcaagcaggaaaagaagaaatgtattccaatagtgttcagaaatataccagagtaaacgaataaccatcaataacagcattttacagcctacctaataacacaggaataaaaccctttatctggaacctaaataataccccctccactcattttattaaaagccttgctttatttggaaactcttaaaataagtggtcatacgattaaaaaaagcagcggcgcgccccctccccggcggccgggcgcagctgtccgcgcctcccccgcgcggctgcccgcattccaactctctgaggtcacgggccgccgccgcctccccggatccgcccgcccggctcagggggagggacgcctgggcccggccgccccgctgctccggccgcgcgtcccgcgtcggtccgacggtctgtccgtcctcctgccaccccccgcccccacggggcttctttgtgcggcgctcctcgccggccggtcccacctccaggcctcgcccctcgccgtcgccaccgccggactctgcccaggggaatggtctgcgagccgggtttttggagacaggaagtgaggcgtgcgagccccatgagcgcgccgcggcccgggctggcgtgcgggtgcggctgcggcggccgcgcggcggggccccgggaggcgggtcgctgagcggggcgckcggccccgaggatgcgggagcgggagcgggagcaggtgagggcgcggtccccggccggcgggaggggcgggcggctggcccgagcggtggggtgtgtccactcgcccggaccccggagcgcgcccgcggccccggaatcccggagaatggggcgcggcggccagacccgtagcgggagcgtaacaaagagaaaagtcttgtttttcaggttcgctctcatatacttgagtaatttctaaaaggagtcttgaacttctattccgaacgccctggccgattgttgcgggttaattctggatcaggsttttaaatgtgttaggcatatttgtgcctctcagaatatataaacgtgaaattcgccagataactttggcgagaaggggcgcagggaaggactgtttggtaacgcctgggtttgtttttggagtagagtatttactctggaaacaagaattcttggatctgcaaattccgacttgtgatttctgcaaatcctgattagattggccgctcttggcatgctcgtcctattttcttttttgctnagaaagccttatactaatagcgtatgctcacaaacacattcagaacattcgtgtgctccaagtgacaactgctgtatgcctaatagttgctgacagtttatttatttttttaagtttgggacacgacagtaattttactctgaatatagtccgtttcgtttctagggcattttattctggagcatctacgcacagatgttttctccgtgagaaacatgggtttaatgctatagctatagatattactctaaaaatgtcacatactctctccttttagtgcttattttattttaaagcaactttggcaaaattacatgtggtaaggaccttaataggaaaggggaaacgctgtaagattgagaggtaaagtgtatttgaggaacttttggaaagggttgtagagagggaaaattaaaatgaattcacaaatagttcagactgccttttgtaaacttgtactgaagcagaatctagtatgtatctgtttacttaccacaaaacggaaagattttgtagagaaaaaattatatcctagttttcctttaatagctatttataaattatgtttactttagtaaattataattccagacccaatcactttcatattattgcatattattttatacctgaaacagacctccccaaagaactcttaaatttctactcatcttggttttattatcttcagacattcataattgtattacaccatttggcaacaaatactgcatattactgaaaattaagatgtataaatcattgataaatttgtaaattattaaacaaaatcattgttttaacatagtgggttttatataaataagcaaaaagcaagccattcttatggatagatcttggggggatgcaccatgtacacacacactgcaactttttcaatttcatctaccaaaataagagataattttgacttttcctttatccctgatgcagtaatacatttcaagtctgagggacaattgaaagttttactgagtttgcttaatcagagcttaagttaataattaagttatacagtgtagtatctattgctttcaaggcatagttctatgtagtgaaaagactaccatatttgaatggcacctaatacaaatatttatctttcctctacacatatgcaatatcttgtctgttcatctacactacttaatccgcccggtttccagttaccataatttttatgtaaaattgaaacccaccatctgatctcatgaaagggtgtttagtatgcatatttataatccttaaatatttactcttggtttatcaattttctagttaaaagcttattatttaaagttgtcatttgctaatttttttccatcttgctttacttatttagtttatacccctgaaacagcaaagagcattgaaaactactggaagtggaaaccatatcttttaatacttattttctgtttccctccatagtatggtgcttttacctacagaaggcactcagcaaatgcggttaattaacacagtgctttaggtagttgcagcgttgtttttttcttctggccttcccctatcccttgtttttaatattttgattttcctggctatgggaaataaccagagctcaaaacaaacaaaaaaactagccagataaaaccgtggttgggtccttattagagatacagctctgtatgtaattatagcatggttgtaatctctttaaagacagcgacggtttagggattcgtcttagatttctcacgatgctcattacgctgtcttgttcccagagacgcartacacatttgtggaatggaatttcaaaatgttaagtttggcaaagccgagggtagtagcggaacccttttctccaggtctgccattccctaaccctaagtgccccatcacctctgggcctgagacgcagtcaggagagcaggacccaggagaggactgggactgtggaatttgggatcgattcccagctcagcccgtcctagcgtgaaactgcgaaagccgcttctcttcctgaagcctgggttctgtctgccagatgagagggtcgggaatagatcttgcctctccgcgcggtcccgggccggaactcagcgtagccagctatggctgggtctcgctaagcgattcatccccaacaggcaatctctgcgcagaaggaaggtagggaaccgtctcaggaccctggaaatgtccgggattttgtagactcgtttagggggaaaaaactaatccagctgatataaaaatccccagctagtgctcgccccagaaaccatcaacaggtctggttaaaaactgttagagcccggcttggtggcgcgcacctgtggtcccagctactcgggaggttgaggcgggaggatcgcttgagcccaggtgttcgaggctgcggtgagctacgatggcgccactgcactccagcctgggtggcatagcgagacttcgctctataaaacacgttgtaaggagcgtattttgaggtcctgtggctccaaagcgggcatcctatggggcccgcccancctctccaccgccagtagggcacgcgctggtccctttaaatgttcccttcgggagccgagggaccggtccttttagagcgcgtccgtccagaaacgcggctgcagaaagagggttccggggcctccgagtctactggttggcctggcaacgccgcgtgctcttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtggtaaatggataacgagcatttgtagggtcttttatgatgtttatcagtaaatcaatttgatgacgtaaatacttccacaagcgcttgttaggcacctcaccgggtttgaatcacacacctgcctttcttagtggggattattcctcccatttgccttcagggttaattttctaaagggattgggactgaaacctagctcttttggggccatttggcacttttctcacttaaggactaaagaactctgacatttggagtattacaacctgaaagagttacctatgaaaaaacaacaccttatccaaaataggaagaggatcacaattactaactacaaaatttrggattatagtagtgctggctattatctcatttaatcytgaggatggcccagtttgctatccctatttgtaggatacagtgaagggtggagtctgaccctgagcctagcacaactctgagataaaattccaccctgccttccgggtcctgttagtgccttttttccagyggagagggacggcttgttctttggccacagcttgactggcttttctttatanaagcaaagcccagcgttacgtttrcttaactaacggcgttcctctttccccagcgctggcgtcaatgctcccttcctcgggccattggagactccgttgctttttaatggcggcagcggctgctgggtgagcagctggaggccggacagtgttcgtcccatncggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtaagccacctaaagacactgcaggccaggcgcgggtggctcaagcctgtaatcccagcactttgagaggccgaggctggtggatcacctgaggtcaggagttcgagcctagcctggccaacatggtgaaaccctgtctctactaaaaatacaaggccgggcgcagtggctcacacctgtaatcccagcactttgggaggccgaggcgggcgaatcacaaggtcaggagttcgagaccagcctggccaatatggtgaaaccccatgtctactaaaaatacaaaaattagccggacgtggtggtgggcgcctgtagggtgtggtggcgggcacctgtcatcctacctactcgggaggctgagacaggagaatcgcttgaatgtgggaggcagaggctgcagtgagccgagatcgctccactgcactccagcctgggctacagagcgagacacctgctcaaaaaaaaaaaaaaattggctgggcgtggtggtgggtgcctgtaatcgcagctactggggaggctgaggcaggagaatcacttgtacccaggaggtggaggttgcagtgagctgagatcacagcactgcactccagcctgggcaacaaactctgtctcaaaaaaaattaaaaataaataaaaaaaacacgacaggcttctctggcccgcatgctggctgtgtgttctagcccacgggccactcactgtgtgtccctggctgggatgtctgagttgagcctgtagtcccctcctcatgaagcaggaatagattagattaagaagtctccccttggggtgccctataagaactaatggttcttattttgaatatgtttatattccccctctaaggtaatccagaatcaaatgtgaatacactttgggttgttcaaatttccattttctaatatacccccaaaggtcatcctgatctctagtacagtttactgacttcattctttcttttttgttcattttaatttttttagagwcaaggtaggtctagctatgttgcccaggttggtctcaaattcctaggctcaagcgatcctcccgcgataggcatgtgccaccatgtccggctcttgacttcgttctttcaacattcattgagtaaaattcattgactatattcttacaggccagatcgaggttctagaaacatactgcctgaactcagtttgagttctagtttcctcaccatctgcttctgttaccttgggcaagttatgtgatatctctgagccccagttctccatctgaaccatggggatgactgtgacacctaattctcagagtagcataaggttgtaagctctgctaactagtctattagagtaccgattgggaggtttgcccaggaaacccctaatctagttggtaggaagttatggagtactcatgtatccatataatgtcttaaatttaaaatgttatgcaaggcctgtgaagaaaggtctctaattaaacctaggaccctccctacctttggctacctggttcttgggtaagggaaagttagagaaactggttattccacctaaaaagtcaggaatagatgaactttgctcctggtgaccatccaatcacttatatgatcactcagtactgaagatgcgtaagtgccaagcacatacatacttggaagctcaccctagtgttgttgccagtaagaaaacaggcatgatgcatgctgtgataagggaagtagagggtgtgctataggccagagggaggtgcagcaaagggaaggctgctcagggaatttgattctgagctgtgacctgaggatggggcaagggagtcctatcaagggctggaggagttccaacaaagagaactgcacaggaccaaagacgcagaggaagctggtctgcctgaagcctgaagtgcgtggaggaaaggccgactgtaagggccacacaatgaggattttttgttaaaggatttagatttatcctgagggtagtggggaagttaatgaagggtgtaaacaggtgtggtacgattgtttctgtgaagagtgagccctttggagaatgatttgaggggagtggttcaggtacagatggtagccacctggagttggatagggttggagagaggtggttggaatctggatcaggacctaccgagtaatagagaagggwtagcatgggtcctggttgatattcaggttttcagtagatggtggggctataacagagaggaaatgtgaaaggaagtgcagatctattaggggcaaggaggagcgtgtggtgagttcagttttagaaatactgagtttgaggtgccagttggaggttttgaatagacagatggatctgctgatctggagttcaggcatgagatccaggttagagggaagatattgggaagtatcagcctaagtgagttcattaaagccagaagatggtatgaggctctccaggggagaaaaagaggacatcgcagacccctcatggtagattagaggaggggaaagtgttggaaggaaactgagatgaaactgccgaagaagaagaaagaaaaccagaacagcaggcctcagtaaccagtccctgcttacttgcatttattcttttttagggatgaggtctcactccatcacccaggctggagtacagtggcaccgtcatagctcaatgcatcctcaaacacctaggctcaagtgatccttttgccttagcctgccaagagctgggactacaggtacactccaccacacccagctaattttttttttaacttgtgtttttgagatggagtcttgctrtgtcgcccaggctggtctgggagttgtttcctctagttatcttcctgcctcaactttgtgagtaggtgggattacaggcgtgtgccaccttgcctggcttagtggcttatattctatttatttatttatttatttactttggttgcttcgactttttttttttttttcctattatggtttcttcttcctgtaattttcttcctcgtgcaccaggtctgtctataacgcctagagagtcagcttcttgaggaactgtggtttatttatttttataccaggtgtggaatgtgttcagtaaatacagggagaactgaacccacaggcattgccttccttctgttaataagtccagagaaattgccatcccttgttagaagttatcagtctcagggaacaagtaactttatatagctgtgggtatattttgagcctgatttttaacagaagaggaaacaggcatggtccctagaaaatgttttgcctgtggagagtctgtcccacaatttccaacataaatgtaacagtcatgggtagaaagtttgtatagcaaactttttctttgaaagccccagaagctctgctctgtagcatataaacagatggctcaggcatcaggcctaatcttaacaaatgactgttcagaaataatctgagtggggtcacacctgtttctagtttgtacatatagtctctgtgtgattcataccaagaaatatcagtatgttggtttcttgcactgttctcccaccaagcaaatctggaattatcgcatatagatttgggtggaaaactttgctactgtccaaatataaatggagggaaaagtccctcttgcttaattgaataccatttcacttctataatgacaattttttttttttttttttttgagatggagtttcactcttttgcccaggctggagtacaatggcgcgatctcggttcactgcaacctctgcctcccgggtccaagcgattctcctgccttagcctccccagtagctgggattacaggtgcctaccaccatgcccggctaatttttgtatttttgtatttttttttttttttaagtagagatggggttttatcatgttggccaggctggtcttgaactcctgacctcaggtgatctgtccaccttggcctcccaaagtgctgggattacaggagtgagccaacgtgcccgggcctataatgacagttacaagggccgcacaatagtataacactatacccaggggtttcagctatatcagtagtgtttcttacactgggtatatgggtattttttttgtttgtatttttagctgtcatatttttacaagtgtctaagatattttgtattaaattaaaagcaacgtggttaatatacatgtatccaatgtagttaacttaggttgctaactttcttttaaattcaccatatttgaactacagaaagtaacttctttttttttttttttttttttatttgagacagagtctcgctctatcgcccaggctggagtgcagtggcgtgatctcggctcactgcaacctccgtctcccaggttcatgccattctcctgtctcagtctcccaggttcatgccattcttctgtctcagcctcccaagtaactgggactataggcgcatgccaccacgcccggctaattttgtatttttagtagagatggggtttcaccgtgttagccaggatggtctcgatctcctgacctcatgatccgtctgcctcggtctcccaaagtgctgggattacaggcgtgagccaaagtaacttttaaaaatgggaaaatgaattattcccttaggaaaatattgctgttcgttatagcagtagtttctcaaagctgttgaaattccctgcctatcattcttctgagtttcaaaacattttttcaagagaggctgtgagtccttgtggaatttaaggggagctagaaaattttctccaattttaaaagcatatgctgtagaggcttgaaggaggtggtgacacaagtggccacctgggcatgggcactgcctggggcatcaccttgacggaatcagcacaatccagagtgcaagagtcaggctcaaaaatctcatgtcatgggaagacctgatttaatctagctcgctaaaaatgatgtgtaaaaccaggacccaagtttagtaatttataagcagtaaggaactgccaagggtcccaggtatgtgtgccctctgcctaggccaagattttcctatagttagggcacatgggaaccagaacaaaccagaagtttcttggtgaacatggaatcagaagaatgttaccttgaaaaagtagatattttcataagtcggccaggcgcagtggctcacgcgtgtaatcccagcactttgggaggccgaggtgggcagatcacctgaggtcaggagttcaagaccagcctggcctggccaacatggtgaaaccccatctctactaaaaatacaaaaaaattacccatgcgtgatggtgtatgcctgtagtcccaactacttgggaggctgagacaggagaatcacttgaatccgagagacagaggttgcaatgagccgagactgcgccactgtactccagcctgggcgacagagtgagactctgtctcaaaaaaaaagaaaagaaaagaaaaagtacatatttttataagcagagaattgctgcctccaggaccagacaaattcctttgagtcagggcaccttttcctctgcgcggtgcttcagtggtgcttcagtgcctgtctgcctcttgagatggctgcttagtaaagtggttaagacagtctgcagtattcagaaacacctaggttgcatccaagtgctgtcatttaagtaattattaaatcacttaatttcccaagttcattgatttttcatttgtaagttggggataataatagtacctacttgatagtggttatgaggattcggtgttaaatgtaaaacatttagcaaaggacctggtatttgggaaactctcaataagtgttcttctttattaccatttttgttgatgttatgttattgttattagtgactcctatcccctgttgtagtaactgaccaaattctcttcataggaattcttttcttttctttttttttggtgagatggagtcttgctctgttgcccaggctggagtgcaaatggcgcgatctcggctcacagcaacttccgcctcccgggttcaagcgattctctcacctcagcctcccaagtagctgggattacaggcacctgccaccactcctggctaatttttgtatttttagtagagactgggtttcactatgttggccaagctggtcttgaactcctgacctcaggtgatccacccaccttggcctcccaaagtgctgggattgcaggcaggagccaccgcacctggcctaaaaagttttttaatcctcaggatatggggaagttgtgaaaccatggaagtctcttcaaggttatttttttcatgtttttgctgtggtatattgtgttagttttataacttagaggacagttttctttcagctgtttctgaggggggtgtgtgcatgctggggcgtctttattgttgttcccatatatggccttcatacataactattgttttgaagttgagttaaatactgagccactgctaaaaattacctccagggtattttgttgaagatgaaagtctagcaaaatatatatagtggcctctcatttcttaattataggctttggtttatcatagatctttacgaaatgttttttaaattgtgtgtttagtgcgttacacacaatgtcaagtttttgttccatagactgtaagctccatcaaagtaggactcttgttgactggagcattgccagggtctgggatggcaccttgcacctatgttgttgctgaataaatgtttacttagtttaaaaattaagagtttagttttgaatttagattgataaacatggacagcagtacaattaagtcagcctttgtttgctctgattttatttcctggagagaggtaaacatttccaaagttttgtatacagatagaaaagcaccattttctttagactcttctttttcactttggggcttcttctgaaacacttagaaagtgatctagttgtagtggctccctgatgtaagattgctgtgtcaagggagtgtcagcttcctcactggactttgaacagatacttctcatagcaccttatggcagatggggatattttttcgctaggggatttgttagaatagagaggaatcaagcatataacgcaaaccataaccctcaagcacaactttagaaagtgttcttggccatcaaagtgttttattttaaattagtgtcttaggtattccaaatatccactgaccttatcttgactgttatctgagtagacatcaagaatttcatgcttatttccttgtgtactagctgttttcatttggactctaaaaatagctgatatatatgtaaagtaaaagtctagtacccagaaacttttttaccttttgggccaagtagttattcatttaggtatgtacgttataaaacaagtaagaccgaggtagagacaagaatctgtgaatattttcagttagagctattggaccgtctgaagcaaatataatgttaggttggttggcctctcacctagatagagaaagctttcccaagtctaacaccaattataaatgatcagggatttttcttgatgtttaggttttgttacttttcttctttggtctaggtaattaagaattagccatataaataagtatggaaattacacatacaaacatggaggatatgcattttaaagtctattctacaatcacaagttattgcagaatttggaaacctgtttatttgaagaatagagtattattcaacctagacttagtgcctaataaacttaaaggctaataacctaagatgttttcctttcagtattggatttttcccttgagataccagatgtccttattttcttaccatcagtctgtcacagtagtgtagtctcaggaccatgtggaattaagcatgaatttactcattcgagatttgtaaggtgaattacaaaatggtggacatgagggaactgatggtgttttgggggctctaagtgctgtcactgtctttggtgtatagaatcagattccattccttctaatatctctagaagctttgactttctgctgtctccatttgggtaaatgagcgttattgtgctggaagctttatttacctcatttaatcttcacaatgagttaggcgttgtattatcttttccattttcaaattaggaaactaaacttaagaaaagtttgagtgattacgtagctaataagcaaaagacccaggatttgagattttatatcagacttctgctcgaactttgacctttaaatttgtggcggtcatggacccctttgagatctgatgcaaacacagaattttgtatacaatttcaggtggttcatagccactctctcccccaagtccatccatgggcctaggctgtgggcctggaggcttcctggttaaggcagtctttccctttttctccccttgtcacagagcaggatctttcttccctggtcttctacttcccagagtgaaagatgctggaaggatggaatatttgtgaacaattcaagaccttcataattaaaaaataataatttgcctctgaatatagagcctcccctcgctgacccttctactacagatgccctttttttctttggccttcatctttaggtctcaggaagggccattcattgctcagtgggacaacttactattaaggaaaaagcccctctcaggggggacagaggggaggtcatgagtgggaattcccccactgtcctgctgatggtagatccatgtctgtcttccctgctaggcagcaggtatgtgatgcatcttcaggaattgaatggatgattcattcttcctttatacattaatcaagttcccaggccaattgttgagccctctgtatcattcttcttgtcagatacacactttatgtgaatatggcattttcttttctattaacaaggattcatcattcttttaacagtatgccaatttagcraatattttcctattcagttctctgagcaatttgttcataaacaaatgtcacttagatttcctttatcttttaatgaattgacagaacatacagaggcaatttaagtttttgcctaagatgctaacattactagaagaaactgtgtatgtcacaaatccttcatgaggattggtagcatgtagtagaaataacttcctatcaagggtttgtaccactttctatagtagattacccaaatatgatcattaaaaggtgtatagtgttgagatttatatatggggcagagtagttttgttattttaaataagttttgacttattttgcctactcaggctaagaaaatatacgggtaatctcatgctgagtggcaagctcatgtgaatctaaaaacaacttattggccgggcaaggtggctcatgcctgtaatcatagcactttgacaggccgaggcagtaagatttcttcagtccaggagttcaccaccagcctggggaacatagtgagaccctatctatacaaaaaattaaaaaattagctgggcatggtgtcatatacctgtagttccagctactctagaggctgaggtgggaggatcacttgaacccaggaaggcaaggctgcagtgagccatgatcatgccactgcactctaacctgggtggcagagcaagacactgtctccagaaaaaataaaaataaaaacaacttgttatgttacagttacttagatggctcagacttcgttgacttgtcaaatgaacctcaatgtcaagtgaattttcagcacattgaactttataccatttgattcaactacatttggcaaagtggggttttggaagaaaagaggtaaagttttggtgctcaatggacttgggttcaaatccctgcagactacctgtgtgaactgaggaaaccaacttccctgggatttgtttcttttgtatgtgatatggctgcatgtaatagtaagaatgatagctctgcattgggtactgaccatattccatgccctgtgctagttgctttacatatgtgtaaccctgtgtataatcaactttgtttcctcccaccatctcgttgatggagtggaccaaagaccaatagcatccataggacactcattaactggcagctcttttttagtattctttagccgtttccactttctgtttcatcatgtaaatttgttagttggaataatacactgagggataataatggattggagaaaaatcactggagaggtattattgttaagtcaggcaactgagttcagagctgcactgctgagaattaagatattcaccataacatcctttctcttcctgcaagtttggtatgaaatatctagaaaataaccttctcagtcccttgtattttgcacttagaaataatatgtagacacttgcatacttgattcgcctgtgtttttatgattgacacctattttgaagtcaaatttatgcttagtgacttaaggaaataacacttaaaccatacagtatgataacagaaaaatgaagcatgtttaatagtgaatatgtctaaaattgtattattattatttgtataatgtatgctacccttcaatagaatgcagatttctctgtatgatgctatacaactaatgcctggctagggcagctagttggtgacagccccctgctagaattcaggtcttccagctcttgttttagcacttttctctcaatatactgcttttccatggagccattgccattttcctaaaagaaaagcaatccaagtgttgatattgtctatttactttaaaaggaaataaagggaaagaaggccaggcgtggtggctcatgtctgtaatcccggcagttcgggaggccaaggtgggcggatcacctgaggtcgggaattggagaccagcctgaccaacatggagaaaccccatctctactaaaaatacaatattgctggccatggtggtgcatgcctgtaatcccagctagtcaggaggctgaggcaggagaatcgcttgaacctgagaggtggagcttacattgagtcaagatcatgccattgcactccagcctgggcaacaagagcaaaactatgtctcaaaaaaaaaaaaaaaattaaccgggcgtggtggcagtcgcctgtaatctcagctactcgggaagctgaggcaggagaattgcttgaacccaggaggtggaggttgcagtgagctgagattgtgccattgcactccagcctgggcaacagagtgagactccatctcaaaaaaaaaaaaggaaagaaaaggaaaagttcccaaagatagaatcctattagtgaaggaagtatttaagtgtaggatctcctctactaaataaatgtaatacgaaattttatactgtttaaagggactagaaaaccatgataagaagatctcgtattacttgagcacttgtttgcatgagacacttttgtaagtgctttaaatgtttttgcttattttgatcttcacaaaaatcctgtatatgaggcactgttatgctcatctccattttactgatgggaaaactgagacacaaaggtattaagtgacttgctcatggttacatggcggaaaccacagctagagtagttctgactccttgaacagcatctttcttcctggtttataacctttgacaaatgacaggtggcctgctctggagctcatgcccttgatgacagcctggctcagagtggcctcctaaatgtgacagtagtttttgtaagtactctggagatatttgttatcatttaatttttgtatttttacaattatcttgcttaagataggtttttgcactcacgtcaggcaaagaaaggtaagcatgagaaggaacatgagtgtcattaggcccgcaagacactgttggggaatccccagggtgtttagggcagagctgtttgatgagaagcctttggtgagcttgttccctggcagagttggaagtatcagactgatgaaatacatcccaggagtgttctctgctgagatattttccaaagcaatatctgcttgcactactgttagatgaatttggtgggcttctagattcagattcttcatccaagcaaggagaaaggtagaggcagtgagtccgttgaagtgctggctgcctttcgtgatgagcccaggctgtgactgaagaataagaagttctagtttatctttggttatgtgggtcgtaaactaaacaacctttatatggtagcacatagagcatattagcttttgactgtattgaaactttgtgcagtaacatctcaattatccctgtcattcttgttggttatatatatacagtcatgtgctgcatatcacatttttggtcaatgacagactgcttataagatggtggtcccataaaattataatactgtatttttactgtacctttcctatgtttacataagtgtagatacacaaataccattgtgtttcagttgcctacaatattcactacagtaatgtgctgtacaggtttgtagcctagcagcagtaggctatatcacatgccctaaatgtgtaggaggctataccatttaggtttgtgtaagtacactccatamtgttcacacaatgaaatagcctaatgatgcattcccacatcgttaagggacacgtgactactaaaatttcccctttaatcctagtttactctttaaaaacatgttgatattgtcttaatcttataattcaagatctttctccatagcacttatcagtatctggcataatatatattttgcttgtctatttttccctattggaattaagttacgtgagggcaggaattttgttctcatgttcaatgctgtattcctagttcccagaacagtgattgacatgtagtaggtattcaatcaatattcattgaatgaatagatgaatctttctaaacattagtccagttaaaaatagagtatatttatttgtgtttcagaggcatcatattcatagcatctcattgtccaggatagtaaatagaaaagagataagcagttcatccatgtggacagtaatctcagtttgtgcctcctactgtctttcagtccctgaaattgtcttatcatttgactcttccttaaagataaatgctacagcaacaacaaaaatctagccacacgagaagttcagttacttggacttcagtataatttcagaataatttagaaggtcaagatgtactcttgattattttcttgagtcttcatttagttgtaatagagtataatgatattgcatattaccactttggctgtaaaatatatattatttgatcaagtatagaagaaaactgattaaaattaaacagaaaaggaaaaaatgctgcctgctttgaggcaatgtgaccgccactatctgtcacaaggaagaagtacgatacttcattatttatggcagactctgtaaaggtaagctccaggcttgaattaggttaatacttgttaactacccttgttagatgatctcttcccgggatagactttatctagtgctatcttctgtcatctctttcctgatgaaaagtcttctgacttctgcctagtctaagaaaggcatcaggatgaaattatatttgcaattttagatgggattaacttttatcaacccaatgcatcagtggctttaaaaacccttcagctaatttctgtgtccctctgctctactttaaaaatagtacaaccaaaaagactcttaaaataattagacgagaaatgacttagggattaggaaagggtttacattctgacaggatttggacctgcttttaatagctgacgtctccttaggggactatgatttgggtgctgcacattttttccccatctcaaatttgtaaactctcttttgctttgaacaaaaaacttggttatcaaatcactttgttctcagtcaacatcagttcatgtaaagtaagtcaaccatattgtgctgaaaagaagccaagtttgttttaacttttatttttactgtagtttacaaagcaggcacagttatctgtacaattttagaagagtagctatgaaaaaattttaaacaactatgaagaaatcattgaataactttttgaaaactatcctgatatgtttgttcataacaaaataggaaaggaagggagaatgtaaacacacctgacaatgaaagtttcacaaaattctctacagtgactattgagaattgatctaggggatgctagaagattcagtgatttaacaacttctgctggaatgagtttcccacaggtcaagtcaatttgctttgatcaccagtgagagtggatgcagctgtggagaaagagaagccacgtggaggtaaagtttcttatcaggaaaagcactggaaagttatataacaaagtgtggcaggagacatgaactgaacgccaataactaaaggctgtctgctggaaaacttctgttacaattaaacgaactccattaacaggacgtgcatagtccagaagatttggactcaaggaagagaggatgtgtgcttctgggaagatatcctagaccaaggcagtagttaaaatttcaggcacatgggcctgtctgtagcaaagtttttgcctttcttttagtaaaagtcctggtatgttcagactttaaaggaagaaattagtttgactgttatttgaatagtgatattttcaaggaagaagcatgcttgattcaagttttattctattttctgtcatacctgaagagatcctatctgctaaatataggtaccatgacaaaggtaagagtgcttttcagtattatcagtacgattagaacttacaaagttcttcaccacaattttgaggaaggaagagtacatgttaaattccctattaagaaacagactcagtgaggaagtgagacattccagagctggcaagtggtaaagtcaggactcaaaggccgagccttttgcctgcaaatctagtgctctttgtaccacaccatgctagtggcagctattggaatctcaggcattgtcacccgggggaaatacagccatgtgtcacttaaggacagggaaatgttctaagaaattcgttaggcaatttcattgttgtgtgaacatcacagggagtacttaaacctacgtggtatagcctactgcacacctgctatgtgctgtggcctagtcctggtaggctataataaacctgtccaacatgttactatactgaatactgtaggtaattatatatatataacaatggtgagtatttgtgtacttaaacatatctaagcatagaaaaggtgcagtaaaaatgtgaggtaaaagattaaaaaggtacacctgtatagggtacttaccgtgaatggcgcttgcagaactaaaagttgctgtgggtgagtcagtgaatacgaaggcctaggaagttgcactatagtagtaggacactattgtagcctctagaaacactgtacagctaggctacattaaatatatcacaattttttaattttttaagacagagtctcactctgttgcccaggttggagtgcagtgacgcaatcatggctcactgcagcctcgacttccaggctcaagcattctcccaagtagcctcagcctcccaagtagctggaattataggcgtgcaccaccacacctggctaatttttgtagttttagtagaaatggggtttcaacatgttggccaggcttgtcttgaactcctgacctcaggtgatcctcccacctcggcctcctaaagtgctgggattacaggcatgagccaccacacctggccttcgataataaattaacctcagcttactataaygtttttgctttacaaacttttaaatttttaaaacttttgactcttgtaataacataggttaaaacacagacacattgtacagctatacaaaaatatctatatccttaccctataagcttttttctattttaaagtatttttttgttttttactttttaaacttttttttttttcttttgagacagtcttactttgttgcccaggctggggtacagttgcgtgatcttggcttactgcaacctctgcgtcctgggttcaagccatttttgtgcttcagcctcccaagtagctgggattacaggtgtgcaccaccaagcgccccccgcccccccttttttttaatttttagcagaggtgggtttttgccgcgttggccaggctgatcttgaactctcctcgccacaagtgatccactcaccttggcctcccaaaatgctgagattacacgtgtgagccaccgtgcccggccactttttaaacttctgtgttgaaaactaagacacacatattagcctagccttaaacagggtcaggatcatcaataacactttctttcacctccacatcttgtcctcctggacagttttcaggggcggtaacatgcatggctctgtcatcccctatgataacaatgccttcttctggaaacctcctgaggctgatttccagttcactgttttttttatttgaaagagggtctcattctgtcacccaggctgtagtgcagtggctcaatcacagctcactgcagcctcgaacttctgggctcaagcaatcctcctgcctcagcctcctagttgggtctacaccaccacacctggctgatttttgtattttttgttgtgatggggtctcactatgttgcccaggctgttcttgaactccttggctcaagtgatcctctggcctcagtctcccaaagcactrggattacagatgggagctactgcacctggcctacagttaacttttttataaataggagtacactctaaataaaaagtataataaatgcataaatcagtaacatagtcatttattatcgtccagtgttatgtactgtacatagttgtatgtgctgtgcttttgtgcaattggtagcacgataggtttgtttataccagcatcactacagacatgtgagtaatgcattgcactgcaacttagcaactacaacatcactatgtgataggaatttttcagctgttacagtcttaggggaccaccatcgcatttgtggtctgtcgttgactaaaacattgttatgcggcacgtgactgtaattagcttctatgctactagttaaacctttcaaaaaacaaataacagcaggtaccaaaacagaaatggaaacagctttcatgtttggctttggaaaatatgcttgtacttgtaagtgaagtaatgaaaccccaattaaattggctagagtactgtaaagctttatataaaataagttatttttggaaaataagttatttcttggaaataagttatttctttgggaaatgaagcgcttcataactaactttgcctgataaacaaggttgactcctttgtccaaactatttggagtgctaagttttggaaacartttataaatttctatctgtcgtaaataaaggatactacctctgcttttaggaacagtgattgttgttgaatacatgactaattaatgtttggagttatttgtttctttagtaagtaactccagactcccatatatttgtaattctttgtaaattctatttaaggggtttttgtttgttatgtacgtgttctcctttgctaaaaagaatrttgcccatcacttccctctactgccaacttgctattattaaataagcccttttcctttaatttgtcatcttttaatctgctttggattggattaccaaatcgctaaactcattaaaagtatgtataaaataagaaaaaaaatccataaaagagataggagaaatttcttctttgtcaagggcatatactttataacattgactttaatatgtatttttgattgctcaaacacatttttccctattctctgttcttcaattatgttcacgtgaggttgccagttaactgtcaaacggcacaaaatcttgacgtaagtatagatattagaaaatagaaattgtaatgaactcataggctcgtctatttctggctcattttttttcttagacttaatgaactgaatttgttgtatttaaacattttaaaatagagctgaaaatatctgtacttgttatgtcctttcctggttttggtattagggtaatgctggcttcatagaatgatttagggaggattccctctttctctatcttttggaatagtttcagtaggattggtaccaattcttctttgaatgtgtgatagaattcagctgtgaatccatctggtcctggacttgttttttgttggcagtttttttttttttaattaccgtttcagcctcaatacttgttattggtctgtccagagtttctgtttcttcctggtttaatctaggagagttgtctatttccaggattttatccatctcccttaggttttctagtttatgcacgcaaaggcgttcatagtagacttgaatgatcttttgtatttctgtggtattggttgtaatatctcccagttcatttctaattgagcttatttagatattctcttttcttggttaatctcgctaatggtcaatcaattttgtttaccttttcaaagaaccagctttttgtttttgttttgttttgtttcaatttcatttggttctgctctgatctttgttatttctttttttctgctgggtttgggtttggttggttcttgtttctctagttccttgagttgtgagcatagattgtctgtgtgctctttcagactttttgatataggcatttaatgctatgagttaatatatatttaatgtatatttaatgctcttagagctgcttttgctgtatcacagaggttttttgtttgtttgtttttttgagatggagtctcactctgttgtccaggctggagtgcagtggcgcaatctcggcttaccacaacccctgcctccctggttcaagcaattctcctgcctcaacctcccgagtagctgggactacaggcatgcaccaccatgcctggctaatttttgtaattttagtagagatggggtttcactatgttggccaggctggtcttgaactcctgatctcgtgatctgccagcctcagcctcccaaaatgttgggattacaggcgtgagccactgtgcccagccatatcccagaggttttataggttgtgtcactattatcattcagttcaaagaatttttaaatttgtctttattttgttgttgattcaaaattattcaggagcatattatttaatttccatttatttatatagttttgagggttacttttggagttaatttccagttttattccattgtggtctgagagagtacttgatgtaattttgatttttttaaaatttgttgagccttgttttgtggcctatcatatggtctatcttggagaatgttccatgttttgatgaaaataatgtatattctgcagttgttgggtagaatgttctgtaaatatctgttaaatccatttgttctagggtatagtttaagtccattgtttctttgttgactttctgtcttgatgacctgtctagtgctgtcagtggagtattgaagtcccccactattactgtgttgccatctatctcatttttttggtctagtagtaattgttttgtaaatttgggaactccagtgttaggtgcatatatatctaggatggtaatattttcctgttggactagaccatttattattccataatgtccctctttgtcttttttaagtgtcgttgctttaaagcctgattcgcccaatataagaataactactcctgcttgcttttggtttccatttacatggaatatctttttccactcctttaccttaagtttatgtgagttcttatgtgttagatgaacctcttgaacacagcagatacttggttggtggatttttatccattctgccattctgtatcttttaagggaagcatttaggaccatttacattcaaggttagtactgaaatgtgaggtactgctctattcatcgtgctagttgttgcctgaataatttgggtttttttcccccattgtgttactgttttataggccctgtgagatttatgctttaaggagtttctattttggtatattttgaggttttgtttcaagattaagagctcctttcagcattttttgtagtgctggcttggtagtggcaaattgtttcagcatttgtttgtctgaaaaagactttatctctccttcatttatgaagcttggttttgctggatacagaattcttggctgataattgttttgtttaaggaggctaatataggaccccaatgccttctggcttgtagagtttctgctgagaaatctgctgttaatctgataggttttcctttataggttaccttgtgcttttgcctcacagctcctaagattcttctttttctttttttttttttcttgagatggtgtctgactctgtcgcccagactgaagtgcatggtgtgattttggctcactgctacctccacctcctgggttcaagcaattctctggcctcagccttccaagtagctgggattacaggttcctgccaccatgcccggctgatttttatatttttggtagagatggggcttcaccatgttggccagactggtctcaaactccttgcctcaagtggtctgcccaccttggcctcctaaagtgctgggattacaggagtgagccactgcacctgacctttaagattctttcctctgtcttgactttagataatctgatgactgtgtgcctaggtgatgatctttttgtgatgtatctcctgggtgttctttgagcttcttgtgtttggatgtctaaatctctagcaagaccagggaagtttttcttgattattccctcaaataagtttccccaagttttagatttctcttcttcctcaggaataccaattattcttatgtttggtcatttaacataatctaaaatttcttggaggctttgttccaaaaaaggctacagaccagtatccctgatgaacatagatgcaaaaattctcaacaaaatactagctatttgaatctaacaccatatcaaaaagataatacaccatgatcaagtaggtttcataccagggatgtagggttggtttaatatcaagtcaataaatgtgatagaccacaaaaacagcattaaaaacaatatgatcatctcaatagatgcagaaaaggcatttaacaaaatccagcattcctttatgattaaaaccctcagtaaaattggcayagaagggacataccttaaggtaataaaagccatctatgacaaacccagagctaacattatactgaatggggaagagttgaaagcattccccctgaaaactggaacaagacaaggatgttaactttcaccacttctcttcaacgtagtactgcaagtcctatccagagcaatcagacaagagaaagaaagggcatccaaatcggtaaagaggaagtcaaaccgtctctattcactgatgatatgaacgtatacctagaaaacccctaagactcatccaaaaagctcytagatcgataaatgaattcagtaaatgttttagtctgttttcatgctgctgatagtcatagctgagactgggcaacttacaaaaggaagatttaatggacttacagttccacatggttgggaaggcctcacaatcatggtggaggatgaaaggcacgtctcacatggtggcagacaagagaagagagtttgtgtagggaaactcccatttttaaaaccatcagatctcatgagacttattcactatcaccagaaagagctgcccccatgattcagttacctcccaccaggtccctcccacaacgtgggaattcaagatgagatttgggtgaggacacagccaaaccatatcagtaaagttttaggatacaaaattcaggtacacaaatcagtagcactgctatacacaaacagtgatgaagttgagaatgaaatcaagaactcaacttcttttataacagctggaaaaagaattaaaatacttaggaatatacccagccaaggaggtgaaagaactctgcaaggaaaactacaaaacactgctgaaagaaatcatagataacagaaacaaatagaaacacatcccatgctcagggatgggtagaatcagtattgtgaaaatgaccatattgccaaaagcaatatataaattcaatgcaattcccatcaaaataccatcatctttcttcacagaactagaaaaaacaatcctaaaacttacatggaaccaaaaaagagcccccatagccaaagcaagactaagtagaaagaacaaatctggaggcatcacattacccgacttccaactggactacaagcctatagttaccaaaacagcatggtactggtataaaaacataggtcaatggaacagaatagagaacccagaaataaagccaaatacccacagccaactgatctttagcaaaggaaacaaaaacataaagtggggaaaggacaccgtattcagcaaatggtgctgggataattgacaagccacatgtataataatgaaactggatcctcatctctcaccttatacaaaaatcaactcaagtgggatcaaagacttatacctaagacctgaaactattaaaattctaaatgataacatcagaaaaatccttctagacattggcctaggcaaagagtctgtgaccaaaaacccaaaaacaaatgcagcaaaaacaaaaatagatgagatttaattaaactaaaaggcttctgcacagcaaaagaagtaatcagtagagtaaacagacaacccacagagtgggagaaaatacttgcaaactgtgcatctgacaaaggactaatatccagaatccacaaggaactcagacaaagcagtgagaaaagaacaaataatcacatcaaaacatgggctaaagacatgagttagacaattctcaaaagaagatatacaaatggcccagaaacgtatggaaaactgttcaacatcactaattatgaggaaaatgcaaatcaaaccacaatgctataccaccttactcctgcaataatggccataataaaaaaatcaaagaataatagatgttggtgtaaatgtggtgagaagggaacacttttacactgctagtgggaatgtaaactagtacaaccactatggaaaacaatgtggagcttccttaaagaactaaaagtagaactaccatttgatccagcaatcccactactgggtatctactaggaggaaaagaagccactgtatgaaaaagacatttgcacacacatgtttatagtagcacaattcacaattgcaaaaatatggaaccagcttaaatgtccatcaaccaactagtggataagggaaaatgtgacacacacaaacacgcacacaccatggaatactactcaggaatgaaataatggcatttgcagcaacctagatggagttggagaccattattctaagtgaataactcaggaatggaaaatcaaacatcgttatgttctcatttgtaagtgggagctaagctatggggatgcaaaggcatgagaatgatgtaatggactttggggtttccaggggaaggatgggaatggggtgaatgataaaagactacagattgggtacagtgtacactactcacatgataggtgcaccaaaatcttagaaatcaccactaaagaatgtattcatgtaaccaaacaccacctgttccccaaaaattattgtaataaaaataaaattatttactttattatgaatatttctgatctttaaaaacatttttttactgagatgaaattcacataatgtacaactaaccttttttttttttttttttttttttttttgagatcatctcgctctattgcccaggctgaagggcagtggtgtgatcctggctcactgcaacctctgcctcccaggttcaagcgattctcctgcctcagcctccggagtagctgagattacaggtgcacaccaccatgcctagctaagttttttgtatttttagtagaaatggggtttcaccatgttggtcaggctggtcttgaactcctgacctcatgatctgcctgcctcagcctcccaaagtgctgggattatagatgtgagccaccgtgcctggccacaactaaccactttaaagtaaacaactcattggcatttagtacgattacaatactgtctatttctaaaacattttcatcacccccaaaggaaattctgtatcccataggcagtcattctctattcttccctgcccctagcaaccaccaatttactgtctgtctctgtggatttatatattctagtcttgaactcctggcctcaagcaattctcccaccttggccttccagtgccttgggattacaggtatgagccaccacaccttgggatttattcagatgtttcatataaacagaattatacaatatttgaccttttgtcttctggctgcttttgcttagcataatatttttgaatgtcatccacattgtggcatgaaccagtacatcattgtgttttatggctgaatgttcattgtatgtatacaccacaaacttgtttatccattcatctattgatggacatttggcttgtttccaccttttggttattgcagatagtcctgctgtgcatatgcatatacatgtgtttcttgagcacctgtttttcagttcttttgggtatgtacctagaagtggaattgctggatcatatggtgattctatatttagtgttttgaggatccaccaaacttttccacagcagctgaaccattttctgcttctactagcaatgtataagggttccagtttctcctcaccaatgtttacttcctattttttaaattatagccatcctagttggtgtgaagtggtatctcattatggttctgagttgcatttccctaatgactaacaatgttaagcatcttttcatgtgcttgttagccattcatatcttttttcaaaaagtgtgtaagtcctttgcccattttaatattgggttgtttctttctgtatgtaagagtcattttatacgtttcaagtagtagacctttatcagatatataatttgcaaatattttctccttttcttctgttctgtaggttttttttttactttcttcatttattattattattttttgagacagggtcttgctctgttgcccaggttgaagtgcagtggcacaatcatggctcactgcagccttgatctgttggggttaaagtgatccttccacctcagccacttgaatagctgggactacaggtgtgtgccactgtactcagctaattttattttttgtagaggcaaagtttcactatgttgtccacgattgtctcaaacttctgagctcaagcagtcctcctgcctcagcctcccaaaatgttaggtttacagctataagtgaccatgcctagcctgatatggttttttttgcatgtaagttctaaattttgtgcgtgtgtatgtgtgtttttaagagggtcttgctctgtcgcccaggctggaatgcagtggtacaattatagcttactgaagccttggtctcctgggcccaagtgagcctcccactttagcctcttgagtagctgggactacaggtgtgtgccaccacacccagctaactttaaaattttttgtaaagacagggtcttgctttgttgcccaggctggtcttgaactcttggcctcaagtttctcccactttggcctcctaaagtgctaggatyacaggcatcagccactgtgcctggcaagttttgtaattttgaaataagtttatctatttttttctttgttgctcatgtttttggtgttatactcaagcatttattcccaaattcaagatcacagagatttaccctaatgttttcttctaaactattttacgggtcgcttcttatatttacttaatttttatatatggtatggagtagggatccaacttcattctttcgtatgtggatcttcagttgccccagcaccatttgctgaagagagtattcttttccccactaactggtcttggcacccttatttaaaatcagttgactgtagatgcataggttcatttctagactctctattctatttgtctatatgtctctccttatgccagtaccacacagtttggattactatactcttgtaataagttttgaaacaaggaagtgtgagtcctccaattttgttattctttttcagtattgttttggctatttggagccccttgcaggcccatgtgaatttgaggattggctttttatctctatgaaaaagcatattgggattgtgataggtattgcatttgaatttgaagattactttgggtagtactgcaccttaacaatattaagtatttcagtctatgaacatgggatatctttctatttatttagattttccttaatttcttttagcactgtttagttgtgttcagtatatgccttttcaccttcttggtcaaatttattcctacatattttgttcttttggatattactgtaaatggaattgttttctttttttgacatrtacattgctggtatatagcagctgatttttgcatgttgatcttgtaccctgcaaacttcactgaatgtattacctcgagtagggcaggggtgtgtgtgtgtgtgtgtgtgtgtgtgtgtgtgtgtgtgtcacggttggggggtggatttggaggattttctttgtctaggattatgtcatctgtacatagatagttttactacttctttccactttaaatgtcttttatttttcttgcctaattgctctggttagaaccttcagtacaatgtcaaatggcagtggtgaacatgggcatccttgtcttgttactgatcttagggggaaagctttcagtctttctccatggagtatgatattagctgtgggtttttcctaaatgctcattgtcatgttaagaagctcttctctattcttctattcctagttttctaggtgttttttatcattaaggatgttggattttgtcaaatgcttttcctgcatcaattgagatgatcatgtgtgttttttttcttttgtcttagtaatatggtataatgattttggggggtatgttttaccacccttgcagtcctgggatgaatcctacttagtcatggtgtataatccttttagtgtgctgttagactcagttttttaatatttgcttaggatttttgcatctatatttacaagggatgtcggtctatagttttcttgtggttatcttttgtctggctttggtattggggtaatgctggcctatagattgagttagaaagtattctctccttttccttgattttcgtgctcactccccaccttgtttgttttttgaatggattttaaattattttggaaagttaattattcagattcttaaggttattattcaagacgagccaaaaaaaaaaaatggtcttacccaggaaaaatctttgcctgatgagaatttaatcacaatactttgttgctcaagctccacctacctattttagaaacagatgatattgtagtcataaaatctcatggaatcagatgttgtgacttgattatgtatgtgtagaaattctaagagagcattcaatccaggattataatgttacaataatttagttacccatatgtatataaacatttctagcagcaattttagaaatataatacctccttggaggtatttaacaagatataaatttgatttttggctagctttcactacttcttaagatagaacttgaacattggggcaggtcccaaagcaaatactttaactacaatagttacgcacgagaaagtcatgtaaacaatctatccttgacaagctacaaagtcaatattcagatgtcccaaatcttagactcctttatttaaaagagctaaccaacaaagaatttactaagcccacctttcttttttttttttttttttttttttgagacagtcttgctctgtcgcccaggctggagtgcagtggtacagtggcatgctctcagctcacttccacctcctgggttcaagcaattctcttgtctcagcctcctgagtagctgggattacaggcacccaccatcatacccggctaattttttgtatttttagtagagatggagtttcaccatgttggccaggccagtctcgaactcctgacctcaagtgatccactggcctcagcctcccaaagtgctgggattacaggcacaatccaccacgcccggcctaagcccaccattcttttcagctgtttgtacctttagataaagttctcgctactctcttctatggtctataatttgtgaaaaactaattatgatgcaatttcaacaaatgtatttgttcagttctatttgattttctaattcatgttgcatgagtaatagatgcactgataaagttagcatattttaacagttttcctttcagaatgtgctttttaacagaatgctagcagattgttcagctgttatttttttaaattatattacagtccattcacaaaaggtacaaccacaaattatacaataaaccagaaattttataattctgtttttgtatttggaacagtctacagtccaactgtatttaaaggggaagttaatgtattcaaagggtatttttaagaccttttcattttggttaaaaatgatgacatacagccaggcgtggtggctcacgcctgtaatctcagcactttgggaggccgaggagggcagatcatgaagtcaggagttcaagaccagcctggccaacatggtgaaaccccgtttctactaaaaaatgcaaaaaaaaaaaaaaaaaagttgggcgtggtggcgggtgcctgtaatcctagctacttgggaggctgaggcaggagaagcgcttgaaactggaaggcagaggttgcagtgagctgagatcacaccattgcactctagcctgggcaacaagagtgaaactccgtctcaaaaaaaaaaatgacctgctgttaacttaccaaaacagttttagatcctaaaggattcctaatctggcattatagaccgaatgtggtacattcagtccaaaacttgtgttctaagatggaacagaaaacaaacatagtaacagaaatgtattttgttgtaatcaaatacatgtaggtaattttaaaagtcttttgaggggaggagtcagtaattgattttgttggtggagagaatgggtgaaactaaatgatatttttaaaaatatagtggttttcaggctggcacagtggcacactcctgtaatcccagcactttgggaagctgagacgggaagatcacttgaagccagtttaagatcagcctgggcaacatagtgagaccctctcttgaccaaaaaaaaaatatatatatagcctggtgtggtggcatgcacctgttgtctagctacttaggaggttggggcagaaggatcacttgagcctgggagtttgaagttgcagtgagccgtgatcatgtcagtacactcccgcctgagtgatagagtgcaactctctctcaaaaaataaaatataatggttttctaataggaaaatgtacttaggtagttttcccgtatccaatcctcatgacaggattgtgagggagatattactttattttacacttgagaaaaccaaattagattgattgactttaccatttcactcctagtaaataactgttggaaatcaaactcagaactttggacttaagcatcaagctctttctattaaaccagatttttgttttctataagttgcagtttaaaaaaagaaaagaacagtacttgttttctataaatgtatgatacatattctrtgcttacagataataagcaattcattttaaaatgtcataacctcagaatataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgccaagtagatgagactacaggcacacgctaccacatctggctaattttttgtattttttacacagacagtgtttcgccatgttgcccagattggtctcaaactcctgggctcaagaaatcttcccacttcagcttcctaaaatgctggcattccaggtgtgtgccaccacacccagccaaagataaggttttatataactttctcttgcataactttggaggagcagtgtagtgtagtgcaaagttatcaaactttaaaggacccaagaaatacctaggagattaatagctttttagggcccaagaaaccctctaggtacttctggtagaggtagtccagggacaatacctgggggaaacactggctttgaggttttacacagataaaaatacctacttcataaattagtgatggtgatttaatctatggtatctctacagttcttggaatacaacctggcacataggaaatgttcaaaatattccattcttgtgtgatgacttgggtggcaactaagaagcaagagaatattccttctttacattcaacaaaatttattgaattccagcagtattctagggatttgtggatataggggaaaatgggcacattcttcactcttgttgaatttatttgatgaactcattttaaaggtatagttcttaccttgttaaaaaataataaaatgactattgagcacatgtttgcataatcttttcccttgcaaattaaagttttattttttacttgaatgaggattgcaggtcaaagaaatgttctattatttctcagttttcttgttgctttaaatctatactatccaatacagtagccactagatacttgcagctatttaagtcaattaaaattgtataatattaaaaatacagctccttggtggcactaccacatttcaagtactcagtagccacatgtggctagtggctgctttattggacagtgcagatgtagataatttccatcatcacactaagttctgttgggacagtgttattctggagtgtgcaactacaaagcagtgattttccaattgtcttaatctgtagattgattttgaggcaagtattagcagtggcttgaggctgtcatttcagctcataagtgcattaatatcctttcaggttgaccaggcccagggctagtattgatttatcttaacagtttcatttcacagcaagtgagatctaaatgctaagacatctgggcattttctttaaacttctgagtaatacactaacgttattttactgcattagtcatagcttttctcatgcactctgtgtgtgtgtgtgtgtgtatgtgtgtgtgtgtagggagagagagaattcaccttcacagcattataattgttttaaatgtgcatgtaatgaaattttggggacaaaggaataaagaagagttggaattgcatctgaatactagaaatggtacttacatgaaataatttcttttatagaaaccaaaactaagagtagtgaaaagttggtttaacactgcttactcagcattctactgggtagaaccccagttatgattatttaaaaatattaattatgaggctgggtgcggtggctcatgcctataatcctagcactttgggaggccgaggtgggcggatcaactgaggtcaggagttcgagaccagcctgaccaacatggtaaaaccctgtccctactaaaaatacaaaaaattagctgggtgtggtggtgcatgctataatcttggctactctggaggctgaggcaggagaatgacttgaacctgggaagcggaggttgcagtgagctgagattgcgccactgcactgtagcctgggcaacagagtgagaatctatctcaaaaaaaaaaaaaaaaaaaaaaaaaaaaaaaaaatatatatatatatatatatatatatatacacacacacacatacacacacacgtgtatgtatatatacacttatacacatatatgtgtatatatacgtatatatacacatatatgtgtgtgtgtgtgcgtatgtgtgtgtgtatatatatatatatatattttttttttttttttttttttttttttttgaggtagattctcactctgttgcccaggctcactctgttgcccagaagaacaacagcaaaaactgaaggaaaaaaaggaggtaagacctatctgtaactagctactcatattcaggaaacagaggcaaaaactcaattgctcttgcatatcatttactgaactctgaaccaaaaaaatacattcacgacctagacactggaatgtagtgggggctactcaattttatatgcagattttaacaacaacaaaaatacagaagaatttatccttggtttttcaattactaaaacactaaatttatcatatatatatacaggtgtatatatacacatacacgtatatatagtatatatacacatatacacatatatataccatatatatagtgtatatacactatatatacacatacacacataaatacacatgtacacatatatatataccattatatatagtgtatatacactagtatatacacacgtgtatatatagtatatatacacatacacacatatatacacatacgcacacatatgtatatatacatatgtgtgtgtatgtgtatatatacatatatatgataaatttagtgttttagtaattgaaaaaccaaggataaattcttctgtatttttgttgttgttaaaatctgcatataaaattgagtagccgccactacattccagtgtctaggtcgtgaatgtatttttttggttcagagttcagtaaatgatatgcaagagcaattgagtttttgcctctgtttcctgaatatgagtagctagttacagataggtcttacctcctttttttccttcagtttttgctgttgttcttctctgagaagaaaggcaataagagactgctgtcatttggtcacaggtcagggattaktgygactgaagtcattgaaatccttttgtatgttattgcctccttcaatgaccttctgtctttccaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtgagaaattacatgccgtttgtttttaggaaatagtctagtgagatgtaaaaagtgaaactaargttgaagtcagaagataagtttgaaactttgccctctcgccccacatttttagccacggtgttacaaagagattctcatatgtggcatgtcagagtgttttactgcatgttgggtaacttatgggttcactaggcacaaaggaataattaaagggaaaaatgatggatttaccctctctgtgaactcttcttgtagtgatgttacctttaatgtttttgttgttttgtttctgatcttttgtaacaaggaaaggagagaagagattttagaaaattagttacaaaatctgtcttcattcctcaaggaaatgtgctgaaaggctcctagaattctctgcctctagctatattctgtagaccggttggggagggagtacagaggagagggagggaagtgtttaagatcaggaaattttggccaataagtgcacttaatagggacaaaagcagaaagggaagatgatattaaggagcagaatagaggaactaagtgttcttattctttttccccctgaagacaatgaaaaaaggaataaaatttgagttcttgagcctgcctttcaaagttctgtgaatcccatcactacctgacctttttaaccctatttaatgttacttttgaacgttaaatatgttcaaaaatgaagtagctgtgctacttcaagggcccgaaacatgctgcacgccctttcatctttgtgtcctagatctttctctcacatgtatttactggaatcctgtttgcctcctgagttgtggttcagaaggtacctcctccatgaagcatctatgaccccaggatagaatgagttttggcttaccacctagaatttgattctacttgtgttaagatggtaattgtcataccctgttattaggattgtccgtgtatctttttcctaggttttagcccatgttttctttagctttacttaatgatatcttacacagtgccttgcagatagtaagaacctggtactgtcccatgtttgtggagtgctgtttgagtctgccagttaatgattaggagagaatggaaagtcaaagcagtaggatccagtggtaggataaacacaaactgactgtaaaagtctgagatagaaatattgaagagaaaagtggaagccagaaggaaaaagcctgaactgatcactttaactcatttaaacatttactgaagatatgctctaagaattgtgttgaatagagtgggaggtgaatatgctttaatcccaccctggaggagctgctcacagtctggtggaattggcagttcatataaatagttacagtatcctatgataataaatgctttaattaaagctgtggattcctaggggtggggcaaggggaacttgaacaggaaaggtagagagactgacttttaaattgactttagaaatgttctagagggaatagtttttgcaaagcagggggaataatcaaaatgattacatgtcttcaggaagtttcaggtattacctaaggaggttttaaaaatagacattagcaataaagtcatggtacaatgaggaagagattttcaaatttaatggaatcattaaatttacatttcacaaagatcacccatcatagaaggtagatcagagatggcaagactataggcaggacaccagtttaggaatacctgtgccataatctaggcataggtttacaatatagaactgaacagaaaggcattagctggattgagagagaatgggcctattagagtcaatcaataggattgctcatcgattaggtataggagcacctgatagagaagttgtatcggtaaggrttaagtatagctatatataacaaaaaccctaaatatcattgacttctgtgagagttcagaagtcagccttgcagagcttgtctgacagctccacagagtcttcaaggatgctcgcactttctcttagtgctccagcatcctcagcgcatccttcccatgcactaggttacctcttggtccaagatatccagagttctgtctattacatccatagtcagaaagcagatgagtggtttcctaggaatggggtaggaattggagagaaagattatgaggggtgcaaggaaacttttgcagttggtcagtatgttcctcattttatagtgatggtttcatggatatatatatgtgtctaaattgtacacttgaaatttgaacagcttattcgtatgccaattatacctcaaaaattgtgttctaaaaaaacccactcaaagatattggaagaaaacaaagggggagggccaggcgtggtggctcacacctgtaatcccagcactttgggaggctgagggggccagatcacctaaggtcgggagttcgagatcagcctgatcaacatggagaaacgccgtctctactaaaaatacaaaatatgtcaggtgtggtggcacatgcctgtaatcccaactactcgggaggctgaggcaggacaattgcttgaactcgggaggcggaggttgcagcgagccgagatggcaccgctgcactccagcctgggcaacaagagtgaaactctgtctcaaaaaaaaaaaagaaaaaagaaaacaaagggggagaacaacaatctgaataatacatcttcagaaagtgcagacttaacagaaaaatatgaccataaagcagcagaaaactgccacctgatactacaaaatgaacttaaaaaattaagaaaataacatgatatgaaagaaccatttaaatctgaattagaaaagcttgggaataattcgtctgtgtaacaggtgaatatgaaaatagctgcaaaaacaattagaaattttgaaatgatagaaactataaaagtatagaagacaagataaaaaatagatgtaataggattccctaaaggaaaaagccaaaacattcttctaacagtatgatctaaggcaaaacattggcaaagaacaaattccaaaaactatataacaaattgtatattctagctataacacattctgaaaacttccttgaaaggaaaatgacttgaagctctctattgaaaaggcatactgtgtacctggtatggtcagtccagagcaatcagcgccaacacattctgcaaagtcaccagaaattgggcatccagactaaaactgttataaaattaagaaaataagattggtatcagacttctggaaaaacacttcatgccaacagacaaaaaagtaacatttaacatcctcaaggaaaggaaatatgaggcaatgattatatatctagcaaaaacgacctgcaaatatatcttagcatgggctgccgtaacaaaatattatagactgggtagctgatgtattttctcagtttggagatctgagcatggttgaggtctcatgagggttcccttcctggcttgcagaacttctggctgggtcctcacatggcagagcgagcaaacactttggtgcctggagtttttacttgcaaaagaggacattttgtttcaattgtcgataatcatgcctcagataaacctcactggctatgatactaccactgcacaaagcttggaaattttgaccatcataaagaatacaactgggctgggcacagtggctcacgcctataatcccagcactttgggaggccaaggtgggtggatcacttgaggtcaggagtttgaaaccagcctagccaacatggtgaaaccccgtctctactaaaaatacaaaaatgagccgagtgtggtggcgcacgcctgtaatcccagctgctcaggagactgaggcaggagaatcccttgaacctgggaggcggaggttgcagtgagctgaggtcacgctactgcactccagcctgggcgacggtgagagcccatctcaaacaaaacaaaacaaaaaaaagaatacaactgcatggattaaaacataccaaatatatcttaaaattcatgaattcataatactttaaaaaaaacctcattgctcacctttgaaacttactagagtacaattcattactctgaatggcagtaagtttatcctatcttttctttatagactatataaagaggtaacaatcatcagtattggctaaaacctttgggtaaagggaacaggctggcatcatctgaactcagtgggcaatgtcagcgtcactgtaagtgggacaaccaaataccatttcttctgatgtgatgcatcaggaagtaccaggcaccactgatgaaaatgactaaaatgaacttgtatcaaagcaagcttccagtctgcactgttcagtaaggtagttgttagctacatgtggctaaagttaattaaaattaatacaattaaaaattttcttgcactagctacagttcaggtactgaatagccacatgtggctaatggctactatattgggcagtgcagatatagataatttctatcactgcggaatgttctgttagacagtgctgctctaaatctaatgattagttttcaggaaagatgtgagaacatgtaaacttgccaaatgaccccatgagactacaatcagaaaagtccagaaggcaggaaattctacatgacaaatggctccatttctgttaataacatgaaaataaaaggtaataaaaactttcttttttatagcaagagatatttagaaacatccattaaatgtaatctgtagaccttgtttggattctaatttaagaaaattgtaaaaatgcatttttgaggcaatcatgaaaattgcatatgaatcaggtattgggtattatgaagatgttcattttgttgggtgtgataaaaatgtagttacatttttaaaaaataaagcttaccttttagggatatgtactgaagtacttacaggtggcacgatgtctgggatttgctgtaaaacactggcggtggagggggcaaaggacaggatggatgcagaaaacgtggtaggcataaggttgatgggtgaggcaccatgataaggagatggggtgactatacttaatgtctctacatatgtttcagaatttccaaaataaaacttaaaaaataaaaatgccgatgcctacacattgccttctattactagtctaagaaaaacagatgaagaaaaaaggctgcctcttcatacattatttggaatttctgttgtgcaaaatggggtcacctaatttattatataattattgtcatatattgtatgaaatattttatattggaaagttgatcagtaacttcataaagatttagataaaatatttaatcagcatattttgactttcgggcaagtttatggaatacttgcttttgaatcaaaacgtgcaatttcttttattccttggctgacagttttgaattcaggtctgcatgttacattttattactgctttgtttttttcctgttatttcattcttcttgttgcttggttgccaggctggagtgcagtggcgctatcttggctcactgcaacatccgactcctgggttcaagcaattctgcctcagcctccaaagtagctgggattacaggtgcccacgaccatgcccggctaatttttgtattttttagtggagatggggtttccccatgttggctaggatggtctcgaccttctgacctcgtgatccacctgcctcagcctcccaaagtgctgggattacaggcatgagccaccgcagcaggcctgcaaaaatattgaaataacatatttataagccatcttcagccccaccaatatatagaaattttagcaaaaaggtttttttaatcactttagtagaaagtgataatgtcattgaagtgtaatttcttggccatctgctcctacagtaaatacttctttaagaaaaacgtatttatggctgggtgtggtagctcatgcttgtaatcccagcactttggatggccgaagtgggaggatcgcttgagctcaggagtttgagaccagcccaggcaacatagagagaccctgtttctacaaaaaattaaaaaaaatttagccagctgtggtggtgtacacctgtggtcccaactactcaggaggctgaggctcaaggatcacttgagtccaggaggttgaggctgtagtgagccctgattacgccattgcactccagcctgggctatagagcaagaccctgtctcaaaaaaaaaaaaaaatctatctgtctgtgtatccatccatccatccattcatccatccttagttgcttccattaaagtatttgagggataatacaataacatataataacaaccacttatgttttttactgtatgttagacactgtcccaagtactttattaatttaattctcataacaaatcctgtgatgtaggtgctattatctctattttgtagatgaggaaaccaagacacagaagggttgaacaccttgcccaaggtcacactgctagtatatactggaactgggactcaagcaggctggctcctgggtccttgctctcgaccattgtgttttgtggactgtcatgtaacatactaaatgaataaaaatactagaaatatctataactgtagatttgtcgtggttaagaacaagacctttgggtcattgagacctggggattcaaactccagctcagtctggctctgtgcatttgagcatgttgcttaatctctgagctccagctcttcatcacttaaaggtaactattattaaatagtggagaaagcaattaagagggatagtaatgagtgcgattatgcctggattttagctgtgagcttaatggcagccaaagcaaaagaagaaatacgagttccatcattcattatgtaacacaaagaagcatacctgtttgcaagcatgatacattttcctggtatagcatttaaacagaaactttgaggtgtgattttttatataagacattgaaccagaaatgaataagttagagcaaatatggaagagtcaattctcatracagtataatgtaaggcaaaaatatttttgtggaaggctacattaattgggtccaartatgttgctttttcatgttttttgttttttgttttgagacagastctctctgtgatgcccaggctggagtgcaatggcaycatctyagctcactgcaacctctgcttcctgggttcaagcgattctcctgcctcagcctcccaagtagctgggactacaggcatgtgccaccacgcctggctaatttttgtatttttagtagagatggggtttcaccatgttggccagtccggtctccaactcctgacctcaagtgatccgcccgccttggcttcccaaaatgctgggattacaggcatgagccgctgcacccagccctttctagtgtttttgatttaaggaaaagtcctagaatatttagaatggaatatgtgaatagcatgttcaatagacagacttccctaaacacgctctccctcagataagcttctgaaaggagctgccatatagaaaatctcaagtttttctctttggtggatcccagaactgccagcatcccattagctatagagggaaatccatgggtttggctgttagcaggtggaaggagaaaagctggatccaaattcttcttamttgaatggatggtgttttggtcaggttctttggtaataaagaacagaggtttacatgtctgtggctgaaataagatgataaagactcatatgaaatgattaaaggggtgggctgtcagaggaattcaaacatgaactgtaactgggttgcacttcacaggcaccanatacggaggacagtttggattccagatggctccatagactgcactggcagagtgtctgtgatttccatttagtacggtatccccagcatctagaataatgcttaacatataatagaccccagtaattacctgttgagaaaataaataaaaggaagtagtaaatcttcactctagagctttatcaaaatggagaagtgagtggcttcaagtacgtgattgataagagctgctgttagccggctatgctcttggtccttcacatatattattatttgagtatgttcagtcctgtgaaggggtgatggtaccctcattttactggtgatagaatttaaattcaccagattatgacttgcccaagttcgtgcagaatactratttggagagttcaggtctacttgactctaaaccttgttctggtaactgatgccctatatattgaaagtacaaacagggtggtaaacagaagtaaacccacattaccagatattaagaaagcatcttaacagctgttttgagggatttcatcagaaacattttaatatcagcctggtctgaaatatcagaaaccatttttctctggctttactttccagtgctagggaacttctaccaaacaaggtaagcaaactcttatattactaagttactagtcagagtttttaaagtaaagattagccactggctttccatttctccaactaaaaagaaattgtggggactgttttacagggcatgaagcagatgactaattgtcttataggatcgttttaattttgaaataactataatctgggataagtaaytcatcacatatactttaatatgtgtaagtgtcatgtggttgaggactttctcatccttgtttgaaacygtctaggggctctgtgtggtggttcatgtccgtagtcccaacattttgaatccaagcactaggattgcctgagcccaggagttkgagaacagcctgggcaacatggtgaaactcccatctctgtaaaaaatagaaaaatttgtcaggcatagtggtatgcacctgtagtcccagctactcaggaggctgaggtgggaggatcacctaagcttaggaaggttgacgctacagtgagcagtaatcatgccactgcactcgagcctgggcaacaaagggagaccctatctaaaaaaaaaaaaaaaaacacacacaaccatgtgggattaaggttttatttcactggtttatgcttctctaccaaattatggttaaatgcattgtrtctcaatgagataatattgacattgaccttatacaactgacattttttataggtatcagtattatctgcaactgaagaaagatatcttggaaggaagtattccttgtaccttagaacaagcaattcagctagcaggcttagctgttcaaggtaaataagatcaattcataatgaaatggttctatcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagtacaataaatagaagtatgtatatatgtgtgtatacacacacatatgtacaatcatatgccgaatgacatttngttcaacaaaagacctcatataggacagtggtcccataaaattataacactatttttagcgtaccttttctgtgtttagatacacaaataccattgtgttacagttgcctacagtattcagtacagtaacatgctgtataggcttctatgagcaataggttatacaatatagcctaggtgtgtagtaggctatacaatatagcctaggtgtggagtaggctgcaccacctaggtttgtgtaagtatactctgatgtttgcacagtgacaaaatctnatgatgcctttctcaacacattcccatccttgacacatgactatatacatatacatttattaatactatgctatgtattyatctagttcaaagactttgtctgctaataggtcatattttaagaagaaagatatgccagtcagtgagtttgatgaggttatattcrcttacagtttaagtacacttcatatgtttggtttctttttatttatttcaataggtttttggggaacaggtggtgtttgcttacatgaataagttcttcttatttatttagttacttttttttttgagatggagtctcgcyctatggaccaggctggagtgcagtggcacgatctcggctcactgcaacctcctccgcctcctgggttcaagcgattctcctgcctcagcctcccgagtacctgggattacagatacctgccaccacacagacccaactaatttttgtatttttagtaaagatggggtttcaccatgttggccaggctggtctcaaactcctgacctcaggtgatccacctgcctcagccttccaaagtgccgggattatagatgtgagccaccgtggctggctatggttacatgaataagttctttagtggtgatttctgagatttggctgtacccatcacctgagcagtgtaccctgtaccccatgtatagacttttatccctcaccccactcccacttgtttggtttcttaaatggttgtcctgaattatgcagtaataacatcaatcataatagataaagatggctgggtgcggtgtctcacgcctctaatcccagcactttgggaggccaatgtgggaggattgcttgagtccaggagttcgagaccagcctgggcaacatagcaagacctcatctttaaaatgtacatatataaataaagattctgcatttcaccagcatttttgaattgtttatttttttcatttttacatgtctgatatacatgtatttacatgtatgtgtgtattttcctttttttggagacagtcttactctgttgcccaggcttgagtgcagtgatgtgatcgtggcgcactgcagccacaacctactgtgctcaagtgatcctcccacctgagcctcccaagtagctgtgactacaggtgtgcgctaccatgcctggctgatttttaaaattttttatagagatagggtcttgctatgttgctaggctggtctcagactctttggctcaagctatcctccctccttggcttactgaagtgctgggattataggtgtgagccactgtgcctggctgggaagatttctgatggggcattatttcaaacaataactggcatttagccttgggagtgaaatttaatcagaataattattaataaaactccttcagctataagaaggcatggagacatgtatcatttttaaacaaatgcctgatgcacatggagccacattccttttcaaggtactttagattttcttaagtatcacttttggctttaagaattactttttcataagcattttgctgaattgtcaattttttaaaaaatattaaaaatttcaacacaaatatatcttgctgtaatatattcaagtggtctaagtctattccccagaggtcatcagtactgttgacaatttggtttctccttgacattttcctgtacataagcaagcatatatgattacagggtaggttttgtttgcattttaactgtaaaatgagatcatattacatagagcttgcaacttgtttttttatttaattcataggcatttttccaagccaagactcatatctgcctaattaacacttttaaaaagatactttaaaaatatactttatatagctataacaaatttgacttctgaaatattagcataccatctagatatactgcgtattgaattttgttgtgcatattttgcaatgmaatttaaatataattaacgtgaatgtttgtcattctatatagcggattttggtgactttgatcagtatgaatcccaggactttcttcagaaatttgccttgtttcctgtggtaagacttcttttgacactgggccttttaaaagaaacagtttattcctatacccttaataatccctgaaatgaaatccgtatgatagacttactgtcaggaataggattataaaaaaaaattccctcttataaacatctcaagtgtgactgctttccctgttgtagtcatcttggtccttgtgaacccacagaaactgaagggtctgtagtcactgcactgtgcctggagacatttgttttctatttgtgagtttaaaaagaaggattcattttcagcttctcaggaagcatgcacaggttttgcttttaactgaaggtttgaaaccttacaaaattatattgaggaatgtcgcttctcatcagcaatttaaaaagtagatgacaaagacactgccttctacttttataaagtcattactgatggaagggacatggaaactgcattgcaacaactaaggaaggtgtggtatgctgttctgagtgtctacacagtgccagagaacgcacaagatgtttttatcttgctgggctcaggactggctaactactgtcaccaacttgacataactcagctgaaactttccctggaattgagaaggtggggcaagttttttttttttggctcttgtgagaagccagttaattccttagaaagatgattacctatgtaaacaaagctcccatatagtaacaatagtcataattttgcctgatagtgacnagagtcattaacagtcaatggccatgattccttctaagaaattggggtgaattgtcacatacttaccactgtgtgttttcttcagggatggttacaagatgaaaaagtattggaagaagcaacccaaaaagtggccttactacatcagaaatacaggtaactctaagaaataagacatggaaatagcatagaaccaatgtctgcttgaatttgaaatattcaattaaatatttaatttacatgattaatatttatttgcccaactaaatttggaacattactgccactactattacaagtagccaacatttatatagcactcactgtgtgtcatgtgctgttctaagtaagcacttacccatattacttatttattgtccatgttttaccagtgaggacactgaggaagttgaaagcagccagtcattgaagggtgcccattttttactgcatgtagtaaaggtttgtttgataacctcaaacaaacctgtataggttaacgtaaaattaggatgatttgttttcttttatgatacagcttagcaagtacagggttacttccctctctatacctatggaagctgtgtctgtcacctggggagctatgctaagagctatggtgcttattactctgaactatgcttctgcatacctttgtatacttgtacatattgacgttctttcatgatgaatctctgtgttgcctgtaagaaaaaatactcttctggataatgctaagtcttattctaaaccaactaccacacagttccacatatagatgctccttgacttgtgatggggttaagtcctgataaacccatagtaagttgaaaatactctttaagtcgagatgtatttaatacaccagtcctgctgaacatcatagcttaccctaacctaccctacgtgttctcagaacacttatgttagcatacggttgggcaaaatcatctaacacaaagcctgtaatatattttataatgttgaatatctcatataatttgttgaatactgtactgaaagtgaaaaacagaatagttgcgtgggtcctcgaagtacagttcctactgaatttgtatcacctttgtaccactgtaaagttgaaagtcattcagttgaaccatcatcgtaagttgaggactgtctgtactctatcattaaattcttataactactcattaagataaacattattatctccatcttaccagatggggaaaccaagctcaaaaagattttgttatctctggctgggagcagtggctcacacctgtaatcccagcacttgggaggctgaggtgggcagatcacgaggtcaggagatcgagaccatcctggcaaacatgttgaaaccctgtctccactaaaatacaaaaaattagccaggtgtggtrgcatgcaccggtagtctcagctactcagaaggctgaggcaggggattcgcttgaacctgggaggtggaggttgcagtgagctgagatcgtgccactgcactccagcctggtgacagagcaaaaaaaaaaaaaagaaaaagatytagttacctctacgtgtggtagaggtggaaattgaaagcagatcagtttcattagaacctattgcttatccccttccaaataaaataaacttttgcctctagtctctctccactcaaatccacacagtgactcacaaaagattaatctccctagaatatcagtttcctcttacctctctccttctccttccacgtgctcatgggtattttcatgctttctactagcccaagttcattaccctgggattaaaggcctcctacaagttggttaaatcctgccttcccagctttaccttctgctggacagcagaaccacatgaaccatttcttttctagcttaattggtccctcaggcacacattgtcctgccttttgtcacttccatttattcatttgtgcatttccttaaaagatagcttagtgttcttattctgcattaagcagaggaagagtgctggatgctatgacacaaagataaatagaataatttcttgtcttctaagagtgcattcccagccctgcaatatgagggctggcaggacaacccactatagtaattataatacatataagaagataatgagtgcagttagaggggtatgggcggaatgtgttgggactgcatggagctgcggcattggagaatcccagaaggtgatccagaggaaatgatgcatagacagagtcttgaaggatattagggattggccaggtccacargtgagtcacaggcacaccaagaagagggattctcatgtgcaaaagcccagaggggctagggaacatattctatctgaagagatgcagagtttgggatggctgcagtgtgggtgccttgaggacagcggggagcatcggaagatgaggctggagatgcaagtctgcatgcacttgggcactcctcctttacccacactgccttcctacccatcctagtagtgttgcactcacctgagcaaaaaggggttttcatgtagcctcctcgtacccttattccctgcgttcgacatttagcacataattctcagtaatgcctcatattttgttgtttttatttttgtttttttttgtttttttgttgcccagactggcatgcagtggagcgatcatagctcactgcatccttgaactcctgggctcaagcagtcttcccacctcagccttccaagctgctgggactatagatgtgcaccaccatgcctggctaatttaaaacatttttttttttgtagtgacagggtctcactatgttgcccaggctggtctcaaactgctggcctcaggtggtcctttgtccttggcttcccaaggtgctgcggttacaggcatgagtcaccatgcccagccctgatatttgggataataagcaattacttggtggtttaagaaaagttcaagatttcaccctaagatttttyagggagttgttttatcccccaccttcccactcatctgccttaagtatggagagcaggatctcatgtgataccctcagcattcagcacatactggttttcagtaaatagcaagattgatatagccaattatagatgcttagaaacgtgaaatgtttataatgtcttatgctaaattgacatataggttttaagaaaagctttattttaaaccattttaagcttgctttgtgaacaatcttgcttcttttgggttgcagagggctcacagctcctgatgctgaaatgctgtacatgcaggaggtagagagaatggatggctatggagaagagagctaccctgctaaggtaagtgtggcttggcggctggggctctttaaagttaggcttacaaatttgagaaaatcatggggaaatccaaggatgtccttatgtgcaaaggctgaggacgtgcaaaactctggaaacttaaaagctgaggtcctggtgaccaaagttttgtggtaaaacacattcccattttgtggttcatactttgaaatggtcttgaaatagagttcctaaggagggccaaactttttcaatttttatacttacctataagatcatagatctcattcagacttttgtcttcctnaatagttactctgtaggtcttcggaactttctacatctgggaaaccagtccagggaactctagcagcagttcctctgcatctgcttcctgggtgtttcttcttctgctttctccttgtaggatagccaaggaagtgacatatccattggagcgtgtcttgaaggtatctttgtgaaacacaagaatggaaggcatcctgtggtatttaggtatttttcttacctctttttgtatgttttctatggctcctgttggtgatacattttttagtacttacagcagttaaattgttcacaagtctataccaaggtctcattaaaaaatggaaataattcccttcctaggaaaaaaataccatctgaatgcaacagtccttttcaataagccgctttcttcaaaactctatgtccagagtataatgcctataatgacggcctattataaaatgcttaaaaatgtgtgaccctttttgtgccatatggaggccattctttgctttgatatgaatgtttaatttgagctctggtttccaaggctatttattggttaatttatttattgtgaggcaaggtctcactctgttgcccaggctagagtgcagtggtacagtcaccactcactgcagccttgacctcccaggctgaagtgatcctcccatcccagcttcctgagtggctaggactacaggctaatgccaccatgcctggctaatttttgtattttttgtggagacagtttcaccatgttgcccaggctagtctcaaactcttgggctcaagctatctgcctgcctcccacagtgctgggattccaggtgtgagcccactgtgcccagcctgaagggctctttcctatgaaaaatatagagctttgttttgactctagttttgtaccaaaattcctaaaataccagtatctaagcaaatttcaattattttttataatgttggttttttttgctgatataaaaaaagatactattcatttgtggaaatcttggaatgtgaagcaagttggaaagaatatatagcgatgtgctaatagtaactgactctgaacaatgaaagtacaggtgattttaatttcctttatagtattctgtgttctaatttgtatcttaaagatagtaagttggaccatattgtacaatcccctacctttaattccttaaaatctgttatctggaaaacccaaagttcatgtccaaccaaaagcttatattgtttttataaggcaggaaaacatattctatcacttntgttttttggttcctttgtgtctaccatttgttgagtgcttatcatgagtcagataaactatgctgagcattttttgtgaattttttttagtgtaatcttcataacactgtcagcagtaggtattaccaccactttgcacgtgtgataattgaggcttagaaaagttgtgatttgtccatggtgacccagttattaactggcataactaggactagaacttggatcctccactttatgcgtgggctcttaatcgctgtattaaacagcttttattctctccaccgcctactcactgcccgccccacaacacacacactactcaagctttctaaaccactcctaccatttcttcttgagaactagtttggcctttgaagagctttttctctaaactgacatctcctccctcacttcctttgctttactgcctcttgagccatgaattctccatggtgattatgacctcagagagtacgcatcacttggggagcagaaccccattcctagaatgcactgccctgggctgggtggctcccctttggcagttgctctctcgtccccaagccacttatattaacccttcccaacatgctgagttgggggtcagggagaggagaggaaaatggatccgtggcttcacctgaagagcagggctctgatggtgcccaaagtgtcacatggaaacttgaggcwtctacctggcttcctttatcactggataggaattttcacagttgccttaatgtgatgctaataatctttagatttaacaaacaacggaatccgtactaagttgattttattttaatacatttaaaataaatctaatggagaaggataaaattttttcttccataattttttctttttataaaattctgtgattaataaaatcaaatattaacatataaaagctaatacgataaaattagaaagtataagattttgaatcctagtgatcacttccagaatagttcactctttgagttcctggcatttcaaatttatcttcaccctgaagcttttcagagcacacctcccccacttttgtgccttattttaatacctgcagcacttaaaagttcttgtttgcttctgtgttctttctcccacctttcccctccaactgtgcgaatttgagggaagcactgtaactcactaatcttagtgtccctaggacctactgcaatttctggcattgttataataggtgtcttttattttgttgaatgaataaatggggcattggcaatcagctaagagagggatcttccatcaagcaaatctgacacatgagaatgatacattttacatcttttaaattctcttttccctcatttattatacatgagtttactttttgaactagctgctgttacttcaattagaacattcatgctagctgattaaaaccactgtttttttttttcttttttctgttttggttttttttgagacagagtctcgttctgttgcccagactggcatgcagtggcrcaatcttggttcactgcaacttctgcctcccaggttcagacaattcttctgcctcagcctcccaagtagctgggattacaggtgcctgccacctcgcctggcctagtttttgtaattttttttttttttttagacagagtttcatttttgttgcccacgctggagtgcaatggtgctgtctcagctcactgcaacctccgcctcctgggttcaagcgattctcctgcctcagcctcccaagtagctgggattgcaggtgcccaccaccatgcccagctaattttttttgtattcttagtagagacagggtttcaccatgttggccaggagtctgaaactcgtgacctcaggtgatccacctgcctcggcctcccaaagtgctcggattgcaggcgtgagccaccatgcctgacctagtttttgttttttatttgtttctttgtttgtttgtttgaggcagtgtctcactctgtcgcccaggttggagtgcagtggtgcgatctcggctcactgcaagctctgcctcccgggttcacaccattctcccgcctcagcctcccgagtagctgggcctacaggtacctgctaccacgcctggcgagttttttctttttttttgtatttttagtagagacggggtttcaccatgttagccaggatggtctccatctcctgacctcgtgatccacccaccttggcctcccaaagtgctgagattacaggcgtgagccactgcgcctgggctagtttttgtatttttaatagagacagggtttcaccatgttggccaggctggtctcgtgttttttgttttttgtttttctcaaaaatgttaccaaatgctaacttacacgtcaggcttagggaaaacttgtgtattctatctccttgtttcccccatgggcactcacattgccagttctctatttgctgttctttaggtggcatgacattgccaacatgtcccacaacaagtccttttttgcattagagctggcaaataaagaggagaccatycaatttcaaactgtgagtaaacattaggggtctgcatggaatgtttttcctaaaagttaacaagttctacttctgcgtgcctgtatgtgtttggaggcagggcagcattaaaatgataatattttgtaattgtataaaacatgcagttttatcatatagcattttgcaaaatggcagttagcaaaaaatggctgctcagtaaatgctgagtgaatgagtctttggataactactgtctgatcatgataacctttaaattaaacttcagggattatgtgggggagaaagtaagcactgatatcttaaatttcattgataaatgaatagctctgaagaaatgttatttaacagttacttgcttttgctctcttgacaaaggcaatattgagttactgagtcatatttttgtttaaaaatgtctttgagtatatttggcaagaataaaagttggtatttttatagtttttagattcccaagtcattttgaaactgtttaatatgagaatcacactgttagaacagattgttttgtcttcataaattaaatcctacttgtggtattcataccatyggcacagtgttggaaaatgaaaggcttatagtgttctgaaagtgactttgtcatatgatgtcacccattatgtctttagacaaactctgcattaaacgtatcaagttgtatgtgtgctttcatattgctttatgcctattttgtttgctaggaagacatggaaacagcaaaatacatttggagactctgtgttgcgcgacacaagttttacagactaaaccagtgtaacctgtaagtatgtcctgctcatggaaattatcaaaaataatgaatttagaaattgtaatcttgagtatactgtatcatcaagaaagacattttatcagttgacatcttttnttgatcctrtagctgttttcctattttagctttggaccaacttgtaataactacattgtatncctctaagatttatttcaactagttacaagaaccattgtaattcttgaaaggtaaaaagggaataatatcctttatttgtttaaatcaatcctctggtaagcattttkagtcattaaagattattcagcttttccagctatctgaagaatttttgcccctccttcctggtgtgcatttttcttagcccacatgggtttcttactgtttgccagatcaataaagcacacggtgatattgcacatataaaatattgtccttcatctatactcccctccagcctctgcaccatatctctgctttcctgaatagcaggtttcctcaagagagttgtgtatgcttgtatgtttccttccttccatcccattttccctaagcctccacgttactgatgctgcttgttgtggtcaggtgactttcgtccagtgatcatttcatgagttctctcacttgaccgctccgcagtactgatcctccgacagctccttccatccttctggaatcctgctcttcttcggctgccaggacaccaccccctgctcggcttcctctttctaggctgtttcttctcagtcacctttgctggtttggtcctgaggccttttctccaaatcctttcgtctagggggcttctcctgacctgtcctccccctgagcccccggttcaagtgattctcctgcctcagcctcccgagtagctgggattacaggcatgcgccaccacaccccactaattttgtatttttagtagagacagggtttctccatgttgttcaggctggtcttgaacttccaacctcaggtgatctgcctgccttggcctcccaaagtgctgggattacaggcgtgagccaccgtgcccggccctccttgagctcttgactcctgcatcctaccgcaagcatttagtgtgcttagtcctcaataccactctgaaagttgtggtgaatatatactactgcctgtatattctgaaggtagagctggcagaacttgctgatgaattggatgtggtatgaaacctgaccatttttaccactcgtgttaacagcttagtgctggctgccactacttctcatcagaatactgaggtagccttctgactttcctgtttctgtgcctttgctgcctgtagcttattttccatatgtcagccagaatgatcttagtttaacctgaatcagatcctgacactgacactcttctttttttttttttttttttttttttttggagacagagtctcgctctgtcacccaggctggagtgcagtggcacgatcttggctcactgcaacctccgcctcccgggttcaagtgattctcctgcctcagcctcttgagtagctgggactacaggcacatgccaccacgcccagctaattttttgtatttttagtagagatggggtttcaccatgttggccaggatggtcttgatctcctgacctcgtgatccacctgcctcagcctcccaaagtgctgggattacaggtgtgagccaccgcaccctgcccagatcctttcactcttcttaaccctcctttggcattccacttctttttttaagtaatttttttagtttgtttttgagacagctctgtcacccaggctgagtacagtggcatgatcatggctcacagcagcctctcaacctccctgggctcaggtgatcctcccacctcagcctcctgagtagctggtaccacaggtgtgtacctggttaattttttggtgttttttatagaggcaggatctccttatgttacccacaccggtctcaaacttctggactttaggaatcctcctgccccggcctctcaaagggctggacaggtgtgagccaccaggcctggccccattttacttctaataaaagtacgaggccatacacagtgtggtccttgcctggtttcaaccttatgtcttttatcctcctccctgcttgctctgttccagccacagtggtatcctggctaggctgcagatgtgcctcaccctaggggatgctgtccttgctcttttcccaggtctccacctgccttgctccctcattgcagcctgctgtctggtcagatatgaccctcttcagaggctgtccctgattgtcctatggtaccccccttccactatgatctgtctctttaccctctaactttgttttgttctttatagcacttagcaccatgtgaatttctatatttgtttgtttgtttgtttgcctgtatcccctgccagcaggttagctctagagcagtgcttgaggacagacactcttccctgccttcagtgctatattccccatgccaagcaagggcctggctcactgtcggccttaatgaatttgttcagctaatctatagatacaggtgttaagagctctgattcaagatgtcttggtgctgtaagatcccttaggaaaatggtacgtcacccagaactgccaagataggaaaggctacccagccaagtgacatctaagctgagacccgaaatgttgcactcaattcccacaacctttctttaagctgtcctcttgtccctggtccatgtctggaggcacctcctggagctccctcccacttggccccccacgccctatctcatctgtatgcagtcagtcttctggatagataagcaaaatatgtagcactgctcttgaagttacatgtcaggaacaaatctgagcatgtgcctctcacccgccccgtcctgggtacaggattaagggcagactcctgaggtccttctctggacttagctgccccagcccagttggccttggagtctgactccaggaaggcatctttccttatcatgtgaatgcccccagcccaggcctttgctaaaatgcccttccttcccttctctgacagactcttagtcattcttcaagattgagtttaaaatacagcccccatagacaccaccaaacattcagtttgcttagtccttgacaccactctgaaagttgttttttctacctcttttataacaatgacctgaataattcataacaataatttagtaaatgcttgctctgtgtcaagcattatactgagagcttttattttctttaatccttacagtaaccctgttgggcacaattattactatcccattattgatgaaggtatggagacttacagaagtgaaatgtcttgccctgccacacaactagtaagtggagcagcaagactcgagcctgtgctcttagccgctgtgctagcctgttagagtagttcctgcctgcttttttcatattgacagatatcaactgacagatcattttcatttgatctgtctctcttgtttgatgaagctccatgagggcagggtctcctcttcctcatcttcgtgtcccctgtctggcaaggtgcccggtgcataagggcttagtgaacaatgggagccggagtgtggcagtgatgggagtcacaggggagaagagcacttttgctcctttgtctcttccttttattacagattgtaaatgaggcatggggtggaggcaaagtctaacaagggcattttgtcccttagcaccaggaaggaaggagaaaggctgtggaagtgccttctgtcttgcagggtgtgagagaaactctgggcaggagcagcagtgtaaagataacatgcggggatgcccacccggacggggagctggccagtggtttgcatgtatggcccagtccctgtctcttctctgccttcccctgcaccatgtttgcatccgagtccccatcgctggtctggtgatgggattttcgtaagcactgacagggaggaggaacctgctttctttgtaaatatgggaagcggtttctgctaggggcctgggtgtatttgcatatgaaagtgttccccctggtggtgatattcagtagtgctacttgcctttggggttccctggggctggcctggttatccagccatatgtggcatgatttctatgcagaagtaagttctaagattcaagcagtagataatgcagtctgttggaccacagcattttcattttaaagactttaataagttaagagtgttcataatattgagccattattacctcagtttgtttcttctctggaaaatagtggagagtctacattttgaataaaccataaaacataatccctttccatgaggcatccatattggttggtggttagtgcctgttttttgtttgtttgtttgttttgttttgtgtttttttttttgcaaattaacaacttgtaataagtaaaagagggaagagggaaaagcaacaaatgattgattatggtgaatgagtcttagaaattcagctctagtttttggaatattgctatttattggcaagtgtgaacaaaactacattaatgtcatcagttgcatatgctatacctaaataaggaacacctgaatctttttaaaatggaatagttatgtttaaagggctgttttccaaagtttgctttcaatctctatatatccaatagattgtggcagtcgatttccatgagctattcctatgtaattacttatgattcattctgtagggaactaatatatttcattgtgagcgtttgtttcccacataaagtaaatgaagcttttaatattagcttttaaaattttgcttgataataaaatgaaaagaactttaattgttatggccatgttttaaaggctctcaatatagactgtttagtcatgttccaatattatgattctgaagtattggtagacttgttgtcatgggccagatgggtaaactaaagcgtgataggcatttaacaaaactgcccctggcctggaactggacggtggcttctggacatctgctttgggctggggtgactggtggcccaggagatagactcgacttgcacagaaaggggaactgtaatcccagggtgtcccctttacccccagtcctgatctattgtagtttattgctgcttgggatggccttatgtgactcatctaatcttgacccagataactatattttagtatttatacaatggcataatccaacagccttctccctccaccccctaacaaagtgcattagataacagaatgatcgttatccaaaccttaaaaatgttagatggataacaatctgtcttttaaaattataaagtgaggatattgagacttttatacttaatattcctttatggttgaattgggaattaaatgacataataatgtcaacctgttagatcagaaatctgcttcaaacccactgtctctcactctaagccccagaactggtcatgctgtaagcaccctccctgatttatataaggaaaatgccgngagagttggggagtcatgagaggccccttggtgtaggtggctcccctgctcttttctgtgaggaaaagggaggatggtatccttcaacctgcaaagccaagtgatagagggttcaagagactttctccagaagggaaacttgtatttcagactgcagcaggccactcgctgagcgcagtgagatggctggtgagtgctccctgcagctcaggggtgttggtgaacatagcagccggtgtccaccttggttccggagacttttgtaatcaggagactgactagagtaggccctgcctggaaagggaaagagtttacccatcttcttggcctactgcagggcttgaagagactataggaagtctggaagaagatggagcagcccctatcccattccagtcccctgagccccagaagtgtagagaggacccagtagttcccatggatccatgtgaaggagcagggcaggaagaggtgggaggggagaggaggagcagccacaaggccaaacagtgggacctctgggtatggggacatggacccctggtggagccgaggagaggcagcggctttttctgagtaggttcttatatggataaaggtcagtgtcaccctggaaaaccacacatgtcggccggtcacggtggctcatgcctgtaatcccagcactttgagaggctgaagcaggtggattatctgaggccaggagttcaagactagcctggccaacaaggtgaaaccccgtctctactaaaaatgcaaaacttagcctggcgtggtggcgggcgcctataatcccagctgctcggaaggctgaggcaggagaatcccttgagcctgggaggtggaggttgcagtgagccaggatcgcaccactgcatttcagcctgggcgacagagcaagactccatctccaaaaaaaaaaaaagaaaaccacacatttcatggggctggagtgacactagggcctctccctccatcagtattccttcccagttacctgagatggtctctgctggctttgttcctctcccatcccacaatgccaggaagctacacctaaggcggggtttggtaggggggtgaacagtggaagcaggcatcccagagccaagtcagtgacctgtaagcagcttggatgcagccctggtctacccaagtgtaggctgggaggagagcatttattcttccttacccttactatagtgagctcaaaaggtgtaagtcattgagacaaacatttgctaggtatttccaccatctaacacttttatttatttatttwtttaaagagacggggtcttgctctgtcttccaggctggagtgyggtggtgtgatcatagctcactgtaacctcagactcccgggcttaagggatccactggcctcagccctcagcttctgaagtagccaggattataagcgtgtgccaccatgcctggctaatttttttttttagttttttagagatggggtcttgctgtgttgcccaggctggtcttaaacccctggcctcaagtgatcctcacatctcagcctcctragtacctgggattacaggaaggaatctattccttgaactatctattagtgcatgagctttcaatggcatctttttgtttatcaaaatcttaactcccttacatcgtataagaaaggaaacttacaaagcaaaattcagacgaggcttagaaatacaagctcagctgtaaatgcttagtaataagcatcactttagtcctcacttgttagtcactcatttgctcagcaaaggcaccagggataccacatcttgcctccacggagcttacagattagttggggttggggagcaggttggacacatgattgttagacacatacactcaggaatctgacagacctgctggttcaaatgccggttctactacttgtttgccatgtgaccaggagcaacttactgaacttacgtatcactttccttatctgtaaaatcaggataataactggacctcccttatgggtttggtgttcacattccacgagataatcatgtacagtccttagcacagtttcaataaataatattgattttacttgggctggtagacttktttcttttttttaaagacaccaggtcctagtatcccagtttcccaggtagaatatggtgggaattcgcagatgggatcgtagtgcactacagccatgaactcctggattcaagggatcctcctgcctcagccttccaagtcgctggcactacacgggcatgtgccaccacgcctggctcagcctttttaatttttattttgtcttctttggcacacagattctagtgatttcttctcagttatttagcagcacccatcaacatagtaactgcccaaaaagtttggaaaccacagccaacagttacatggttttctcttgtatgccaagctgaggatagctggtctcagagtaaactgcatttataagaacaatgccaagaagaaagagaaggttagactattagaactgatggcgtggctgcctgggtcaagcactttggcaggtacacgcttttgtagtttgttttcttagtagagccggctactacagtgggcagtgttcgcctccacactgggtgctgcggcaagagcgccaagataagctctcagtgtgggagggccgcccatgtgctgaagctctgcatccttgggttttgtgttttatttttgccccaggctgggcaactgtagacatgttgttggagtttgttgacagagaattctgttggcaatccttgtgaatttgtagtactttaaaagtttcttaagttcagtccatctagacagtgagtctctgctagactgaacacagggttcagaggacccagtttgcctaaacctagtcctgacaatgaagaataaccagagacaaagtaaatttcaaggctgcaaaaatgcagcgtcttcaaattctgggcactattttttttttttttttttttgagatggagtctcactctgtcgcccaggctggagtgcagtggcgtgatctcggctcactgcaacctccgcccccttggctcaagcgattctcctgcctcagcgtcctgagtagctgggattacaggcgcctgccaccgcgcctggctaatttgtgggcactaattttaaggaatatattaatgtgcagttaaggagtattttttattttttattttttattttttaaaacccagacacgccatgcagacttgtgtcaccaaaataaatactggaagaatggaatatcttttggaaaagagacatttatttttcmttaacagcctgaatactttccagtaacaaagaaatgaaattatttataaaagctagtaaaagcagttgtaatcacctgatgttaaaactagtatgtactagttttctttttatctcaagagtcttataaaaataagctaatattcagggtttttgaatataagatactagttttcagagtgctaagagtaatattaatttatgagacatgaggcttgatattatggtaaatttgcttaaatggattgaatattcactttgtcatgatggattttctagtaattagtccttagaacactgtaaccaaaggtcacaaaatatttttgtaatcagtgattatgtgttacataagtacatgaaccaggaataggtggtaaaaggtataagaaaaagtgctttgacaaaactacatgtcatcaacaaagccaagaatccagtgtgtttaggttcctagatcttgcagtaaaactgaccacacagaagaaaaaaaaatcttgcctttatttgaaaacaatagttacaaatgggcttttctgtgtctgtttcctttttttaccttattgtttttttaaagatagaacttgctgtgtgaatagttgaaaatctcacattatcacattagtgtttgtcagcactccctaatacgtttaggtacttttttttttttttttttttgaggctagaatctcgctcttgttgcccaggctggagtgcaatggcgcaatctcggctcactgcaacctctgcctcctgggttcaagtgactcccctgcctcagactcccgagtagctgggattataggcacccaccaccatgcccagctagtttttgtattttcagtagagatgaggtttcaccatgttggccaggtggtctcgaactcctgacttcaggtgatccacccgccttggcctctgaaagtttgggattacaggtgtgagccactgcgcctggccttaggtgtttttttaaaaagtatattcaaaacaaatcagaaatttcttgcaaagaaaggtaaatgggtttaccatcggctcactgaaccaagtcttgtgctttgctttcccttggttccttagaggaaatgtagatttaaaaaatacgtaggtttgaaatttttttatatttgagttttttaaaagatggggtctcactatgttgtctaggctggtcttgaactcctgggcccaagatgctcccaagaggcgggtctacaggagcatgcttactgcacttggaaatgtagattcttgtcactaaaatcataaattcatttcttcattatgtttgtagtctgtggttaacagacttttaattaaaggcagttcttactgcttgaggcttctgggttgacagtggatggtcccccgggaggaaggttagtggagggacccagggctcccccagcgcataggagaaacacatttgcatttgcactgaatccagcttctcctgcgacaagtgtgtgggtgatgtagccttgtctctttccccactgcttatggctaatccagaggtttattggatgggcctgggaagtatgctctgatcccnttgtgggtccaggcgatgatgctgtgtggggagcctgaaaccacagggcaggttgacgggttggggcagcaggaaagggctgaggccccacgggccgacagagaacctcccttcttttctttgacttcatgacttagatagcttgtctttttttttgcctgagaagatttattattttacattcctatatcttgttttggtagaatttaagagagagtgtgtatgtgctcttctcagagtcatcctattttataggcaaactcagactgtcacagtgaacccaatcaggaggaggtcttcttcaaggatgtctctggtaagaaacaaggaaaatatgattgcttttttattttagtgatgtttttcctgaataaaatatgctttcaatgctgttaattttgagtttgaaccataaaagtgtattgatatttcatcatttttaaccaaagaaatggtaattttttcccataggtccaacctaatatttatattattatattatacatatttgaatattaggtctgaccttaatattaagaacttagactattggccaagagtaatcctaagttggtatatatttaaaatactagatgcctttaataagattgactataatacctataagcttcttatgttgaaatgtttctacaaggaaatgtgtatctattgcttcttgctcttagctttttagatgcagattttctggtggagcctaatgtccttggtatcagtcatagggcttgacattgccatttggggaaacagaaatgctagatatgttaagaactactgtgtcttcatgtttattttccatatataatatatttaattcctttagaagtttttttaacagaaagaatccagtggataataactttacctgtattacataagcaatgtgtttcaaccctgtgtcaaactctccatttcttagcctaaaccccagccctacgtgatgcctcccccaccgcagttgcactataatggacattatacagaaccatatgcttcttcccaaggtaaagtacactgtttctgccatgccttacatagttatgactatggataaatctgtgaatgcttggagatcatgaagcctggacagtttttggctgaagttgcaccccaaattgcatcatgataatagctatcctggattcataaaagaagccaatatattgttttttgtttgtttgtttgtttttttggagacagagtctcaatgtgtcacccaggctagagtgcagtggcgtgtctcagctcactgcaacatccacctcctagattcaagcaattcttgtgcctcagcttcccaagtagctgggactacaggcacgccaccacgcctggctaatttttgtattttttagtagacatggggtttcaccatgttggccagactggtctcaaactcctgacctcagatgatccasgtatatttgggttcttgaatgtatgtaaaaacatgcagtatcaaattttgatgctccactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaattgtatttataacaaacccccaagctgaagtttaagcagtcaattaacatttactctatactctctctgtrtggggctataccaaatgctaaggaggtttatgcagatgagtatttccacatcttaagaagtttatcttcagcctggaccacagggccagaccctgtctctaccaaaaaaaaaaaaaaaaaatagctgggcgtagtggtatgcacctccagtcccagctactcaggaggctgaggtaggaggattgcttaagcccaaggtgggggtggaggttgcagtgagccaagattttgtgctactgcactccagcctggatgacagagggagactatctcaaaaaaaaaaaaaacaccttagaatctaatagtttaagataagacaagtgcacaaataactttgtctttctcccctgaacccctttttcgtggagaatggggtcttgctatattgctcagggtggtctcaatctcctgggcccaagctatcctcctgcctctgcctttctaagtgctgggattataggcctgagccaccactcctggcacaaataacttgaatatgatagtttttctgagacagcatgtgcaattaccatgctcctcagtggaagagagactcatcacattggggagattgagaagaactttctgtatctgaaaagatgggtggatttcagcaggtagaaaggcaggaacttgactggggttgctgttcctagttttggggatagtgaacgccaggcacagaatgaagcagggtgtgtttggagagtagagtggtccaggtttcctctcgggtaaggaactggtagggagtgatgcatgaagggaccagaaggtgggatgtgactgtattgtttgtgtcggccctggtgtaaaagatgagggttttcatgcagtgaggtgggtagtagagagcagggctttgggtgtagagcctgagagcatccccctcaccatgttcttgtatttcctccctcttgcaccctgcccttgtctggtatttgcaatcccggcccctcccacttccaggacctggctgtcctctgcattgttagtctcactttgccactcattctcttccctctgtctataaacatcttaatattgttcattctcctccctttaagtaatggtttgagtgatctgctttcttttctcactgacttttttttttttttttttggagacggagtctcactctgttgcccaggctggagtgaagtggcgcgatctcggctcactgcaagccctgcctcctgggttcacgccattctcctgcctcagcctcctgagtagctgggactacaggcacccgccaccacgcccggctaattttttgtatttttagtagagacggggtttcaccgtgttagccaggatggtcttgatctcctgacctcgtaatccgcctgccttggccttccaaagtggggattacaggtgtgagccactgtgcccagccctttctcactgacttataagagtactctctgtgtgctgcttctgcttgctggttacccgcccactcctctgtctttgccactctgttaaagcggccctctgggagcctcccagcacccccacatcccctcaccatcacattcaagcctttgtaccttctggaaactctcctggcatgctaggtttttccctcctccttcccatcagtattgtttggtgagctctgcaggtctgtcctgtggctttttccctccctctgtgagcttcccagggatctcatctacatttaacatttcttttcttttcttttcttttcttttgagatggagtttcgcttttgttgtccaggctagagtgcaatggcatgattttagctcactgccacctctgcctcctgggttcaagcctcagcctcccaagtagctgggattacaggcatgcgccaccacgcccagctaattttgtatttttagtagagatggggtctctccgtgttggtcaggctggtctcaaactcccgaccttgggtgatctgcccaccttggcctcccaaagtgctagtgttacaggtgtgagccactgcacacggctgtgtgcaggatcattcttttgcctggtgttcgagactccacacaatattccctgagcctgcccttccaaccttacttcccaagttattttactcctctgtagctatctgacactctagccaccccagcttgcccaggggtgcaccctggctttgccagtgccgctctgcaccctcaggtgcccttaccccatgcacccttccgttcacatgctgccatgcagaccggataggcagggctatgctgtgctgacaaaatactccattccaaactctcagggaagtaataataaaggtcacctgtccgttgcacactgtactagcaggagggctctgccctgtctgagtctgccgtaggggcttgagctggagaggctcttctctctggaatgttgttggtcagtgttgcagttggaagagagcctggaagctggcttttaaccctctgtgcactttcccttgaccattactagtcgcattgttgtgcctgatatcaaggggtgaggaggggtaaccctgcgtgctctgagaggtggagagacctcacttctgatggaagctggacacgcccaccccacccacttacccctcaagtccccttaactgccatatcttgtgaggtggttcttggttctctcttccttgtccccatcaacccaactcaggctggaaatgagcatttcttcctctggactcctgtaacccttcatctcttctcccttccttgaattatggtgatttcatgcatacctttccccttttcttgcctgtattccaaccatcttttcctccttctattcttagtattgccttttccacataacagtctcataaatggctagatggtttgtggggtgcagaagcagggagactaggtgtatatagagctagttcagacaagctggggtaggggcccgagctgtggcagcagtgaggaaagggggattgcagagatggagccatgaccaagctttgcataaatgaggaaagcacagtgacatggaagtgctgtgtgtcagcagaagaataccatggagatttgagtgctatttcctcacagctgcatgtgccaccagaataaagtgtacccactggattgtggtgtattacttaagtatcaccatgatcacataaatcaccatggagctttcgaagcacaaaaagaatgcctttcagaggaaattgttatttgaaggagttggctgctgagtgttagaaatcatctagggttagaaatcatcctcagtaacagagggcaggtgagctacaaattgactagaagaaacatggcccctgtcatccctgggcagggacacatgcatagctattttaagattaggttaaactgattctgttagctgcaggtctggatcttcctgaaacatgggggccagggcagggggcagctgcagctgtttaatgtggctcctcttggcttctggacactttatgggctgtgtggctgctggtgacactgttggaccagagaagttcagatcctgctataccattacccttttacagtcgaagctctcatattcatttgggaagaacaataaaaatttccagttaaggaaatgcttacagacagttggtgcttgaactagctcagcagcagcaaggccacatccctacccagggaagaaaggcagagtccccagcccagtgccttgaatggtatctctgcctcaacttccccagagttccaaaaagtctgctagtctgctgtgggtgtggttcgtttaagacagggtctcactttgtcacccaatgaatgccaccccttaagtaggcagagccatgcccatcctatagatgaggaagccgaagctcccagggtcactcagatagtgtggctaaagctaggtcattctagcggggatttttacaagctgtgttaaaaatgtcatcagaggtaagggccgatctcagtatttggttggagtaattagtccatttaaaaaaatctcattttgaactcattttttctagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcaytcgctgcaggaggtcagcgagcccctcaccgccgcgcgccacgcgcagctgcacaaacggaacagcatcgaggtggccgggctcagccacggcctggagggcctgcggctcaaggagcgsaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgccycctgcacgtgcgcgcgagcctcggcccggcctggcccaggacccacctggctgccctcgcgtcctgctcgccgggccyctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggggtaagccacgcggcgagcagtgccgggccaggggaccgcgcgttcgccctggcgcttctttcactcatcacgtcccgtgtttttcagctcctcttgttcttttaacgttcttcattcccccacgtcactctctttttgtctaattctgaacacatttaaatttatggaaatcatggggatccacttgaattttagtggttttactggagataattattatagatgaagtgaaaaggtaaattcacagggttttgtcgaaatggaaaagatgaatgaaatgttttagtaatgcactgttaagggaaagacagttaagatttcattactttagccacgattgctttagccacccattaaaaatactgtgggtgatgtggcaccccaggggtgcatttgtttagtttgctcaagagatatctgaaaaaagcatccaggaaagtgtacccaatcctaatataattctccaggttggagtgtgtgtggatacagcttacatatcttggccgtgattctccagagtgattctggagttgggaaggtggcactttgttaaggcaaatcctgagacgtccaggtttcttaaatttaaaagaaagatgaattcagctgagaatctaaggaaagtccccggtagaagatgcagttctttaatattcagcctaataaataaatatgaattaagcactttttacctactttgaagcaaaatataaaaaagcatagtagcatcatctctagctaccatccttggagcatttgccatgggccaagcatttcctctacttttgtggcctatttacagtaagcctattgttatgcctgttttacagatgaagaaacagacttagatattaactaacttttccaaggtcacatgactagtgagtgactgaactggaattttaaacccatacttagaagcccattctgttatcatctacactgtagatgtatgttctgcattgaagtatactgtatatgttctattaagtcataattgcttgttgaagccttgctagtctttcactgaaacttttaaactcagtccttaacctgggactaagcatctgcggccttgtcatgaagtgtgtccaccgaagtgattttgttgcagtgctcaggcttccagctcttcctggcccacatctccactcctcatgccctgcacttgagccaggctaacttgattagggcctccatcctwtctcctgttggcttccagtgtcctggcaactagggttctcctccccccatcgctgctaaactgcaaactccgacaggacggctcatctcaagtgtggttctggcctagtgtatgacatcctttaagatgctgcaaacatcttgctaaacaggaaaaaacgcacactattatagtacttatgaaagagattaatgtacatagacaaaaactacttaacaaaaaaagtaccacagatttaaatttgctttttttttttttttttttttttttagaacagtcttgccctgttgcccaggytggagtgcagtggtgtgatctcagttcactgcaacctctgcctcctgggttcaagcgattcccctgccttgtgatctggctgcctcagcctcccaaagtgctgggattacaggtgtgagccaccacacctggcctaaatttgctttcttttaataagttttgggtttgaattttaagttgatttttaaatttttcacaagtatgcaacataactcacatccctgaacagtaaaggccaatgccttcagtggacacagatttaagagtgtagggagcagtgattcaggataaggtgtgggtagattttccaaagtaactctacctgaatccctgagccagctggacagggtccttttatagttaacacccttcccattgcattaagaacggtctgtttttatgtgtgactcacgtactttccccaaatgctatctgagtacagctcagtactcaggcctattttatccctgtatgttttgaatggggtctggtaggttcagttaaatctgaggactttgatcaatttggttctcttaaaagaacttttctctcccattgacttttaagaccacaatactagtaaaattatgtgattggattatgtttttggtcctttttgcttaaaggattctacttaaggaatgggtatggcagctgtggtcacgaggaaagagcaaaggtcctacaagttaagaacgttggggctgagtctagagcctgccatttgttagttctctgtgaccacggtcaggacccttcatgcgtcagaacctcagcttccacatcagataacctcagatcatgaggacggtcatcccttcgctgcctgcttcgtggcattatgtcccacatgcagttaggcatgaaaaaatgcctcctgaattacatgattcagtgtaactgattttaaccaaagatttgcttttatttgttttgacactgattaccttgtaaaagaggcagccatgtgacctcagacaagctatttaatctgtgactcagtttttacatttgtaaatgagaggaccccagagagttgttggggggataaaaatgaggttctggcacattgaaagagattagtcaatattaacattactgtgaggtggcatcatatatttaacttaatggctttcaagagtggaagaggccaattccctattgtaccctctgacctttcatagtaacatggggttgccattatcttaatcgttacaacaaatttcctaatgtgaattaaggttatggaggtttagtattaaaaacagtgaaataaactgtagacaagtaggaatgattttagaattctccacccatctccacctccagcaacctgattgttatcttaaaggcagactggtttgggtgctcatatatctacataaagattttctttttgttgtaccctttagtgcagtggttctcacataagaaatcactgtgcagggtatgcattaaaatcctgtgcttatattctaagggctaattaaggcatattcaaggctagttttgactacatacaacattcttccaatactggcttttgaactgacctcacagccaatcagctttatccagcgtgtcccagtgtgggatattttgagtcattttcaggcagagaagtgccagagctagttcatattgactagcaagagccgacttaaatgttcaggaarcttgtgagccaattgatgtgacattaacagtttgaaattggctgtgatgggagtatttacaccatggatatgggcaaacaccgatcaaaacttccttccaagagccwgttgttaaatattaccagcacatcactgttttctgcacgttagaatcattaaatttcagcctaagcaggaagtgtttagtctgtatgcctgtgtctggatatatctgtctctttctgtctaggtgaggcttacagaggaaaggtgacttgcctgaaagaagttggtcagttagaggccagatgtgaacccaggcctctgctgtttatagtctagactgcattatgtggggagctcatgatcaaatattaattataaaattaaaaattaatccacttagcttattgagttaggtaccaatcacagtctccaattacagcagcaatcttttaggatttttttcctctctcaccaagttgccttttccctctgttcttgcaccattatcatggggcttcatggcctgttacaggctgagagagctggaataacacggattttgtttacagggcagaaccattattttccagttggggctactcattatattgatatcatccaaggaagtgtagtatatccaacgaaacttagtgttctttttttttttggagacggagtctcactctgcctccaggctggagtgcagtggcacgatctcagctcactgtaatctccacctcccaggttcaagcctttctcctgcctcagcctcccgagtagctgggattacaggcatgtgccaccacgcccagctaatttttgtatttttagtagagacggggtttcaccatattggccaggatggtctcaatctcctgacctcggcctcccaaagtgctaggattacaggcgtgatcccccgcacctggtcaacttagtgttcttatgcttactattctcagagaggaaaatcatgctctaataataattttaggaaacacttgatttcaggagacaagattttgttgatgctttctcttctgtcctatcctcctggtgtcatgatggagattttagccctgttttattttccttgtttaaaaacgtagccgttctgagaggtagcgtgatctaacccgggtcatctaagtctgcactagaatgcagagtagcatatgaggagggggcttaacacacaaagggggctgctgcagaaaccatttaatttttcagaatgacttaaagaatttatatattttaaaaattataaaaagctgtccgggcatggtggcacacgcctgtaatctcaagcactttgggaggccaacactgcttaagttcagttgtttgagaccagcctgggcaacatagtgagaccccatctctacaaaacacacaaagattagttgggcatggtggcatgtgctggtagtcccaggtactcgggaggttcaggtgggattgcttgagactggaggttgaggctgcagtgagctatgatggtgcccctgcattccatccagcctgggtgacagagtgagaccctcaaaaaaaaaatttataaaagcttactatagtcaattgattgcatttaaagcttttgttttttttttttttttttttttttggacttcagctgatttgttacgtctgtcttgttttaaaaggaatgcagtctgcctggagcctcacctttcattacaacagaactttgtaaccaatagtgtttcaaaaccttctatctggaagactttatcagggctttggccttgaaaggaatgtcttcctactmatgtttgttaaacaagtggtgtgtgaaggagtgtaatctttctgggtttattggcaaaggagaacactccctctgtgtgttcctggtcttcagtgcattgaaacttcttttcacaggggttgtatttgtgtatatttcatatatacatataaatccttttacagggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaagggtatgtatgggacacacagggctttgtgccttctctggaacaaccggtaaatactacgcaaatgccttcatgagattttggtgaattttctaacacaatttaataataaatgagtgttaaggaattttgtaatatgggcctcaaaattggggcaaatgtatagctaatgtcttaatagataatttcaggttcgaatgctgattttttgtttgtttgtttctcagtgttcttttttaccttctcctggccttttggagcagtcttgattttgatggccttaaagtgagaagaaatctacaaaaatacaggagcatacaggggaaaagcagcagacattgacttttattatactgaaagtttatctcgagagtagtttctcaatttttcaaaacttcctttgtgcctgaggtgtattttctatgaggttttattacatcaaaatcagataggcatacatttgctttacaacgggatcctggaggtagtttcgaatatttcctactgctttagtcttttatatatcgtatgacataaaatggaaacatttgttcatagctgttggaactcattatccgtcccctagatttacttactgttccccaggagaattccatctattaggggtcacaaaattgaccacagatctagagaaaatgaattcaacaaatttctttaggccaattttcaactttaaacaaaagtttgcattatatttctcaccaaaatgattgtcttttgttcttttaactcttgttgttgtggctttttaaaattttaacttcattttcacctagaattttgtttctgttttggttttggtttggtttttttgagataggttctcatggttcactgcagcctcaacctcctgggctcaagcaatcctcctgcctcatcctcccaagtagatgggaccacaggcatgcacyaccacacctggctcgttttttaattttttgcagagacggggtctcactgtgtttctcaggctggtcctgaactcctaggctcaagtgatcctccctccttggcctcccaaagtgcagggattacaggcatgagacaccgtgcccaacctagaattttcaatattatacagtgctagatttgaagcagaaaacaagatttcaaatatacagtcaaaaggtagccacgacgtgtggctgtattcatgttattacacatattctgttttatagtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgngagagtggagttggtcccaactaaagaaaacaacactggttacatcaaygcatcacatattaaggtgagaggaacgcctcaagtaatcaacagcacatgcagtttcagttaagttacaagaatggtaagaattgtattcatgtctgtttagaattcagatattttaaaatttatttttattgtattgttttagataaacaccctagttttaaacatttgtgacaaactgtactgcaagctgggaaatccacayaccagtgctagataaaaagygtctatcagacagagccaaagtcatgtctactctccatgtgcgaaaccactctgcccccaacactgttaccaggactcagggcgcacttatttgcccggcttttttttttttcttttgccttttttgagatagagtcttgctctgtcgcccagacaggtggagtgcagtggtatgatcatggctccctacagccttgaccttstgttgcctggctttagaactttgtccttctaaatctgaagacctctttttagctcataaattctgggagccactgaattgctagtttttcctcatcacatactgacatgcatttttatgtaacaaaagtgtctgggctttttgatggtgttcacaaaagctttcaacttaccaaggtgccatctgttctctttacatactctttataataatttttaagtatcatttttttctttgaagaagtgcttttttcctggaaccagtataatgccattaaactggggtaatgtttatggtgagagatagggggtccagttttacttttctgcttatggatatccagtcttcccagtcccatgtatttaagaggctgtccttccctagtgtatgttcttggcaccttatctggggtaatatcactcctatgaaaatggacaaaatgatgattcacaacacatgatggaataaagccagatgttccctcttcctcattgtaccctttgttcatgctggccacattcaattctttattttgggaaggagaaatctcatggtgagtgaatgagtaactgtggacaggtggtggtttttttctttagtttgcaagtattatttgagaagggaacaagctgacaccaaggctttctggagactggcagtctgcctgtgaatgccagtaccccttgatggcttttgggaatctatgcacatactattttgtttttaaatataatatcagcataatttacttaaaaaccgagcatttccttgaaataactcatccagtctctcatgactagatggataagaatgaatgatactgtagttctgtagtgatatttcaaaatcttcagcagccacttgcagaatagaggaaagaatttgatagacctgggtctgacgcctagatctaaaatgaggtgggacctcactttataagctgtgttgtgggacctcatctcacttacatggaaataaataaatgatgacacctaccctgccagcttctcactagtcccctcctcctccctagtgtttattcactgttataacctggtactcatccacagtggcagccactgggtgctcagtgagacgatgtggagcggtgactagggggctggcagccctgagtgagagtgcgtgtggcacaaggcttggcactgggttttacgtttagtgagtgtttggagacagttattgtcgtcactcaatattggtgaagccaagatttaacccaggtctcttaaccacaaatctagtaattactgttgtattagactgctctcaaggaagttaaatctgaagtggaaacttaatattattgtggagagtgaccttgactcagaagttcagaggtgagactatcttaagtaggaaggttttttttaaagaagaggcaccatgtctgcaataacagctacttattgagttatgtgccaggtaccatagatactgactcagtcctcacaatgaccctatgacggtaggcagtatctttattgtataaatgagaactgacattcagcaaggttaaacaggttgcatagatattatgtatattcacagtacctaagtttataaaaatgtcagtaatgcaaattgtattcacaagggaaaagatgaaaagtctttccttattctgctgaataatccagtttactacttttttactttttacttttttaaaaaaacttttttagtactaccatgaatgcatgcatacatacctatgtatattatacccacacatcaatttttttaaccttttctaatcccaggtctctgtcagtggaatcgaatgggattatattgccacacagggaccattacagaatacctgtcaagatttttggcagatggtatgggaacagggaattgcaattatagcaatggtgacagcagaagaggtaggtacttayttctcttaagtgattttctcagcctctgaagaacagttaatgttaatcatctggaatcctgacctgtggagaaaaaggcagggtagggttgtggttctgtttcagatgtgccgtctatgtgagaaaggcatccattgccggatctcgagtcatttaaccatgctcatctttaacaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatgtgagtgactttaactttgttccgaggacagctgcctctggaggtgttaaacagagaggaacatttatgtttccgaaatatttcctttatgttatctcatataagcttcggacttgttttaacataaagaatacaagtgttttggggagggttaacgaggtttataaattatgatttggtagtgagtagaaygccacagctgactcagtatctccgtcatttcattttgtagatcagaaagtggacagaggtagtgacttgctcagggtcacactgtccctttgtggttgggtttggttcactggcacccagtgctctttatctgcagtcctcttaatcagtggagagaatatgaagattgagtcaacaatgtgatacgccttgatccttgagtacttttctatttcattgattttccacagcatatcttgaagagatccagtctgttcgacgccatacaaatagcacaagtgatccccaaarccccaaccctccgttgttggtccactgcagtgctggggtaggaaggactggcgtggtgattttgtcggagatcatgatygcctgcctggaacacaatgaggtgatggcgcttatgatcacctggcctttttgggtggaaatraggctggggaagagarggacatagtgacttaatagctctttttgcgcacatttccttggactgtggtggcctcaagatgttactaatgttccctgcaaaaggctgtgtcttcttggagagtctcagtaccaattagcatattaaagactaagaagtcatacgataaataaagctgtttaattttgttttacttgcccagggtttttcaaatttgagctcagaattctttttctgtttacatttcaaggatgattcatgctgcccagagcccttgagggaaatagctagatactgatagcacttagcacactatgtttttgtataattttggtatttagtgagacatggtaattatgtccaaccatacaaagtcagtgagctacacctggggaatgttgaagaaatagtctgcatggacattctatttatagctaaaactaatcagaaaatcagaagtaggcaatcatggcttatttctagaagacgctaaggtggaaaagagactgtccatctccyaaccaggtttctgccaggacactcgtgtcctcccatcctttctgtctcccnaggggaacacattatcttcattaccgtttctctcaacctaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttccygttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgagggcaaaattactgtttaatattactcttaaaatgttgcatgtttggcgtcattcctaagagccatgtaattttaaacttttaattgcagttagtgaatatgaaaggatttctgaataaaaatctatccacattactgagctttgaaatagtatcattttcaagagcaaactagaacattaagggttcataggtttactgcctctgaaatgagtatattaatgtctgccaaacttacacaatgcttcatgtatcttagtgtcttttaataagaattatcaaaatgtgcacttccacaaaacgtagagttataaaccactgttttccactgatcaattttggtatctctggtatcagttttcctgattagtggggtcttttgatgaaatagtttagcttagttggtagttttgagcacagaaagtactcattttattttttatttttgagacggagtcttgctctattgcccaggctacagtgcagtggcatgatctcggctcactgcaacctctgcctcctgggttcgagtgattctcctgcctcagcctcctgagtagctgggattacaggcatgcaccactatgcccggctaatttttgtatttttagtggagacggggtttcaccatgttggccaggctggtctccaactcctgacctcaagtgatctgtctgcctcggcctcccaaagtgctgggattacaggcgtgagccactgtgtccagccagaaagtcctcattttagaatatcatttggaatgcttattgtagtcattaatttcttctggaacatctactgtgaagcattcagaaaatgctagaacttagactttaaaaccctttggtcgaattagaagctgggcctgtgcttccttagaaacgtccagaaagcaatgtctagccagaaacaggaggaggagggaggagagtgtggtgttgtgggactgagtggcgacagcatgacgtggccagcttttctgtgaagctttcaccatcagtcatttcagaagggttgagatgttaaatgttcacaatattaagaaaatttaaatatacaactatgtacagtaatataaactggagattagctgcagcttgccaagagcaggtttattatttgagatttgcataaagaaatggaaacaggaaattattgtaaataagactttttttttcttttttgagacggagtttcgttctgtcacccaggctggagtgcagtggcacgatctcggcttactgaaacctccaccttctgggttcaagcaattctcctgccttggcctcccaagtagctgggattacagatgtgcgccattacgcccggctaatttttaatttttagtagagatggggtttcaccatgttggccaggctggtctcgaactcctgacctcaggggatctgccagcatcggcctcccaaagtgctgggattacaggcatgagctaccatgcctgactgtaagtcagactttttaaaggaactcttttggatagaaatgtagttgaatttgcttatcagcaagatttcatgtggaacaagctaaaactatccctttccagtttaaacttaattttttaaaaaaagaatctaaattgcagggtgctttcttttgagctgagggatggacatttcaaaagtagaggaatagctgcattagaaatttgcctgggaaaacatttctcaaaagaatatgagcttttcaaattcctggaaataagaactccatttaccctactatctaaaattatttatagaaaaatgaggaaggccggtcgtggtggctcacccctgtaaatcccagcactttgggaggccgaggcgggtggatcacgatgtcaggagtatgagaccagcctggccaacatggtgaaaccccgtctctactaaaaatacaaaacttagctgggcatggtggcacgtgtccagctactcagggaggctgaggcaggagaattgcttgaacccaggaggcagaggttgcagtgagccgagatctcgcctctgcactccagcttgggtgacagagcaagactctgtctcaaaaaaaaacaaaacaaaaacagaaaaataaggaaatgtcaggaaattcagatcaaagtttgcatgtctacttgggtagagagagttttagaaaacatttgaagtccttggattgttaaagtggtggcatagttttctgggtatttcaggtagttcccaaataaaaaatatgctctaaaagttcacttgtatgttgacttttagtaatatttacccatgcaaacaatactcttggtgttagccttcttagtttgtgccctcaaagcttactgaaaccataggggccctgaaaggtaagcagtggtacagaaccaaaccgtatctgtatgtgttctgtactccaagaaattatagggcaacttttctccctactgcaccctgctggtgagatcagagaataaatactcctgtcgggcagtggcaaccaagactcagaaagcaactgaagttaagtgtctgttttatgggaaacttttcagaacgtatgccagcgtttgttgcagaaacttgagctgtgcatgggtaaggaacagaatgggccttataatgtgagcagggatcttgctaatgaaactgtctgaagtggggcagggggtgaaggagggcaaattggcaaaactgtcccctacctttcctgttgccacttatatgtcctccttaatattactggcttgaaatgggaagtaagggatggcccaagaaggaaggtgaaggtcttcagcacccagctgaaggagcagcagttccaaggcaaatgctattatatagagggtatccctaggtcacatacaagtaaaattaaggtctgtctgcacatcatatttccaaaaatgttgacattacccatgtgtattctaaaaaatacttaattttcaaaaatctaaagaacatctaaacaccttccaacattttatgggttactaaagggatagtaaccatatacttttgagttatgctttaatattataaatagggacaaacggatgacaagaaaggaatcattgtgtttgaacttctgtagaacttcagaaatagtatggcttgcgtactgttccaaatttctgaaaattacttattaactagataaatgttttgatcattattccttaactttcattaaatgactttgtggtgtgtcaaataaacgcactttaaaatctgtaaaatcccttggctctgaatcgacaatgtggtgtagctgcactggatatagcagtacacaagcgacataatttcagtgttaatagacctacaattttaactgaactggtaggtggtttttaaagtgtgtacaaagactactacttaatttcagttgtcaaatgtgaaaccactgacatttaagtgtgcgtgtgtaacttaaattcacactctaaaaacttggtaaaacaaacatcttcagtattcactcttaaaaacagatgtccattgccaaagaaattcagaaggttggatgattacctgggttagacaggatatgagtctgtcaggcctcaatttttttagtaggttgatgagactagtacagattcaataactagttttcatttctgtctgctcatcagctgagaaaaactgaacaaatgaacagggaatataaacgtattcatttttcataagatacagatattacaggtcagactgtgaccatatgctgagacggtccaaatttttttatcctggaagtttattagaaatcacttgaaattaatggaccattgaatgagacaaatattttgttacttacagtgattaatatttattgaaatgtaatttaatcttagagttaagtgtcctgaaaggattttggtaaggttttgtagttttactgaaataataccagtgcaacactggttcagaccaacaaacaggttgaaaaaactgaatattctccagagacaacaagtttatttctagaacaggtttaataaaaacaagataatacagaatacttaaacccctgtaagtcaaacaaaaaggtaaaggaaaaaatgtaagaaaaacatactgtttgcggttccaagatagccaaataggaacagctccagtctacagctcccagcgcgagtgacgcagaagacaggtgatttctgcatttccaactgaggtaccgggttcatctcacggggcttgtcggacagtgggggcaggacagtgggtgcagcccaccgagcgtaagccaaagcagggtgaggcatcgcctcacccgggaagtgcaaggggtcagggaattccctttcctagccaagggaagtggtaacagatggcacctggaaaatcaggtaattcccacccaaatactgagcttttccaatggtcttagcaaacggcacaccaggagattatatcccacacctggctcggagggtcccacgcccacagatactcactcactgctagcacagcggtccgagatctatctgcaagatggcagcgaggctgggggaggggcatccaccattgctgaggcttgagtaggtaaacaaagcagccaggaagctcgaactgggtggagcccaccacagctcaaggaggcctgcctgcctctgtagactccacctctgggggcaggtcatagccgaacaaaaggcagcagaaacctctgcagacttaaatgtccctgtctgacagctttgaagtgaatagtggttctcccagaaaggagtttgagatctgagaacggacagactgccccctcaagtgggtccctgacccccgagtagcctaactgggaggcacctcccagtaggggcagactgacacctcacatggccaggtgcccctctgagatgaagcttccagaggaacgatcaggcagcaacatttgctgttcagcaatatgtgctgttctgcagcctctgctgctgatacccaggcaaacagggtctggagtggacctccagcaagctccaacagacctgcagctgagggtcctgactgttagaaggaaaactaacaaacagaaaggacatccacatcaaaaccccatctgtacgtcaccatcatcaaagagcagagatagataaaaccacaaagatggggaaaaaagagagcagaaaagctgaaaattctaaaaatcagagcgcctctccccctccaaaggaacgcagctccttaccagcaacggaacaaagctggatggagaatgactttgacaagttgagagaagaaggcttcagacgatcaaacttctctgagctaaaggaggaagtttgaacccactgcaaagaagctaaaaaccttgaaaaaagattagatgaatggcgaactagaataaacagtgtagagaagtccttaaatgacctgatggagctgaaaaacatggcaagagaactacgtgatgaatgcacaagcttcagtagccgattcgatcaactggaagaaagggtatcagtgattgaagatcaaatgaatgaaatgaagcaagaagagaagtttagagaaaaaagagtaaaaggaaatgaacaaagcctccaagaaatatgggactatgtgaaaagaccaaatttatgtctgattggtgtacctgaaagtgatggggagaatggaaccaagttggaaaacactctgcaggatattatccaggagaacttccccaacctagcaaggcaggccaacattcagattcaggaaatacagagaatgccataaagataatcctcgagaagagcaactccaagacacataattgtcagattcaccaaagttgaaatgaaggaaaaaatgttaagggcagccagagagaaaggtcgggttacccacaaagggaagaccatcagactaacggcgaatctcagcagaaactctacaagccagaagagagtgggggccaatattcaacattcttaaacgaattttcaacccagaatttcatatccagccaaattaagcttcataagtgaaggagaaataaaatcctttacagacaagcaaatgctgagagattttgtcaccaccaggcctgctctacaagagctcctgaaagaagcagtaaacatggaaaggaacgactggtaccagccactgcaaaaacatgccaaaatgtaaagaccatcaatgctaggaagaaactgcatcaactaatgag

SEQ ID NO: 10651 - DNA, 12538 bp, Homo sapiens
tttgttctaggttgtgttaatttttttttttgagacagagtcttgcttgttgcccaggctggagtgcagtggcgtgatcttggctcactgcaagctctgcctcccaggttcacgccatactcctgcctcagcctcccaagtagctgggactgcaggcacccacgaccacacctgactaattttttttttgtatttttagtaaagactgggtttcaccatattagtcaggatggtctcaatctcctgacctcgtgatccacccatctcagcctcccaaagtgctgggattacaggcgtaagccaccgtgtccagcgtgttaacttcttaagagaatatcttttaagttgggttgcaaagtgcaaaatataatcgagctgtttcagatttctaacacttctgtctgacaaatggcaatggtagaactcagcgggtgctctctatagctgtttcttctactatcatttagaccaaagatacaccttatgcatacgtacatcaaatgaaggtgaatagtgggagttgaagcttagagagcaattcaaggatcagtgggaagaatgtgaaaggctaaggtgtagaaattaaacctaaattctcttggaaaataggtagtatctagtagctatttttaaatctatttagaaggtaatgcaatttctttagattttggggcataaatgaaggagaacatttagtatattaaatggaaggagacaaaagatggtagaattacatttagatagaaatcaatagctttgatcaaccttaacattttagctaaaggtcaacctttattggtctagacctaatcataatagattagagcatgtaaatatttgaactataaaaattctttaattcatggagcatttttaagctgatggattcaagcataatttactttgtatttaatctttctggtttagactttatggttatgccttggtattattatcaaattgcaaatccactcttgaataccagctacaagaagacatgtttaaaggtagaaggaggacataactcagtttgctttgcacattaaaacattttatttggattaatcagagatattcaaggaaaaaccaggtctgaagatgcatgagcatcaagagagagttgggggagcagagatgtcactgaaatgatgaactattccatcctggtcctctgctcaagcaacgcaagctatccagaacactgattgatacatctttcagtaagtgaattcggcacatccacagtgtcctaactaggagtttcattatctctgagcagcttaacaacatcatggtacttagcatccaagtaaaatcgaacagttcttcagaaatcagcacaattttgctgtgcttcccctttcattcttaagcgatcagcaacctggcttttagcaggtgggctcacagcagtggcagcagcaggctgggcggcagcaggactgtccacagtaggacgggcggcagcaggaggcctcggcgtggtgcagctggcagcaggatgggggtgtgcagcttaccaggtagcaggggggcaggcaggtgccctccacgtggcaatctgggtggcaccacctgatacgggtgctcacagatccaccgctgccctcctggccatagccaatgccaccaccaatgccacagccggttccgcaggagctggtctggcagcagcttggctggcagcagctagtttcacagcagcttggctggcagcagctggagccacaggtcccactggtggaacagctggccatggtgtcaggagttgggttgagagctgtgttaagagaggtttctgagtttgggctgtaccttctatatctgtcctttgatatgttccctagagctgcatatttacccaacaccttttcttgatgtcaatttcagtgtgagtctctggctaatacctgaggtgtttataaagttataaatagcatttcaatagcctttttccattgtacaattaagtctcattatgtttcttctttgccctctgggcgaagtgaaggctcatcatggaagccaagcaccgaagtgcctctttatgcaagtcacatgacagactagccttgagccaagtgtcgccctggcacgttttgtcatagttgtcctttgataacctttaggcagaatttatcttaactgatcatttttccttaaatggtcacttaactatgatcatgattttataaacaatttgtccagacttggaaagactaacattagtgtcatcaaaacatgaactacaacctgatgtatcaactttcaaaccaagtatgcctttctatgatcaatttgtgcaagttataggatcctcagagctctatctaatattcttgccttcagtaatagtgaatgtacaaattgctaactaaaatctttaatgacttttgcttgtagattgttttctgactctattaaattaaacatatgtgctagtaatgagtacacattgtaacaagtcaaagagtacagaggtatataaagaaaaattagtgtcttttcccttcctggaagatgcacacatctcttccaaaactaatgctctagaggtaatcaatattaagaatttggtgcacattctttgacacctttatccttgcttctgcaaatataaaccagcatatatacatatatatcttctatttcagaaaagtttgggtctcctacacatgtttatagttacaaatttttaattgtggtaaaatatacataccataaaatttatgaaccatttacattaaccatcttaaccatttgtaaatagtcttgtcacccttgttgaaaatcatttgaccacattcacattcagaagaaatgaaattagaccattgtctcacattatatacaaaaaccaacttagaatggattaaaagactgaaatgtaagaaagactcaaaatgataaaactataagaagaaaacagaggaaactccatgacttttgcctggccaatattgtgatattgtgaacatgaatccaaaagcatcagcaaaaatagacaagtgggattacatcaaactaaaaagcttctgcacagccaataaaacactaaactgagtgaagacgcaaaccgctgaatgggagaaaatatttataaaccacatatctgataaagggttaatatccaaagtatagaggaaactcaaacaactcaatacctgtagtaagaaaacaaataacgtaattgaaaaatgggcaaaaaatctaaatagacatttctcaaaaaaaatctacaaattgccaacaggtatatgaaaaattttcaaaatcaccaatcatcggataatgcaaattgaaaccacaatgagatatcgtctcacacatattagatagttattatcaaaaagacaaaagatagcaagtgttggagaggaagtggagaaaagagaactctggcacactgttggtggaaatgtaaattagtacagccattatggaaaacaatatgaaggttcatcagaaaattaaaaatagaactgtcatataatcaagcaatcccacttctgtgtatatacccgaaggaaagtaaatcagtattttgaagagacatctgcattcccatgttcattgcagcattactcacaatagccaagatatggaagcaacctaagtgtccatgtccatcattaaatgagtggataaagaaaatgtgatacacacacacatacacacacacacactcacacactggaatattattggtcataaaagaaggaaatcctgctatttggggcaacagattaaacttgagaacattatactaagtgaaataagtcagacaaagaaaaagactaatattgcactttctcacttacaagtggaacttaatgtaaatgacaagttattgggtgcagcacaccaacatggcacatgtatacatatgcaacaaacctgcaagttgtgcacatgtaccctagaacttaaagtataataaaaacaaaaaaacctcaaaaaaaagaaaaagttgaattcatggaagtagaaagtagaatggtggttaccgggggtagggtggtggtggagtgtgttgggaagatgttggtcaaaggattacaaaatttcagttagataagaggaataaattcaagagatctattgtacaacatagagactatagttcataacaatatgttacagtcctgaaaattgctaagagagtagattttgtgttttcactacaaaaaaacttatgtgaggtaatgcatatgttaattagtttgatttagccattgtacgaagtatacatattccaaaaaaatgtgttgtacacaataaatacatataatttttgtcaattcaaataaataaataaatgaactcatttaaccatatgtgtatttgagggtttatttctaggctctctgttcttttccattgctttatatatctgtctttatatcagtatcacactgttatgattactgtagctttacagtaaattttgaaacaggaaaatgtgagaccaactttgttcttttttaagattgttttggctatataggaccccttctaatttcatatgtattttaggatggatttttttaaaatttctgcaaaaacatcattgggatttttatagggattgcgttaaatctgtagattctctgggtagtattgacatcttaacaatattaaatcctataatccatgatctcaggatgtcttttcatttatttgtgtcttctttaatttctttcagtaacattttgtagtttctggtgtacgagtctttcccctccaaggctaagtttgttcctaagtattttattctttattttattattattattattatttgaaatggagtctcactctgtcacccaggctggagtgaagtggcacaatcttggctcactgtaacctccacctcctgggttcaagcaattctcatgcctcagcctccccagtagctgggaccacaggcatccacgaacatgcctggctaatttttgtatttttagtagagacagggtttcactatattggccaggctggacttgagctcctaacctcaggtgatctgcccacctcagcttaccaaagtgctgggattacaggcatgagccaccatgcccggccataagtattttattcttttgatggaattgtttttaaaattttccttacagatttttcatggttagtatatagaaatgcaatttattttttttagtagagatggggtttcaccatgttggccaagctgatctcaaactcccgacctcgtgatctgtctaccttggcctcccaaaatgctgggattacaggtgtgagccaccgtacccagccagagattttgatttctgtaacttcctggttgtgaaagcactgtgtaaggttaagttatggtaacagagcctttgccatttctgaggccctaaataactacayttactctatgtttttatggtcattaacctccactggacctctggataacaaatttcctaatgtggtattagaagagaagggatatcaaaagcagattaaagtttttcatatgacattctatgaaatatacatcctgagtacactcaatgaaaaaaaaaagatatgtttgttgcaccaatagttaaaatttattagaccttggtatattattcctctttcatagggggtgcaatttgcaggacggtgggatacaggaagtgagtgtcctgagaaggacagatggctcttccatggtctcgtcggcgctgagactcagagcgtgggcttcaatgcttgcaaaggctcagtttcaaggtaaatcggctttttcatttcttgggtcaaatttgtattttggcgtcctcagagagaagagtaaggtctttctggaattgaaaggaatcagataattctgaggccaaaatatttggtaacccccataagaaagacaaagaaaggttgaagaatttgttcgttgtccataagtgcttgaagaaataattcgttcatgaatggaactgaaagtggaaatttcaagttgaaaatcagcaaactggcttttagcaggtgggctcacaggagtagcagcagcagactgggcggcagcaggactgtccacagtaggatgggcggcagcaggaggcctcggcgtggtgcagytggcagcaggttgggggtgtgcagctcaccacacagcaggggggcaggcaggtaccctccacacggcagtctgggcggcaccacctgayacgggtgctcacagctccactgctgccctcctggccatagccaatgccaccaccaatgccacagccagttcygcaggagctggtctggcagcagcttggctggcagcagctggtctcacagcagcttggctggcagcaactggagctgcaggtcccactagttgagaagctaggaaatccgcagaagctggtctggcagcagcttggctggcagsagctggtctcacagcagcttkgctggcagcagctggagccgcatgtcccactggtggagcagctgggatatccacagaagctggtctggcagcaggtcatggtgttgggagctgstatgaagtctgggttgcttggaggagtttctgagttttggtgatggctgccacattgggccttttataagcctgggccagctactgtttacataattccagaagtctcttgcttatttgtgttggataatttgtctctgaatgataattggcctctccctgaattatttgttgaacctactgagagcctttgaaagttgattgtatttggtctgcaattaggcttctttaccatggtcaagaagtcattggcattaattaggaatatgatccctaactcctcatgtttcttaaaatttcctcatggtcaaggaataattgactgatgcctcacctttaaggattgtcaatattactcagtgttgacccttacaactgggtgattgggtctcacrtgacagtttaattccctccaattttaactgtggctccttctctaacttycttatcttccctttgactgtgaagcaagactatattcagctggccagaaagggatgctttcttgggcctgggagatttgcattaattgctattgataacattttcccatcactgattatgtgcctaaatagttctgagtacttcgcatgtatcaatttgctgaattttcacggcaatctatgggctaggtatcactgccactcccatcaaccatgtgagaaaactgagccacaacaggttgaagtaacttaccctagttcacactagtatctagtgaatctgaaatttgaatccacaacctctgattccagactaaactctttaaacactatagtcaattctttctctctttctctctgtctttctcccttccttccttccttccctcctttcttctttctttctttctttctttctttctttctttctttctttctttccttcttttctttctttctttctttctttctttctttccttccttccttccttccttccttccttccttccttccttcctttctttctttctttctttctttctttctttctttctttctttttcttctttctcctttctttctttcctttcttctttttttatgtaaaaagtcattctaaggaaattccaatggtgaaagcaagccgtaaaaatttgcttcctttcttacggacttttttgagagtaaaaggaaggaagggagagcttagggtaagtaataacacagtttactacagccattcctagagattttatttatttattaacagcataataagcacagttcaagaaaatcttaagtgctaaaaaagttaaccttcttgtgactttgtctcatcttttatcttaggatattctatagatttagattttttaactgcataaaattatagtttttaacatattaatactggagtatgtgatttactacagagtgttagatcggctgtatgcagtttattatagatattagagactaatccagtgaactggaaagtttatataatttgaatgagacagctgatgayggtgaatataaaggttttgtttagatgcaataaaaggtgaccaggcctccatggagtatgggttcattactgagaaatgcaagttacgatgctactcttggattttgaaccagaacaccaagtggtagttctgcttctctagaaatgacagctttgagtttacatcataactctttctgagtcagaattaagacatattttcaaatcccacatcaaatttggtttaaaagatatgattctttgtgaattccttgcttcttcttaagcaaagctacatcacagattctttgattagctaatattttttatgttggatgcttgaaatacgtgggtgtgtcatgacaacaatctcgggagctatttaattcagatctaaatttagcagaatctttgatactaaacagatgtatctccttttgcaaaaggctcagatatctgaggacctgaaatacattattgataagagcactggagacagtggcgttgcatatcagttctccctttctgggcttttctactgtggcactattttcaacatcttcctcaatgcaaaatttaaggtatgacacttacttgagaatttgactcctgtgccacagaacgaagactaatctgaacattcccttacctcctctaagtaaattaagaaaatgaaatttattttatttcactttacattatatccttcaagtttaggtatgttgtaatatgtgaccgaatttcctgctttttatagactcaatagtattccgttgtgtgtatataccacatttcttattactgtgctgattccctctggcattcattacttcatttaagtgatgggctgtagaccattccagtaccataagaagaaagaatgtgtttgtctgttattcctgaacgtggctttggtttaacacagacactaatgtttgaaattatttttctttaagatatcatggttctggttttctagttacaagttctggggattctcccaatttcttcatctccgttttactagttctctaattcggttgtgactgccttacttagattctcgagaaataaaacatgattgatgtaccagtcaaatgaatacaacattcctatgtagggcttctgtgcttctgctctgggcttccatcctagtaatctagaccagataacacataaacttcaaggacctcctcttactaccaacttttatcctaagccaagtcacaagatctatctcttccctcctgaatgccaaccaggattttttggggtgcttctgagccaaagtccttttaattaaaaggtacatccaacctaaaccctctcagagacaacagagctctaaatgaggggaataaaatgttgactacattgtagggccattgtgtatagatgtacaggtcgcgccctgatgtgtggctctgtccactcagaggaaggagcatattatttcttacatcaagctggaggctcaacaaactgtgcactcctctgtctgtatcttctccaaagtggtgccttttcctaattcttttaaagttgtgctagcagaggtcctgttcttttgattttttaaaatggaggttaaattcacataacctacaattaaccattttaaagtgtataattgagtgacatatagtatatttataatattgggcaacatcatctctctctagcttcaaaaacttttccatcatcgcagaagaacacccccatgacctttaagcaatcacttcccatacccctctacccccaggcactggctcaccactttgatttaatgacaaaagattttatcccttggaatgaaagcctcactatgcgtcttttatttaatgcttgcttcatctagaactctctctgaaaattagaataagaacagtgacagtatttaaatccatccttgcagtgaacatttattttctgcttcacaatacataagaagattatacaggtattataaaaacatcagttgatactccctttcatcatttttcaaagtatattttgaggagtatttgtgttacagggtgttaacaggtaacataaaaatagagagttttctggctaagttagtttgggagtgatggttatagagttgttttttttttcttttctttttctttttttttttttttgagatggactctcactctgtcacccaggctgtagtgtagtggcgcgatcttgtttcaccgcaacctccacctcctggattcaagtgattctcctgcttcagcctgtaagaccacaggtgcccgccatgacgcctggctaatttttgtatttttagtagacacggggttttgccatgtttgtcatgctggtctcgaacttgtgacctcaggtgatccacctgcctcagcctccrgaagtgctaggatgacaggtgtgagccactgagcccggccactggttgtagagctttatttattgcaggccatctcagtccctttaatattccagtgtggctttataaacttgcaaaaaggtgataaagcatacaacataatttgaccactgtatattttttcctctttgggcatctgaagctattactggtcagtgtgtagcctgtttaggaaattatctaccctcttatgcctggaagggatgttgtcagtaatgactcaattctctcatttcccaaattagaaataggtacccaggcaagtgaagggacttgctcaaggattcatggatagctagttacaaagttgggactagaactcaggagtcttgatttagctttttgttcttctacccaatagcataagctatttttacatcttatgctattgggtagaaggaaaaaaaaacacactcaaatgttctttctactctctcactcaacaacaatcaacacagaagatttctgtggctaatgtgtggggatttctccccatcaagaagcaaggaaataaattctgcagcagataccagctgcatgttttccactccaattccattctaacgctatttacttggtgatagtgtcaggttttacagggggagggctcagttctgtaagactgccccctacttccagtgccaagcacaagctccaggttgttttgcctgtgcttctgaccaaccagccataaattgggaattccatgacaccctcaagtttgatgaatgtgctagggcaggtcccaggactcagggaaacatttagcttattggtttattataaagacaattacaaatggcacagaagaagagatgcatagggtgaggtgtgggggaaggggtatgaggagctttcataacctctctgggaacagcacattccaggaacctccacacattcagctatctggaagctcctcaaactctgtgggtttttttttttttttttttttgaacattttacggggacttcagtggatgggcatgatggacaaccattagaaacgtgattggacaaaaagagtatgatctaatgttagtagagtgagtgatgaaacctgtctgtcagatccttcttggtctctctatgcagccttccttcctccagggcatggggcagaacctcttctgaaatggggatcttatgacctacaatcaggcaaggtaggtaggagaatatcttgatggccagtgccaagaacagtgggggaagattcttgccttgaggagtaaaaggagcaggtgaaaagaggtggggagaaggccagagagagagagagagcaagagcaagtgagtgagcgagagcgagagagagagagattctgttttctgaggcctgcttctgaagtgtaaagtgccctaacatcaataaaagggctatgggagttatgagcctagaccttgaatgaaatgtgtatattcgttacgtgctattactctgtaatcttgtgtttgtattctttcacaatttttattatgcttttgtatatcttggaggacagaaataattgtatacaacctcatatatgaatggatgaatgaatagatttggcaaaacctcaagaagctgaatcaatctgttggaatacctagcccaccactttgcacatgagaggaccttaggaaacagttcctaaatgttgtcaagttcctttaatcatatgtcttggctgcaaaatattggaccatttaatggtaaaacaaaggaaaattgctgttaaatatcatcattaaaagagcaaaagtacagaaaaaccatagtgtcatgtcatgttgatattttgaaaaatcccagtaccccaatattgttaataaattccaaagcaaagaaagttcaaacaacaacttcatcattgaagagatgaaaacttttattaaatttaagtcccaataactgttgaaatatttcaggtgatatttatagtaaaatagtatctaactcttttcacattgtaggactttggctgacaaccaggtctaggaaaaatttttggtcttccattgtaaatgaatttacttcctagggaatttatgtggctgtgtgatgagaggttgcaagcccagttataggtactggagttcagaagattgttaggattctaatttggctagttttaaggtgccatcttatcaggatccccagcagaaggaggt

SEQ ID NO: 10652 - DNA, 104249 bp, Homo sapiens
  misc_feature (1)...(104249): n = A,T,C or G, or insertion/deletion polymorphism (see Tables 1-2)
tggaaagtggatgtgatttctagtttcagcaggtcctggtttattgtgctgccagtaaaataaaatcaaaatacacattgaataaataataaataaaataacccatggtgagcaaaggtttacaatgtttgttgttgttgttgttttttgagtcaagatcccactctgtggtctgggctggagtccagtgatgcgatcacagctcactacagacttgaatccataagcccaagggatcttcccatctcagcctccccaatacctgggaatacaagtgcccaccaccgtgcccagctaagtttacttatttttatatcttttagagacgaggttctcacaatgttgttcaagctggtctccaactcctgatctcaagcaatcctcttgccttagcgtcctgaattgctgggattacaggggtgagctgtcatgcccagcttgtaatgtactgacaccttcaagatttccttctccaagtgtggacacagcagcagacgccccttgtctcttgggtcaggacactgggtagagtggaagagcaagacaacaaagtcactgcagaaagcatccatgtggaagaggtccagcagggagggccagctgtcccagggacaccatatttagggataactcctctttctgggcaggactgttctttgattacttttatattcacgatagttctgaaatcgtaggatgatgatactcaagactggctaggatttgttttcaaaaaaccatctccgagacttgtcgatcttttgaatggtttttagtgtcacaatttccttcagaacttaactcattcttaacatttcacagactactttcagttaataatgtactagtgcccataaatatagaaatattgcaaccatttatcctctataaaatgtccatcttttatggtatagatattatatgtaatatatctatataggttgtaagtcccacgataaaaaactttttcttatctttaaacagttctatgtatataaagtaagaataaatgaggggagcaagatagccttttgcacttagctcaatatttaccatttttgatcatcttcatcttttttgataatctcattttccacctggtatcatttgcctctagtctgaagaattttctttaccaattgtaattgtacagatctgctggtgacaaattcttttaattttcttttacctgaaatatctcatttgcctatccttgaaggacatctatgctggatatagaattcttagttgatctttttgtcttccagcactttaaagatgttattctactttcttttgtttctatggtttctaataaaaagtcattgatcaggacaagaggaacagagaaacaaaaaccgggaaaataacatggtagacgtgaaacttatcatatcaataatgacaaaaacctatatgaatcaacactccaatgaagggcagagattgtgtgacttggtttaaaaaaacacggaacccaaccatacgctctttccagacatgcactttctttgttttttttttttaatttaacttttatttttagttaaggggtacatgtgcaggtttgttatataggtaaacttgtgtcatggggttttgtttcacaaattatttctatacccattagtacccacccaagtattaagtcttagttcccattagctatttttcctgatcctctccctcctcccaccctccaccctcaagtggaccccagtgtgtgttgttcccctctgcatgtccatgtgttctcatcatttagctcccacttataagtgagaacatgtggtatatagttttctgttcctgcattagtttgctaagaataatggcctccagctccatccatgttcctgcaaaggacgtaatctcattcttttttatggctgtatagtattctatggtgtatatgtgccacattttctttatccagtctaccattgatgggcatttaggttgattccaagtctttgctatggtgaatagtgcttcaatgaacatatgtgtacatgtaagtcacgcactttctctttttatttaatttattttattttgctttaagttccagatacatgtgcagaacgtgcaggtttgttacatacgtatagtctgccatagtggtttgctgcacctattcacccatcctctaagttccctcctcttacccccgactccccaaaaggccctggtgtgtgttgttcccctccctgtgtccatgtgttctcattgttcacctcccacttaagagtgaggacacgtggtgttaggttttctgttcccatgttagtttgctgacgatgacttccagcttcatccatgtccctgcaaaggacatgaactcattcctttttatggctgtgtagtattccatggtgtatatctaccacattttctttacccagactatcattgatgggcatgtgggtttgttccatgtctttgctattgaaaatagtgctgcaataaacatacctgtgcatgtgtctttatagtagaatgattgatattcctttgagtatatacccagtaatgggattgctgggtcaaatagtatttctggttctacatctttgaggaatggtcacaccatcctccataatggttgaactattttacattcccaccaacagtgaaaaagcattcctatttctccacagcctcaccagcatctattgtttcctcactttttaataatcgccattctggctcgcaggagatagtacatcattgtggttttgatttgcttttctctaatgatcattgatattgagcttttttttcatatgttttttcttctgagaagtgtctgttcataccctttgccaatttttgatagggctgttttttttcttgtaaatttgtttaagttccttgtaaacatacatgtgagctctcatcattcttgtttaaacacctaagaggcatccaaatcagtgcaacatggcaagaaaatgaaataagaaaccaatagaaggaccaggcatggtggctcatgcctgtaatccctgcattttgggaggctgaggtggaaggatcacttgagttcaggagtttgagaccagcctgatagtgagacctcatctctaccaaataaaaataattttaaaagaaaaaagatcaatagataggaaaggaagaaacaaaagtctttgtcaccaacttcattgcatatgtagaaaacactagggaattctgaaaaagtctctggaattaatcattgaatttgcaaaatagttcataaaatatatgtaataagtcacttagatgaacatgaaaagacagcaaacaatactagtcatcaaagaagtgcaagttaaaaccacaatgagaaaccatcacacatcacctagaatagataaagttaaaaagacattggataagtctaaataytgtcaagaatatggaaaaaataggaatgtctgatattgctggtaggaatgcaaaaaatgtggcagccaatttgtaaagtggtatggcagtttcttatacagttacccatctattaccacatggcccagcaattccacaaatatgtatttatccaaaagaaataaaaatgtaaggccacacttgtaagcagttatttatagtggcttcattaataacaagccctaactggaggaatccacatgtctatcaactggaggcagagaaaccaatgaataagctgggattccagcaatactcagcagctgctcagcaacaaaaatgagtgaatggcatcatctcaaacatcgttatgctaaaggagagaccaaacgaaggactacataacataagactgcacgtccattacattctagaaatttcagtattgcagtgacagaaaacagagtggtggttgagtgaagggaaggggtgagggtgggaggcaaggattaaatagaaaggggcagaaagaaagtttttagggaaaagaaacggttctctacagygccacaactcagagagtaactgggtggtgggaactaaggggagaggagggtgtgagggaagaggacagagagaagggctggggaagcaggaggtgaggacaaggagcaggagaaaggactctaaagcagtggaggagcctagcaggggattctttgcattctgggtttctctactgggcagtgtggtagttacatgactataaataattaccaatattcgccaaaaaagcgcagctaaaactggtgaattttattacatataaatgccctaataagcaaaaataaataaataaataaaagggggggaggggaggcaaaaataaagacatttttagataatcaaagccataaaattaatttcctaggggtcctgtactacatttaatttaaaaggaagtgcttcagggtgaaggaaaatgatactagatggtgacccagatatacagaaaggaacaattaacaacagaaatgatgcacatacacatgtcacattcacactcattttcttaatttcctgaagacatatggctacttgtttaaaacaaaaagtattacactgtatcattgagcttataatataggttgatgtaatatatacaacaataatagcacaatggtaggttacaagaaactacactgttagaagtgtcctttattttctggatgcagcttaatataacctgaacttcactgtgaaaagtcaaggaatcgggtttccattctttgctattgtgtaaagaaatatagccaaaagccactaggagaattaaaaccataaactaaaaaatgtttatttgacacataagaaagtagtaaaggaggaacagaaacaaaaagatatgagacaaattgaaaacatatagcaaaatggtagaccaaaacccaaccattgcaagtgaagaaatgacatgacctgagtcacattagcaggactgctgagcactgtggggagaacagatatgggcaggaggtgagggacagtgttagtgccacaattcaggagtgaaagggtggcggggactaaggggagcgggggtgtgagggatgagaggggcagagagaagggctggagaggcaggaggtgaggaaaaggagcaggggaaagaattttaaagcagtggaagagtctggcagagggttctttgcattcggtatttaatacattttgttagacttcctaaaaactaattggctccttatgattaaaaaaaaaagagttacaaaaatacccagtgtccagataaaatatgcatactgcttagatgtgcggagttcaggaaaacaggcagtgcttgagcgtcggtgaagagcattgggactgcatggagcactcccaactttgaggtgatgactacaggttcccggttgcaatagacagtaacaaaccccgcttctttatattcaggagatgttctggactcatatagggaaactcggggtggggaatgaagataattttaaatgcaacaacccagagtcacagatccatagtctgggaaagtaaaacttaggagctttgagagtttaattgtaatgctgttttgacacaggtcttttgcagattggaattctaatcattcagggattaccaatattgtgctacctactgtattaataaacaaaaaggaaactggtctctatgagaatctctgtgtggtggcttcagacaaaacttcgccaggtttagagagaaaacccctgtctctacacctccattcccagggcgagctcactctctggcatcaagttccccgtgatcagtttccctacacaagatccaagaggagaggtaaggagtgagaggcagggagtccagttcagggacagggattccaggaggagaagtgaaggggaagsggctgrgcgcagcctgggggtctctccctggtttccacagacagatccttgtccaggactcaggcagacagtgtgacaaagaggctggtgtaggagaagagggatcaggacgaagtcccaggycccggacggggctctcagggtctcaggctccgagggccgcgtctgcaatggggaggcgcagcgttggggattccccactcccacgagtttcacttcttctcccaacctatgtcgggtccttcttccaggatactcgtgacgcrtccccatttcccactcccattgggtgtcgggtgtctagagaagccaatcagtgtcgccgsggtcccagttctaaagtccccacgcacccacccggactcagaatctcctcagacgccgagatgcgggtcacggcgccccgaaccctcctcctgctgctctggggggcagtggccctgaccgagacctgggccggtgagtgcgggatcgggagggaaatggcctctgtggggaggagcgaggggaccgcaggcgggggcgcaggacccggggagccgcgccgggaggagggtctggcgggtctcagcccctcctggcccccaggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccggtgagtgaccccggcccggggcgcaggtcacgactccccatcccccacgkacggcccgggtcgccccgagtctccgggtccgagatccgcccccgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacatcatccagaggatgtacggctgcgacgtggggccggacgggcgcctcctccgcgggtatgaccaggacgcctacgacggcaaggattacatcgccctgaacgaggacctgmgctcctggaccgcggcggacaccgcggctcagatcacccagcgcaagtgggaggcggcccgtswggcggagcagctgagagcctacctggagggcctgtgcgtggagtsgctccgcagatacctggagaacgggaaggasacgctgsagcgcgcgggtaccaggggcagtggggagccttccccatctcctataggtcgccggggatggcctcccacgagaagaggaggaaaatgggatcagcgctagaatgtcgccctcccttgaatggagaatggcatgagttttcctgagtttcctctgagggccccctcttctctctaggacaattaaggratgacgtctctgaggaaatggannnnnnnnnnnnnnnnnnnnaggagtgacagggtggcggggactaaggggagcgggggtgtgagggatgagaggggcagacagaagggctggagaggcaggaggtgaggaaaaggagcaggagaaagaaatctaaagcagtggaagagcctggcagagggttctttgcattcggtatttaatacattttgttggacttcctaaaaactaattggctccttatgattaaaaaaaaaagagttacaaaaataccaagtgttcagataaaatacgcacactgcttggatgtgcagagttcaggaaaacaggcagtgcttcagcgtcggtgaagagcattgggactgcatggagcactcgcaactttgaggtgatgactacaggctcccggttgcaatagacagtaacaaaccctgcttctttatattcaggagatgttctggactcacacagggaaactcagggtggggaatgaagataattttaaatgcaacaacccagagttacagatccacagtctgggaaagtaaaacttaggagctttgagagtttaattgtaatgctgttttgacacaggtcttttacaaattggaattctaatcattcagggattaccaatattgtgctacctactgtattaacaaacaaaaaggaaactggtctctatgagaatccctatgcggtgccttcagagaaaacttcaccaggtttaaagagaaaacccctgtctctacacctccattcccagggcgagctcactctctggcatcaagttccccgtgctcagtttccctacacaagagtccaagaggagaggtaaggagtgggaggcagggagtccagttcagggacagggattccaggacgagaagtgaaggggaaggggctgggcgcagcctgggggtctctccctggtttccacagacagatccttgtccaggactcaggcagacagtgtgacaaagaggcttggtgtaggagaagagggatcaggacgaagtcccaggtcccggacggggctctcagggtctcaggctccgagggccgcgtctgcaatggggaggcgcagcgttggggattccccactcccctgagtttcacttcttctcccaacttgtgtcgggtccttcttccaggatactcgtgacgcgtccccacttcccactcccattgggtgtcggatatctagagaagccaatcagcgtcgccggggtcccagttctaaagtccccacgcacccacccggactcagagtctcctcagacgccgagatgctggtcatggcgccccgaaccgtcctcctgctgctctcggcggccctggccctgaccgagacctgggccggtgagtgcgggtcgggagggaaatggcctctgccgggaggagcgaggggaccgcaggcgggggcgcaggacctgaggagccgcgccgggaggagggtcgggcgggtctcagcccctcctcgcccccaggctcccactccatgaggtatttctacacmgccatgtcccggcccggccgcggggagccccgcttcatctcagtgggctacgtggacgacacccagttcgtgaggttcgacagcgacgccgcgagtccgagagaggagccgcgggcgccrtggatagagcaggaggggccggagtattgggaccggaacacacagatcttcaagaccaacacacagactgaccgagagagcctgcggaacctgcgcggctactacaaccagagcgaggccggtgagtgaccccggcccggggcgcaggtcacgactccccatcccccacgtacggcccgggtcgccccgagtctccgggtccgagatccgcctccctgaggccgcgggacccgcccagaccctcgaccggcgagagccccaggcgcgtttacccggtttcattttcagttgaggccaaaatccccgcgggttggtcggggcggggcggggctcgggggacggggctgaccgcggggccggggccagggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcgggtaccaggggcagtggggagccttccccatctcctataggtcgccggggatggcctcccacgagaagaggaggaaaatgggatcagcgctagaatgtcgccctccsttgaatggagaatggcatgagttttcctgagtttcctctgagggccccctcttctctctagacaattaagggatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccaccccaggtgtcctgtccattctcaggctggtcacatgggtggtcctagggtgtcccatgagagatgcaaagcgcctgaattttctgactcttcccatcagaccccccaaagacacaygtgacccaccaccccrtctctgaccatgaggycaccctgaggtgctgggccctgggyttctaccctgcggagatcacactgacctggcagcgggatggcgaggaccaaactcaggacacygagcttgtggagaccagaccagcaggagayagaaccttccagaagtggrcagctgtggtggtgccttctggagaagagcagagatacacatgccatgtacagcatgaggggctgccraagcccctcaccctgagatggggtaaggagggggatgaggggtcatatctsttctcagggaaagcaggagccagccttcagcagggtcagggcccctcrtcttcccytcctttcccagagccrtcttcccagtccaccrtccccatygtgggcattgttgctggcctggctgtcctagcagttgtggtcatcggagctgtggtcgctrctgtgatgtgtaggaggaagagytcaggtagggaaggggtgaggggtggggtytgrgttttcttgtcccactgggggtttcaagccccaggtagaagtgttccctgcmtcattactgggawgcagcatscacacaggggctaacgcagcctgggaccctgtgtgccagcacttactcttttgtgcagcacatgtgacaatgaaggayggatgtatcaccttgrtggttgtggtgttggggtcctgattccagcattcatgagtcaggggaaggtccctgctaaggacagaccttaggagggcagttggtccaggacccacacttgctttcctcgtgtttcctgatcctgccttgggtctgtagtcatacttctggaaattccttttgggtccaagacgaggaggttcctctaagatctcatggccctgcttcctcccagtcccctcacagggcattttcttcccacaggtggaaaaggagggagctactctcaggctgcgtgtaagtggtgggggtgggagtgtggaggagctcacccaccccataattcctcctgtcccacgtctcctgcgggctctgaccaggtcctgtttttgttctactccaggcagcgacagtgcccagggctctgatgtgtctctcacagcttgaaaaggtgagattcttggggtctagagtgggtggggtggcgggtctgggggtgggtggggcagtggggaaaggcctgggtaatggagattctttgattgggatgtttcgcgtgtgtggtgggctgttyagagtgtcatcacttaccatgactaaccagaatttgttcatgactgttgttttctgtagcctgagacagctgtcttgtgagggacygagatgcaggatttcttcackcctcccctttgtgacttcaagascctctggcatctctttctgcaaaggcacctgaatgtgtctgcgtccctgttagcataatgtgaggaggtggagagacagcccamccyygtgtccacygtgacccctgttcccatgctgacytgtgtttcctccccagtcatctttcytgttccagagaggtggggctggatgtctccatctctgtctcaactttayrtgcactgagctgcaacttcttacttccctactgaaaataagaatctgaatataaatttgttttctcaaatatttgctatgagaggttgatggattaattaaataagtcaattcctggaatktgagagagcaaataaagacctgagaaccttccagaatctgcatgttcgctgtgctgagtctgttgcargtggggtgtggagaaggctgtggggggccgagtgtggacggggcctgtgcccatttggtgttgagtccatcatgggctttatgtggttagtcctcagctgggtcaccttcactgctccattgtccttgtcccttcagtggaaacttgtccagtgggagctgtgaccacagaggctcacacatcgcccagggcggcccctgcacacgggggtctctgtgcattctgagacaaattttcagagccattcacctcctgccctgcttctagagctccttttctgctctgctcttctgccctctctccctgccctggttctagtgatcttggtgctgaatccaatcccaactcatgaatctgtaaagcagagtctaatttagacttacatttgtctgtgaaattggacccgtcatcaaggactgttctttcctgaagagagaacctgattgtgtgctgcagtgtgctggggcagggggtgcggggagggggttgctgtagaaagagggatggggagggagggcacacaagcagcactgctgagaaaaacataggcggcctctatctcagtgtgaggggtccttgtgctgtagctgccacaaaacagcacttggcctgaggctatgttaataaagatactgccttcaaaatagggaggtgctctacagtgatcattcattcaactgacctttgtcattggccagacataggacagaatggttctgcatctggggaacaccactgaagtaaaagaaaaatctctggccttttgtagcatatgttccagtgggaagaggcagacgatagatacactataaccagagtaaggaaggaaagtgctagaaggtggtaagtgctgtgaggcaggtgatccaggatgtgggcagtggggacagggaaggtggctgttgtgctgggtagtcagtgtgtgccttgttgcaaaggtgacttttgaggaaagatttgagagacatgaggatgtctggggaagttctttccaggcagaggaagctccagtccaaatgcactatggcaggaaggtgtttgtgttcccagaagagcaaggaggccaggagggctggacagagagaaactgaggtgaggtcagaggtgcggccagaacaggtgggcttgaggggagtggggttggatctggcctttgctctgagtgggatggggagttagaggacagttttgagcagaagagagccatgatatgacttctgttttaaaaggatctctctgacggctgtgctgagaacagaattgagaggcgagggacgagggaggcagaagggaaaacagtaggaatcaagtgcagtattccaggctggagatgtcggttaccttgactggggcgtgagcaggggaaatagtgggacgtgaggggattctggatgcatttgaagatggactcacagcatttgccaatggattgtatctgtggtgtgagaaagacgaatcaaggacacccatagttgtaagatgagtgagtagaagggtggagctgctgtcagtggagatggggagactctggcaggagcgtcctgaggagggggcatcacaggcactcagtggaggagatgtctactaggaaggcaggtgggggagctggggtggaatttggacagacaactccagagtttaggggaaaggactgggctggagaaatagatttaggaggtcacaccatatatatgagacttaaaacctcaagcatggatgaggcacaaagggagtgactgactatggaaaagaatgagcacaaggactgaaccctggacctccagttctaaggggtgtgatcagaccacacccagagcagactgcacagttctggccccacgtctagaggacactcagacaaggaacccccatgtgcaccaggatcacctggatgtggtgctgagatccaggaagtctggagtcgagcaagagattctggatttatgacaaggctggagctcatgttgctggtctccagatcacacttggagtagcaagagcaccaggatcccacacgtctgagcatcagcctcacctctagggcttgtcatataaatgattccttggtcttgtgcataatactctgagacaagggttctggggagtggcctgtgtattttctaagtccccgccagcaatcctattgctcagacagattgggaaccactgagatcagtgatcagagagtgcccagggtgggtgggtggggtgggttttcaaaccctgtttaaaagaggatttttctcacagaaagaaaagggaggctgtatatcatcagttatgagaggtgatattctctgttgttctctccaccatggggtagaggccaggtagacaattcaggatgtggctctcgcacaaagaacacctctgaatgccgctctctgacactcgcccgcagactcatttctcactcacttcttggagaaaactatggaaaccaaatttctgtaatgtacacataaagttgtatattggtattgggggctagttttattgtggggaaggccacagaaccaggctggaaactacacatccaagaacagaattcacagcccaccctggatcaggtccctcctaggaacaamtgcctctgctgctgagcacagacascactgctcacacctctgacaccctggtcctggacactggaccctgaggctaggacagatgtcactgctgcatctggaaattggacatcactactgtcactcagccatctttactaaaatgctttctgcacagtcctagcctctctgtcacctcattctggctgagtctggcagtgatataggagttaagaagaaattatttagacaggtagtgagggtacgcaaggcttttaatggaaagcaggctccaaattattttcttttctaacaaggagcagcctgtaatatcaagattcagacatagacaagtaagctggaagtttgcacgggtgaatgccagcagctgtccaataggaataggacgcctgggactgggtatgttcacaatggcggctccatcttcccttctctttgccaggcacgtttacagtaaggagcagacaacatgtcaccagccaagtggaaagcccatttgcataataggatgagggtggggtgaacagccttccacacgcactatgtaaatatcacacctggtacaaccaacctgtgggccctacataaatcagacaccatctcctcaagcctgcctgtaaaatccgatgcactcccattccaggccggaattcccttttgggtgcccctctctctcacaagaaggagctgtttccctttgtctttcttttgcctattaaaccmtttgrtcctaactcactcctcgtgtgtcagtgtccttaatcttcttggcgtgagatgacgaacacttagtatttacctgagacaatgacacctcttcagcaggtggtcatcagactggtggagcttaaaactcatgtccatgagcaactgcaggggtgactggagtgttgttgtcctcttccagggagggaggtggtgtctgtctcctctcaacattttacatgttrtaaaccaaaaataaacatcaaagccaccccttcccaatcattttaatggacaccctyagccagggtgctcaaaagttaacctgaaagactggctcaggccaccaagggaagcaggtattgaacatgtcttattatgccctcttccctcttggaattcaggaaaagttgaccagcatttaccatcaacacagaccttcagtctgatcagaaacatttacaatctattctctctgaagcctggcacctggaggcatcatctgcatgagaattttggactccacaaccttttatcataacccagacattcctttctattgataataactcaaccaattgccaatcagaaaaattaaaaatctacttataacccagaagcactaccccgcaacccttgcttgcttcaaattgttccaactttctggaccgaaccaatgtatagcttaaatgtatttgattgatgtctcatatattccttaaatgtgtaaaaccaacctgtgcctcaaccaccttgagcacatgttctcagggtctcctgagggctgtgtcatgggctgtggtcactcatttttggctcagaataaatctctttaaatatgttactgagtttgactcttttcattgacagtgtggaattctgatgtagtaagagggttcaagtgctggagtgtgaggggtggggaaaagtgacaaattttaattcttggagcagtgatccaggacgagaactttatctggtacccagtaggcacgaagagtggctgaatgaaccagtgactaataaataacatatttccacccattcccttgaggataggtttacatcaagtttttgtctatcccagtttatactctagattattggagtggcattctgtaatgatgaaatgattattcaaacatcttccctcagcatgactcttactaggattaaaactcccaggtttgtaagatctcagaggttctgggtccacacgatgttttctattaatatttatattttcttgtgtgtggaaatatttctggggagagaatctctaacatttattagtttttatgtgacaccctcaaaggcctaaaaaatcctaacttctagattaaaggtaggaccactccacgtctagacaatgaacagctggtagcaacctgtgtttagggacatgaaacaaatgcttacatttgtttatcttttcctctgggaccgaagaaggtagaggtttacttgcttactcttactataagtttctctctgtgggatggtgatggggttttcttccacccaaataactttctgattctccaacagcagctgggagtcctagagtttgactcaattctgacactaactacctggagttcgcctcagactccacaggtttaccagctcagtcctacaagtctgtcctcacttcagaagcaagtcacaagtatcacgtcccaggttacctgcacttctgtctaacatggctgcaaagtcaggggtttctcacctcccaaggattgagaattcttaaactaactcaaagaactcaggaagttgctatagccatgtaaaccaaaaaacgtctgagacaggtctcagtcagtttagaagtttatttcgccaagctgaagatgcaccttggaaacagagacacaaatcattgtagcatctgtggcccatgctttttcctaacaggcttttgaggacttcaatgtgtacaggggaaagagcagccaggagaggaaaaaaatagtcaactatgcattcatctcatgctcagtaaatctgcattttaaataagataaagtaaacattgggtggaaaagtcaaatatgcgtttgactctgggtgggtggagggatgatttctagtcttgtctttgtcctgtacctgtgaagataagctgttaatttacattgtcaggggaaaattcaacaaaactgttttagggtaaacacgttggggcccacaaggaattatcttgtgagcagtttgtgagggaggccacctggggagatatgtggtcttctatctttgcagttatttgtttaggaacgaaagaaaggcagtttttccatcagtctccaaacttaatttttccttttggtatagtgaatttggagtcctgaaattttattttcttttcacactcagtattgcagttttttattgttatagcttaaatccccacctttttggcacctgggaccggtttcatggaagacagtttttccatggactagtggaggtggtggagggcagagggaaatggtttcggatgaaactgttgtacctcagatgatcaggcattagcgcttcataaggagcatgcaacctagatctctcgcatgcagagttcacaatagggttcgtgcttctatgagaatctaattccgccactgatctgacaggaggcggaactctggtgttatgctcatgctctctcacccaccgatcacctcctgctgtgcagtctggttcctaccaggccaggaacctgtaccagtccgcagcccgggggttaaggacccctggtttaaattatgccactagagcagaactcctgagactggataacttataacaaacagaaatttgtttcgttcatggtgtcgaggatgagaattcccagatcaagggactctatctggtagaaaacaaaaggacaagagagggtgagaggtggggggaaaggaagtcaaactcacagcctcaggtccttttatgatgagccttagtccattaatgaaggcagagctctgatggtccaatcacctctcaaaagtcccatttcttaaaaatgttgcattcgggatgaaatatccaacagatgcttttttggggaaacattcaaaccatagcagttataaaggatacaaatgagcagccagatgaagaggtgcacagggtgaggcctggaagggctctgagcacaggagcctctgtccccacggagatggggctcaccatcctcccagcacgtggacacacggatgtgctcagcaattgggaagctctccgaaacccaatctccagaggtttctatggaaatttcattgtgtaggcatgattaattaaatcaccggccattgtgtgactgaactcaacctcgagcctctctttccttcccagactttagggatggggttaacagttccaatcctctaatcacagcttcgtgtttctggcaaccagcccccatcctgaagctatctaggagcccctcaccccatagtcatctcattgccatattgaagtcattgtttatcactgaggagattgcaaatgttttagaacctggttgtcaggaaacagggaaaagaccaaatatttttattggaccacagatcacaccctggttttgaccacattatctctttttataatatttattattttattttagagataatctcttgctctgttgcccagggtagaatgcagtggcacaatcatagctcactctaacctcgaattcctggactcaagtgatccttctgcctcagcctcctgagtagatagcattacaggtacacaccaccatgcccaactaatttttaaatattttgtaggaatgggtctcactattctgcccagtctggtctcaaactcctggccttaaacaatattcctaccattgcctcccaaactgatggaattacaagtgtgagccactgtgcctggccaatcacagatctcctataccagaagaatcataacagtgaaaagaccctggcacattaccacaatcctctttggtcattaacaatgatcccagtgcaatccataaacaggaatagtttcagcaacatatgactgcacgctttcaggcaactggtaaaattgagctaagagacaatatcatctcttgcttatacctctttcaagtagttcatgtaacattggattttcctcattacataacccatttattcattcatttaccctcagctactatttctccttcccttcatttatactaaacatttataattttggaaggaacactaggttctgctgctgtgctggctgagactgcagggagcaatactgttctagcaagtgtctcccgtcatccattccagttcatagagggtagggttatgcagtagagaactggttggctatctgaccccaggcaatacagctgcattcagtgttagccccaactttgccagatgcagtgaaggcacaacctacttctacaggcccttaggaattattacataatggacataaaatatatttacagtttcttgctcaggaataattcctgtttctggactctatttgcatccctagtcctgggaccactgcatcaggtatgagaaaagcaagttgaggtgaattacagtcatcattccagtgtcctcccaccttggggaggaatatatgtagatcacaccagcaccttcccctgatccaccaggaaaagagaggatactctcacgtcaagtgcgagcacactcaagaaggtgtataagaccaccctttgtgcttgtttccccactcttgcctttacacacccaattgactattttaattctctacagaactcttcctctgagaaggatatctctctgaccattgttggacattttgagcaggtgcattttctggtgtaaagaaatatgactctgtggtccacatggttgcagtacctcccattcaggttcttttgtaacactccgagcatttgcctctgagataaagcagggacctctcttagaagcctgccagggcctcccaacctggaaataaagaaaaacctttagttccttcaagagaaattccaggtacctagccagccctaaaaagtagtgagtgaccttataagcaagatggtaatgatagcttaaaacaacagccaaggaagttagagtcacaagatgtttgattctctatagaaactaaaaataacaccttaacatatgcccctgagttgtttttcagaaacatggattcccacctaatagatccactgacagggagatcttataaaggggaaactgaggactgaactctgaccgccgttctttgttctaaatttcttcctgaggggcctggagagagtaaagcccacaggccaggcctgaacattcctctctactgcccccaactgtgtaaggaagctgcttaaagaagcttcactttcttatctatcacaaatcagagaatctttacatctacctaagacctgtaagctccctcatcaggatattccaccttttaaggccaaagcagtgtataacttctatgcattgatttatgatgttgcctgtaactctgctgtcccgaaatttgcccctgcctttaaaaattcttgcttgtgagccatcaaaaagttgggtcttaagcgtgagctgcccaattctccttgtttggtgccctacacataaatgccytcctttctcccactacattctcagtgtggatgtttgcttttactgccccaggtgagtggaccccagttcagtttggtaacacacctrccaccagctgaacaaagcccattccagggtgaggatctgttcctgccaagacccatttgctgcttcctggggctactggtatcagtctaacttgccagctatgtattttcaaggccctggcataaaagaatctgccacatagccatatgctagctctcctttttttgttaaagraagcacttcttatgtgtattttttgcctgtgatgtgtggaatgcaagaggaatatgtcttgattccacctatctctgcattgctacaaccccaatgtctattcatttcacggactcaggtgatcaccacaagcaaacctggattttttgttgttgttgttgttgtttttgagatgtggtcttgatatgtttccctggctggcctcaagtgttgctgaggctaaactctaactcctggactcaagatatccttctgcctcagctgctttcatagctgaaattacaggtgcacctggcaaacacttggagataaattcttgttgatttcaatcaccttccaaacctggaagggagttattctgagggacactgaacagcactgaggggacggtgctaaaggattcatgagaaactgacctcgtgatccaaccacctccctccctccaggccccacctataatgctggggatcacatctcgacatgagaacagcatccaatctatatcaggtatcaacagatcttacattaatgaacccctcaaattaccatagtgatttccgtgggacttggctcacatgggcattcttttcataggcaagtttttcattgctctcctgattaattatatggccaggccattagtcactccctttaagtcagtaaaaactaaaacgtaggagctttatcattgctcaattcttccaccactgctaagaaaacaccatgcaattaagtccacaagagcccttctgtttttaccttgtttgatcaaagaggtggacttccaaacaggatgttgttcattcatcttgcaaatgctatacacaaaccaaccagctgtttgtgggtcagttgatggatactgcagttcaaatccctgcgctgtctgctacagagttccatcttgctcgaggaaggtcagtgttttgtttaatttatgccttcaatgaattgaatgaagcccacccacatgatagacatcaatctactttattcaaagtctagctatttatatgttaatctcatccaacaaatgtcctcacaaatcatccagaataatgcttgactacctatctaggcaacatgctttagccaagatgaccaataattttttttattattatactttaagttctagggtacatgtgcccaacgtgcaggtttgttacatatgtatacatgtgccatattggtgtgccgcacccattaactcatcatttacattaggtatatctcccaatgctatcccttcccactgcccccaccccatgacaggccccagtgtgtgatgttccccaccctgtgtccaagtgttctcattgttcaattccaacttatgagtgagaacatgcggtgtttgcttttctgtccttgggatagtttgctcagaatgatggtttccagcttcatccatgtccctacaaaggacatgaactcatccttttttatggctgcatagtattccatggtgtatatgtgccacattttctcaatcccgtctatcattgatggacatttgggttggttccaagtctttgctatgtgaatactgccgcaataaacatatgtgtgcatgtgtctttatagcagcatgatttataatcctttgggtatacgcccagtaatgggatcactgggtcaaatggtatttctagttctagatccttgaggagttgccacactgtcttccacaacggttgaactagtttacagtcccaccaacagtgtaaaagtgttcctatttctccacatcctctccagcacctgttgtttcctgactttttaatgatcgccattctaactaatgtgagatggtatctcattgtggttttgatttgcatttatctgatggccggtgatgatgagcattttttcatgtgtctgttggctacataaatgttttcttttgagaagtgtagttcatatcctttgcccactttttgatggggttgtttgattttttcttgtaaatttatttgagttctttgtagattctggatattagccctttgtcagatgggtagattgtaaggattgtaagtattgtaagaattttctcctattctgtaggttgcctgttcattctgatggtagttcttttgtggtgcagaagctctttagtttaattagatcccatttgttaatgttgacttttgttgccattgcttttggtgttttagtcatgaagtccttgcccatgcctatggcctgaatggtattgcctagcttttcttctagggtttttatggttttagggatgaccaataaaattaattatgatattcttcaatataagaatactctgaggaaattagcctgtgacctaataaaacaaggagcaaacaagtgtttctaaaaatttacaaccaatagtcaaaaagcctatagagtgaacttgtttctcaagttcactctataattctgggaaaattctataattttcaacaaatacatgtatttgttgaaaaccacagaagaagagaaaattgaaaaagcagaaagtgaaaaaataagaataataataaagatgacagcagttatttcattggaaacaatgcaaatgaggagacagatgagcaacatctttagagtcctaaaaggaaaatgctgtgaaactagattctagtcccagaaaataaacctttttcaaatatatacgtataagtttaattgacaaattataatacattcgtaagatattgtttgatgtattgatatatgtataccatgtgtaatgattaaattaagctaacataccttgaatatatctatcaaaaaataaagggattttaggccaggcacggtggctcatgcctgtcatcccaacactttgggaggccgaggtggacagatcatgaagtcaggagttcaagaccagcctgaccaacatggtgaaacctcgtctctactaaaaatacaaaaattagctaagcatggtggcatgcgccctgtaattcccagctactcaggggggctgaagcaggagaatcacttgaacacgggaggctgaggttgcagtgagccaatatcacatcattgcactccagcctgggcaatagagtgagactctgtcttaaaaataaataaataaataaataaatacaaacaattggattttagacatatagggagtgaaaaaataaccagcagacctaaactataataaatgtttcagtcctctaggcaaaaagaaaattaagggactagytggtacagcatttaatgatgaagagacagcttcatcgccccctcccaccgagacagagaacacagccctggggcctgggaattcctctccccaatccaccaccttgggcacctgtgcactccttactgggtacctgaggttgggggcaatcaccctatctgtcacctacctgcaaacaccacctatgggcaacccacccagcctatcacagctgccgctaacaatgcacactgcttggacccagagaagcagcccaccactgccactgccaagctagctgcccaggacccggaagaccccacccacccacccagtcaacctctgccactactggcatccaagcaggccacctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaaggaagacaattagatcttaatcaaaaagaaattttcaagattccagataaaggattcaaaatatttattttacagaagttcaatgagatacaaaagaattctgaaaaaaaaataccaagaaagcctaaaaataattcaggatatgaataagaagtttacaaaagatatagatttaaaaaaaacaaatagaaattctggaattaaagaattcatgacatgaaattccaaatacatttgaaagcttcaacaatatactaggtcgggcagaaggaagaattccaaaacttgaagatatacatcgtgaaataattcaataagacaaaaacacacacacaaaaagaatgagcaaagcctttgtgacatttggtacaatataaacaaccaaatattcaaattatcggtatcctcaagagcaaagagacaaagaacagattagaaaacctatttaatgaaagaatagatgaataattcccaactctagcaagtgatttagacattcagatacaaaatgttcaacaattctgagaaaaatacagtgcaaaaagttcttctccatggcatataatcagactttctatagtttaaggtaaaacgtaaatcctaaaaatagtaagagaaaagcatttagtcaccaagaaaggaaaccccatcagactaacaacagatttctttttcttttttcttttttttgaaacagagtctcgctatgttgccaggctggagtgcagtggcatgatctcggttcactgcaacctccgcctcctgggttcaggtgatctcctgcctcagcctcccaagtagctgggatgacaggtacaagccaccacacccagctaattttttttttttttttgtatatttagtagagatgggatttcaccatgttggccaggatggtctttatctcttgacctcatgatccgcccacctcagcctcccaaagtgctgggattacaggtgtgagccactgtgcccagctctaacagcagatttcttgcagaaatcttacaggccagaagagaataggatagcataatcaaagtcctgaaagaaaagaactgccaagccaagagtaataaacaaaacataaattattcttcataattgaaaaagaaattgtctttccaagacaagcaaatgctgaaaggcttcgttatcactagacagggcctacaggaaatgctcaagaaagtcctaaacctggaattgaaaggacaacattttcaacatttccacattatcaccatgagaacatacacaagtataaaactcactggtaaagcaatcacacaaaacaggaagagaaagttctcagatggtcctactacagaaatccaccaaagcataatgaccagcaataagagaaaaagacaataacaaaannnnnnnnnnnnnnnnnnnnacatataaaccaaccagaaaacaacagtgtgaaaggaacaaagctgttgggaacaggaccccaaaaatctggccataaactggccccaaaactggccataaacaaaatctctgcagcactgtgacatgttaatgatggccatgacgcccacactggaaggttgtgggtttaccagaatgagggcaaggaacacctggcccactcagggcagaaaactgcttcaagttgttcttcaaccacaaacaatagcatgagcgatctgtgccttaaagacatgctcctgctgcagataactagccaaacctatccttttattttggcccatccctttgtttcccataaggaatacttttagttaatctataatctatagaaacaatgcttatcactggcttgagttaataaatacaggggtaaatctctattcgaggctgtcagctctgaaggctgggagacccctgatttcccacttcacacctgtatatttctgtgtgtgtgtctttaatttctctagcgctgctgggttagggtctccccagctgagttggtctcagcacaaagcctcacatattaataaaaatctggaatgtaaacagattaaattctccacttataagatgtagaatggctgaatgggtagaaaacatgatctaactacattctgcttacaaaaaaactcactggtaataccacctcaccacaatccatagagacagaaggtaaaagaatggcaacaggttatctatcgaaaccaaaagtgagcaggagtagctatacttatagcagataaaataaacagtaagtcaagaacaatttttttaaaagataaggaaggccatcacataatcataaagagatccatccaagaagagaatagaacaattctaaatatatatgcactaaacattggagcactagattcataaaacaaatattactacatctaacaagagagatagactccaatacaataatagtgggggacttcaacatcccaacctcagcataagacagatcatctacacagaaaatcaagaaagaaacattagatttaaactgaattttacaccaaataaagctaacagatatttacagagcattctctctaacactacagaatacacactcttttcatgaacacatggaacattttccgggagagagcctatgttaagccacaaaacaagtctcaacaaattttcaaaaattgaaatcatattaaatatcttctctggccacaatggaataaaactagaaatatacaccaagagaaatgttggcaactagaccaatacatggaaattaagcaacctgctcctgaataaccattgagtcaacagagaaattaagatgtaaatcaaaaagtttcttgaaataaatgaaaatggaaacacaacataccaaaacctgtgggatacagctaaacagggctaaaagggaggtttatagcaataaatacccacctaagaaaagtagaaacattacaaattaacaatataacaatgaacctcatggaaccagaaaagcaagaaaaaaacatatmcaaaattagcagaaaagaaataataaagatcatagtagaaataaataaagacttttaaaaaccatgtaaatgatcaacaaagtgaaaagtttgttcttcaaaaacataaacaaaattgataaaccactagctaaacaaacccagaaaaaaagagagaaaatttattaagaataaaagttcctcttcaaagttttcctttttggtttagaatgataagtcttaagaagatagttcctcttaaaagcttcctttaagtttccctcgctcttcatactaacaaatcttctattttactaatgactctttattgtgccccaaaggagttgttacatacagtaaacaaataaacacattctatgttcttgtacttgaaccaaggcctaactcctttgttccctagtctgcctggatctgcctggacacgcccagrcatgtcacagcttgcagcctatgctctttccttatttggaaatattattgtcttcctggtttcccataagcgaccccctcctttccttggttccccattgtgcctttaccttatttgggaaagtttaagtttttagccaactgggatcagtttagattgtgtggtccagttccagccaatggagacaggacacaatagtagaaacaaattgcgttaggaataaaaacccctgctttcctttgttctggttgctctcgtggcaatcaggcttacaggtagcacccttctgcagaagtaaaaattgccttgctgagaaatcctttgatcaagtgttcatttcctttgtgactccaagctttatttctaactattttatgggggctcttccaggattcccattctcctatgggaaggggtctttggtcaccccatctaggggaggtgtaccccactgcagtggccccagggacgggagattgagactacccattgtgatgaataaattcaggctctcagcaatgtggaaggagaaggcccacaagtaccgcgatgaccagctaactctgtgcagagaccaaggtaaaaaaagtcacacgggcaacagtatttccttggtggtcgggatattctggaggttaaagggtgtgaaaggtaacaagcactactgctgtgcagagtgagtgagttcaatctgtggttccgtggtcacctcatgtggcttatgatggccctcttgtagggatcctgacattggggttcatacagtcctgctgatgctaaggggagcctaatttcctctgggaaagcagccagagtggatgaagcaaaaggagaagattgcaaggaacctccagggtgggggttaaacctccagggaaggataggcaagaaatctctagtttgagggactgagcctaaccagtattcaacatgggaaataccctgagtaagacagaaggtaaaaaggaaaaggcaaacagtgaaatcacctctgatagtcctttaggactcatgttaaaatattggaagaatacgagaggactaaacataagaaaaagcaacagatgataaagtattattgtttcatttggaccaaggaacctattctaaagccttcagttttctggccaaaattcgggtcaaatgaggcttggacttgccaacttttaatagaatgtgtaaatgataagagtcctgtttcccaggaggaaatacattatgctctgtgttggcagcaagggcccatcctcctttgtcatctaaaaaccaaaggagacaagccagaaactacttctcatgaaattaataccccttactccaagaaccccaccaacacgtgggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccacctcccccttcagtagaaataacagtcccagacctttcccctactcagactttttttccctccttttaaccctgattcttggggtcatccccagcttgaatgccctccctcaggaagacttcaacgtgagttagaacaatgtaaaaatgatatccaaaacttcccttttcccccttcctctaggggtttggctacaaacctcttcccactgagggaagtgcctctaggaggagcgggcattggctttttaaatgctcccctgaccagttcggaagtccagagcttgaagagggaactcaagccactcttagacgatccctatggagtggcagatcaaattgatcaatttttaggaccccagttgtatactggggctaagtttatgtccatcataggcatccttttttcaggggaagaaaggagcatgacgcacagggccgctatgaccatctgggagtgtgagcatcctcccggtcaaaacgtccctgcagccaaacagaaatttcctgcttaagatccccagtgggataataacaacatagctcataggaggaatatgagagacctgcaagaaatgataataaaaggaattagagaatcagtaccccgcacccagaatatgaccaaagcttttaatatacagcaaggaaaagaagaggggcctatggaatattttaataggcttaaggaacaaatgaggaaatatgctggtttagatggaggagacccacttggacaaggaatgttaaacgcttcactttgtcacaaatagctggccagatgttaccaagaaattacaaaagatagaaaattgaaaggactgtcccataaaggaactcttaagggaggcccaaaaggtgtatgtacgaagggatgaagaaaagcaaaagcacaaggcaaagattgtgctgttcttaaagcagggaactccccaatagacagctcaaagaaatatcgccggtaaatcttttaggtacccgactgtcagactctataatggaggtaaaggaatcaaaccagggaacaagggaataaaaagaggaatagggcagaataaatgcttcaagtgtgggaaggaaggtcactttaaaagagaatgccctgaatggaaaaaagaaaaagaaatcaccccacttatgatctttgaggaggaatggggggccaggggctctactctttttacctcgagtcccaccaagasyccttgataaatttagaggtgggacccagacctttttaattgactcaggagctgctgattcctcagtttgttatcttcccctggtgtaacttggtcacaagaagaactttttattttgggagcaaaaggggaggggtttaaagcaaaagtcttagaagaaacaaaaattaaatatcagaamcactcagtaaatattaaacttctgttaatcctggaggcaggaacaaacctattaggaagagacttaatgctaaaattaaacctaggcctttgtgttaatcaaggaaatctcctcccctccttaaatttgcttgctactctaaatgagggatacatccatccagatgtatggtcaaaggaaggaaactgaggaaagttacaaatttccccaatccaagttaaattgaaaaacctggggcaagaggtaaaaagaaaacaatatccaattcccttagaagctaagatcaatttaaagcccacaatagaaagccttctccatggtggactcattgaaccctgtatgtctccttataacactcccatactgcctgtgaaaaagccagaggggtcatatcggctagtgcaagatcttcgatctattaatcaaatagttcaaacaactcactctgtcgatcctaatccttatgctattattagtaaaattccttacaaccatgagtggttcacagtaatagatctaaaggatgccttctgggcttgcccactagcaaagatagmctttgaatgggaggaccctcactctggttgaaaataacagtatcgatggacagttttgccccagggatttacagaatctccaaatttgtttggtcaaatactagaacagatcatagaaaagttttacaaaccaccatatatatgcctgctccaatacatggataatatccttatttcaggggaggatagacaaaaagtagaaggattttcaataggttttttaaaaataatttgcaactggaggggttatgagtgtcaaaaaagcaaacttcggtttgtagaacctgaagtcaagtatttaggggacttaatcagtaagggcaaatggagaattggatttgaatggattgaaggcatcatatccttcatatgatatcctgagacaaagaaggaacttagaaagtttttagggttagtagggtattgttgcttatagagagactcttatgctttagtaaccaaacctctacataaaaaaaacttacacaggatgaattggacccccttatatggttttacaagaaatacagcagataaaaaaattaaaagagttactagtgacagcccatgttctagccttaccctctttagaattgccctttcatctttttgttaatgtaggtaatgaagtagccttaggggtacttactcaaacacacggaggccattggcaacccataggcttcttgtcaaaaattcttgacccagtagcccatggatggcccgagtgtgtccaatcagtggcagcaacagccttgctcatagaggagagcagaaaattaacctttggggaaatcttatcattagtactcctcaacaagtgagaacaattctcaattagaaggcgggaaggtggcttattgattcaagaattttaaagtatgaagccatcttgttagaaagagatgatctaatcttaaccactgatgactcaattaatccagctgctttcttaacaggaaaccccaacccacagacccctgatctttgcccagagcacagatgtttagatttaattagttatcaaacagaagttagacctgatctaaatgaaacaccctttcatactgggaaacacctgtttgtagatggttcctcccgagtaatcaaaggaaaaaggcataacgagtattcaacgatagatggagataccctcacagaaatagagtctgaaaggttaccaaatgactggtctgcacaaacatgtgagttgttcacattaaatcaggccttaaaatttctgcaaatcaagaagcaacaatctatacagactccaggtatgcctttggagtagtccatacttttgaaaaaatttggactgagcggggcctcattaacagcaaaggtcaaattttagaccatagggacctaataatacaagtactagaaaatttacaattgccaaaagaaatagctgttgtacatgtcccacgacatcaaaggaatcctttatttgaaggccagggaaataatctcactgaccaaatagccaagcaagctgcctcttctccagcagaacccatttttcgactaaccccttgtcttccatcttcagctgcactccctatcttctctcaagcagatcaggaaaaactgaaaaaaataggagctgaagaaaactcaaaaggaaagtgggtattaccagatggaagggaaatgttacccaaaccttatgagggaaatattgtcacagcttcatcaaggatgtcactggggtcctcaaaccatgtgtgatgcagtccttagggtttatgggtgcataagaatatacaccctcgccaagcaaatggtggaaagttatatactgtgcagaaaatctaataagcagaccctcaaaagacaacctcccggagggagaaatcctgggttaaggcgatttcaaagtgtccaagttgactctactgaaatgcccccagtaggccgccttaagtatttaccggtaatagtagatcatcttacccactgggtagaagccatcccctttccaagttcaacagccagtaatgtggtcaaagctctgttagaacatatcatacccaggtttggaataatagagaacattgattcagataatgggacccaatttaccgtgtacattattaaaagactaatccaagtattagggataaaatgggaatatcatacttcctggcctccaccttcatctgggagagtagaaagaatgaatcaaactttaaagagtcatctaaccaaattaattttagaaactcgcctaccatggacaaaatctcttcccattgctttactaagaatccacaaacttctcytcggagggatcttggcttgtctccttatgaaatgctttatgggttaccttatctaaacactactactgaccttcctatgatcgaaacaaaagatcagttccttagaaattatgtatttggtctgtcttccactctttcgtccctcaggactcaaggtctggtagcacagactccaccccttgaattctgggcccaccaacatcaacccggagatcacacgtccttatcaaaggctgaaaagagggaaagcttgagcctacctgggaaggaccctatctggtgctcacaacaactgaaacagtagttcggaccactgagaaagggtggacccattatactcgagtcaagtaggcgtcaccttctccagagacatggaccattattccgtcaactcccaccagagtaacaataaaaagaaaaacttaatctatctctttttcttcttttctttcccttaactgcccccatctcatcattaatgtaactagatcaagtttgcccaaaattattacctttgatgcttctctagtcatgccttgtggaaatttacaggaccaaagacagcttactgcctcagataaatatctttgtccctcttgaacttcctcagattggaaagatataacaaattcttgtaaagatcatgataaccccaaaaatagtagctgtatgaactggtgggaatgggactcttgtccccttaaaacagagtccctatgctatacttggtctaatgtcctatggaacaccaaaggtccaggctggactgctcccaccagtctttgccagtccttaaagccatatatccattttacaaaagggattgcctcttctaattgtccatataaccagtgtaatcctattcggcttactattactattgcaacatcccaaaactctttcccttcattaagtcgtatttatagcataggggccaacatcttgggaaaggatcctaggggaatttttgaaatctgctttattgccccttccacctctctaacacatcttcctcaaaccatcaccccacctatacccagtgacaaaaccaaagtagctatagtagaagtaaaagacctgaggtaaactctagccactgaaacagggtctcaggatgcaaatgcctggctggaatggattaaatatccatccacactcaaaataagagcgattgttatgcttgggcacagggcagaccagaggcccaaactgtcccctttccactcagatggtcttgtaatagaccagatatggactgcatggtagctctgctccaagacctcacagcctggggtaataaatcgtgtcaaagactttctttgctgttccctgaggttcagcactctgcggatcagcccccaaaggccattcagcctccatcttctgggaccaaatttgcttcgtgtctctcacaacagggagaaaacttggctttccttggaaacctgacaggatgcagtgaggtcaagcacttccaagagctaacccatcagtcctcccttatccatccccgagcagatgtatggtggtattgtggtggacctttgtgggagactctgccaaataactggagtggtacttgcactctaattcaattggctatctctttcaccctgacatttcattcacaaaaatattaacaactaggcatcgtagtacaagaactgttcctgtgagtcttttgatcccaacgtttatatagatgctattggagtaccagatgaatttaaagcttgaaaccaaatagctgcagaatttaagtcattattcaggtgggtgactatcaataaaaatatagattggatagccaggcgcagtggctcacgtctgtaatcgcagcactttgggaggccaaggcgggcagatcacgaggtcaggagtttgagaccagcctgaccaacatagtgaaaccctgtttctactaaaaatacaaaaattagctgagtgtggtggcacgcacctgtaatcccagctactcaggagagtcacttcaacctgggagttggaggttgcagtgagccgagatcacaccactgcactccagcctgggcgacagactgagactccatctcgaaaaaaaaaatgtaggttgggtaaattatatttactacaatcagcaatgattcatttttttttaattaatttatttttttttagtatttattgatcattcttgggtgtttcttggagagggggatttggcagggtcataggacaatagtggagggaaggtcagcagataaacatgtgaacaagggtctctggttttcctagacagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcacggggttgggggtaaggttatagattgacagcatcccaagacagaagaatttttcttagtacagaacaaaatggagtctcccatgtctacttctttctacacagacacagtaacgatctgatctctctttcttttccccacatttcccccccttctattcgacaaaactgccatcgtcctcatggcccgttctcaatgagctattgggtacacctcccagacggggtggcggcctgggcagagggctcctcacttcccagacagggtcggccgggcagaggcgccccccacctcccagacggggcagtggccgggcggaggcgcccccaacctccctcccggacggggcggctggccgggcgggggctgcccccccacctccctcccggatgggctggctggccgggcrggggctgaccccccacctccctccctgacggagtggctggccgggcgggggctgaccccattaattgcacaagggatgctatgagggaatagctgagcaactaggacccaccaatcagatgacttgggaaaayagaacagcactagacatgatactagcagaaaaaggcaaggtttgtgttatgattggaactcaatgttgtacttttatccttaataatactgcccctgatcgaactataataaaagcactacaaggtcttactgcttcatcaaatgaactagctaaaaactctggaataaatgatcctttcactagcttaatggaaaggtggtttgctaagtggaaaggactcatgtcctcaattctcacctcactggctctcataatcagtgtacttatccttgtagaatgttgtattatatcttgcattcatggattagtgcaaaggcttatagaaaaggctcttaccaaaacccctttcaattctcctcacccttactcagataagttgttctttctaactgattaagaagagcaacaaaatcaagatatgttaaggagatttgaagaggaagaactgtaaaatcaagagggggaaactgtaaagaataaaagtacctctccaaagttttcctttttggttaagaatgataagtgttaagaagatagttcctcagccgggcgcacagctcacacctgtaatcccaacactttgggaggctgaggcaggtggatcatgagttcaggagatcgagaccatcctgactaacatggtgaaaccccgcctctactaaaaaaaaaaaaaagaaaacaggaaaaaaaaattagctgggcgtggtggcacgtgcctgtaatcccagctactcgggagactgaggcaggagaatcgcttgagccccggaggcggaggttgcagtgagcctaaattgcgccactgcactccagtctgggctacagagtgagactctgtctcaaaacaaacaaacaaaaaacaaacaaaaaaagaagatagttcctcttaaaatctttctttaagtttcccttactcttcatactaacaaatcttctaatttactaatgattctttattgtgctccaagtagttgttacatacagtaaagaaataaacacattctatgttcttgtacttgaaccaaggcctaactcctagtctgcctgatctgaccagacatgcccagacatgtcccagcttgcagcctatgctcttgccttatttggaaatcttattgtcttcctggtttcccataagtgaccccctcctttcctttgttccccattgcacctttaccttatttaggaaagttaaagtttttagccaactgggatcagtttagactgtgcggtccagctccagccaatggagacaggacacaatagtagaaacaacttgcgttaggaataaaaaccccggctttcccttgttatgggtgctcttgtggcaatcaggcttatgggtagcacccttctgcagaagtaaaaattgccttgctgagaaatcctttgttcaagtgctcattttctttgtgacttcgagctttatttctaacagactcaaacaaaatcagaaaagaaaagagaaacattacaastgatattgcaaaagtacaaaagaccatcagagactattatgaacaattgtgtactgacaaactggaaaacctggaggaaatggataaattcctggaaacaaacaacctgccaagattacattaggaagaatagaaaacctgaagccctaacatacatgaaccattctcacagtggtyccagtgggcccctgaccwctctgtgattatttcctcagtgcttgtttgcataattgaaatagacctactcagcaayagscaaaatccacagatcagttcctttttttaacttttattttcagttcaggggtacaagtgcaggctgttttacaggtaaacttgtgttgtgggagtttggtacacagattatttaatcacccaggttttaagcctattacccattagttattttccctgatcctcttcttcctcccaccctccaccttctgaaagtccccagtgcccagtgtgtgctattcccctctatgtctctatgcattctcatcatttagctcccacwtataagtgagaacatgcagtatttggttttctgtttctgcattagtttgctaaggataatggcttccagctccacccatgtccctgcaaaggacatgatcacattcctttttctggctgcatagtgttccatggtatacatgtatcacgttttctttatccagtctataattggtgggcatttaagttgattccatgtctttgctattgtgaatagtgctgcaatgaacatatgtgtgcctatgtctttataatagaataatttatattcctttgggtagaatggtatttctctctttaggtcttcaagaaatcaccacactgtcttccacaatggctgacctaatttgcacttccaccaagagtatataagtattcctttttctccacaactttgccagcatctgttattttttgactttttaataatagccattctgactggtgtgaaatggcatctcattgtggtttagatttgcatttctccaatcatcagtgatgttgagcatttttcatgtttgttggctgcatgtatgccttcttttgagaagtgtctgtttatatgctttgcccactttttaatggggttgttttgttttttcttgtaaatttgtttaaattccttatagatattagacttttgtcagatgcatagtttgcaaaaaattttcccccattctgtaggttgtttactctgtcgatagtttcttttgctgtgcagagctctttagtcgaattagatcccatttgacaatttttgcttgtgttgcacttgcttttggcatctttgtcatgaaatcgttgcccatacctatgtcctaaatggtattgcctaggttctgttacggtttttacagttttggatcttacatttaagtctttaatccattttgaggtgattttggtatatggtgtaagaaaggggttccattttaatcttctgcatatggctagccagttatcccagcacaatttatgaatagggaatcctttccccattgcttgtttttgtcaggtttgtcaatgatcatagttgtgtgtggtcttatttctgggttctctattctgttccattggtctatatgtctatttttgtaccagtaccatgctgtttcggttactgtagccttgaagtatagttgaaatcaggtagcatacactggacgtggtggctcatgcctgtaatcccagcactttgggaggcagaggcaggtggatcatgaggtcaggagttcgagaccagtctggtcaacaaggtgaaaccttgtctctactaaagatacaaaaaattagctgagcgtggtggcatgtgcctgtaatcccagctactcaggaggctgagaaaaggagaatcacttgaacccaggaggcagaggttgcagtgagccaggatcacacaattgcaccccagcctggatgacagggtgagactccatctcaaaaaaaaaaaaataataatcaggtagtgtaatgcctccagctttgttccttttgtttaggattgccttggctattcaggctcttttttggttccaggtgaattttaaaatagttttttctagttctgtgaagaatgtcagtggtagtggccgggaacrgtggctcacgcctgtaatcccagcactttgggaggctgaggcaggggatcatgaggtcaggagatggagaccatcctggctaacggggtgaaaccccatctttactaaaagtacaaaaacttagcccagcatggtggcgggtacctatagtcccagctactcgggaggctgaggtaggagaatcgcttgaacctgggaggcggaggttgcaatgagccgagatcacaccactgcactcctgcctgggtaacaagagtgaaactctatctcaaaaaaaaaaaaaaaaaacctcctgaattcgttgatcttttgagtggtttttcatgtctctgtctccttcaggagacaatacctttgttaattttttattattacgtcttgtcttctgctagcttagggatatgtttgctctttgttctcaagttcttttggttgtgattttaggttgttaacttgaaatctttctaactttttgatgtgggcatttaatgctataaatttctctcttaacactgccttagctctttcccagagattctggtacattgtatctttgttctaattatcttcaaagaacttcttgatttgtgccttaatttcattatttacccaaaagtcgttcaagaacaggttattcaatttctatgtaattgtatggtttgagtgaatttcttagtctttattttgaatttgattgcactgtggtccaagtgactatttgttatgatttcagttcttttgcatttgctgaggagtgttttacttccaattgtgtgatcgattttagagtaagtgccatgtgacaatgcaaaaaatgtataytccattgctttggggtgaagacttctgtagatatttatcaggtccatttgatgcagggctgagttcaggtcctgaatatcttcgttaattttctgtcttrataatctgtctaatattgtcagtggagtattaaaatctcttactattattgtgtgagattctaagtctctttcaaggtctctaggaacctactttatgaatgtgggtgttcctgtataggatgcatatatatttcagatagttagatctccttgttgaattgaaccctttaccattatgtaatgcccttctttgtctttttttatcttttttggtttaaygcctgttttgtcagaaacaatggttgcaaccctggctttttttctgctttccatttgcttggtaaattttcttccatctttttattttgagcctatgtgtgtcattgcatgtgaaatcggtgtattgaagacagcatactgataggtcttggttctttatccagcttgccactctatgtcttttaaatggggcatttagcccatttacatttaaggttagtattgatatgtatggatttgatcctgtcatcatgatgttaactagttactttgcagacttgcttatgtggttgctttattgtgtcactagtctgtgtacttcattgtgtttttgtagtgactggtaactgtctttccatgtttagtgcttccttcaggagttcttgtaatgcaggtctggtagtaatgaattcccttggcatttgtttgcctgaaaagaatctgatttctcctttgcttatgaagcttagtttgtttggatatgaaattctgggttggaaactcttttctttgagaatgttgaatactggacctcagtctcttctggcttgtaggatttccactgagacatccactgttagtctgatgggcttccctttgtaggtgatctggcctttctctctggatacccttgacattttttctttcattttaaccttggagcatctgatgattatttgtcttggggatgatcttctcatggagcagcttactggggtcctctgcatttctgaatttgaatgttggcctgtctagctaggttggggaagttctcatggatcatatcctgaaatgttttccaaattggttccattctccccatctctttcaggtacaccaatcattcatacattgtttctttacataatcccatgtttttcagatgttttgttcattccttttcattcttttttctctagtcttgtcttcttgtcttatttcagaaagccagtcttcaagcactgagattcttttctccacttgctctattctgctattaatacttgtgagtgcaccacgaaattcttataaagtgttttttacctctatcaggttggttatcagattcttttgctgattccttctcatctctatgggcttatctaccctcaatctttgaggttgctgacctttgagtggattttttttctcttcttttgttttctcttttaacagtctggccacttttctatagggctgtacagtttgctaggggcctgctacagtccctagttgcctcagattttccagtacctgaaggtatcaccagtgaaggctatgtaacagcaaagatggcagtctgccccttcctctgggaggtctgttccaggaaagtacagacttgttgccagcctgaacacacctgtaggaggtgctggagaccctggttgggaggtcttgcccagtcaggaggaacaggatcaggatctagaggtttactaaaggaggaatgctcccacaggagacacagaaatgaaccattgagctggaagctaagacagctacccaggcccttcagagcctcatgattctgaatcaacaaaggaaggagttactgcactgtctggggtgattggtcctggccatcagggggaattggtctactactacacaatggcagtaaataggactgtgtctggaacacaggagatcttttagagcatctcttagtaatactctgccgtataattaaagtcaataaaaacggcaacaacccaagtcaggtaggactagtaatgacacatacccttcaggaatgaaggtttgagtcacccaagcaggaaaagaaacctgatcagctgacggacttgctgaaagaaatgggaatatgggatggttagtgaaaaacaacaaaaaaagtatttataaatactagttgtggccggcacagtggcttgtgcctgtaatcccagcactttgggaggcggaggcaggtggattgcttaagtctaggaatgtgagaccaacctgagcaaaatgctgaaactccatctctactgaaaataaatacaaaaaattagtcagacttggtggtgtgcttgtagtcccagctacttaggaggttgaggtaggaggatcacttgtgcccaggaggtggaggttgtagtgagccaaggtaatgccactgcactccagcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttgtgtctgtgtgtatgtatccttacatgtattgagcaaatacctttcttttcatcttttcctgatgatctgtaataaaacataagatgtgctaacaataattcccttttattaataaaagttaacttttattacgcatggtatttaggttacagtatatcaaagagaagagtgcatatcatgcatctttttctgtggaaagggttagtgtgtttctagttggatgcaagttaattgtatcatctttggcaaaagtaagactttataattgtttttatttggagacgaagtaaggtttaaggaaaatgttaatgggtgccaagttcacaagcatggactgggatggtgggtcttatgtgtcaattttactaaaccatagcacctagttatttaatcaaacactaaatttatatgttgatatgatggtgttttgcagttgtgattaaaatctgatatcagttgatttcatgaaaaggaaattaccctaaaacatgtgggtgggactttttgaatcacttgaaggcctttgggcgaaatgtgagtcttcccagagaagaaaaaattctgcctcaagatgacagtagcaactacactttaggtttccaatctgccagcctggtctacaaattttagattgaaggctgcaacattatgactttccagccttccagcctgccgaggtgtaacttgtgacatcaataacgtaaaatgaggggtgggaaaagatgtaaagaagcagagtttcatattgatttcagttcaagattgttataactgtattgttatatataataccacagtaatcacaaagaaatatacataaaatatacacaaaagaaaatgagaaggcagttaaaacatatcactagaaaaaaatcgactaaatgaaaaatgactaaaaacaaaagaaggttggaatgaaggagatgaaggacaaaacagctataagacatgcataaaaccaacatcacaattacagaagtaaatccttccttatcagtaattactttaaatgtaaatgtaaatggattaaacttcccaatcagaattcagagattatcacaatggacagaataaaaaggatctggctgggcacggtggctcacacttttaatctcagcactttgggagacggtggctggcagatcacaaggtcaggagttcgagaccagcctggccaacatgatgaaaccccgtctctactaaaaatagaaaaaaattagccgggtgtagtggcaggtgcctgtaatctcagttacaagggaggctaaggcaggagaattgctggaaccggggaggcagaggtttcagtgagctaagatcgtaccactgcactccagcctgggcaacagagtgagactccgtctcaaaaaaaaaaaaaaaagattctcactttggatctaacgacacacagaagttgaaattggaaagacagagaaggatattcacaaaaatagtaactaagaatttttaatgatctcttatagggttctatgtgttggctgggctcagatgatggcctgggagtgttacatggtccagggattgaagtggaaggaaccagacgcaggcaggatggttaacagcagtgcccagactgacacagccacacttctgccatattttattgggtaacgcagatatcagatctgcttatgtttaaggagtggagagaacttacctcttgatgagggagtggtgggtcaaactaaagaaaagcaagtgcgatggaagatatttagatatttttgcagccctctttggaaaatacatgcaattcaaaacatcctatctgccagaaaggaagaacaccattacgccttacccctccagtttaagccctgtgattctatagtatcctggggaaggatcatgtcttaggaagcaggtggggagtcgaagctctaaataaagccccatctacacccacaatttcactttattttgatgaaattttgtgtcatttttgatgaaatgggggctcacaaatctctcttcagggatctctccagtggcggggacgatatgctcccttctccacagttctactttatagataagtggaactagatctcagtttcagttatttaaaacaccagagacttggatgcatgcatgtcacaaaaaggtgaaagaatgctctctgtcactttcccttctctcactcactgcgccctgaacaagaacctgctctaccctgaccttttgaatgaggaggagggtcgcactcctgcctaaccttcaactttccagagataaacctcctgcccaaacagcatggttcattataaagaccaaaccctacaccaagagctctccccttatccaccatggcagaaactgaatcctatggaaaggcccagaaaattctggctcaaaatgaccagcgtcatgtcccttccaccaaaataaagccaacatattcatcacaacatggggtattgataaggatatcaaaatgattaccaaaaaaatttgacaaatatgttctttttattacatcaacttttttttccctccaaatataaagaaaataagcctgcacagcaggagaagttgttcccctgggagagcatcctctttccagctgaaaatctggtactggaatcactagaatggaacaagggtttctggtatgacacagcaccaggtcttggggcagccagagttagggagggctcaccctctgggtgacaccaacctttggttctccatttttttgttctcattgcaagaacaaaatttcagagtatcagagccaaagaaatttactctattttattctttagaaaatgcaatctcaaggataatcagactgttatgggctaaattgtatccccccaaaattggcatgttgatgtcctaacccccagtacctgagagagtgactgcatttggagaggttttaaggaggtcattaaggtaaaatgaggtcatgtgagtgtgccctaattcaatgtgactagtgtcttcataaaaagagaagattagacacagacagatacggaggaatgaccatgtgaagacagagagagaacacatctacaagccaaggaaagaaccttagaagaaatcagcactgccaacaccatgatcttgaacttccagcctccagaactgtgagacaatgaatttctgttgtttaagtcacccagtgtgtggtactttgttatggcagctctagcaaattaaaacaaacatattatattgcccaatggagagttttacctgactccactctggctccaatttgattaaggtctatatgctctgggacctctccagctcctcatgagaaatgacaaagaatgccatgtccagctcctggggtccctgatggcagtaagaggcagctcctaatcgagggagctttggggtgacgaaggcctcatagacttcatcactgttgggccacttggcttcagtcccctgaccacaatggatccatgggcctggattcacctctgacattcgtgtcttttttttccacaagtggtctctggtagagatggagggaaaggacacagggattcaaaatcctgactatcctagtgtcctcccctcacttccactcagagacaacacggccatttctctaaactcctgaggacgtggccaacataagtaatggagcacggggaggtgccttgaacagagctgcatggaagggtggctggtggcctctagaccctttgtctatacgtgctgggcttctttagtatgaaatgtcccagagacagccacattctatgcttggatcctcaaaccaaaatgtgtgagggtcttagccctggccaactgagcactgaattcaagagagaccaggaaaccttctgaatattgggacactttattcctgaatcctgaatcctggaagttggcttctggccagggargcaggtgtcattatatctgggctgcctctgtgaggcctcttttccctctgcctttcacatctttctasccctgttaaaatcccagaacagatagaaacattctgccttcttagatgcctcttgctacaaatttcaatgccatttgattgaattaataaatgaaagcaactttaatacaagatgaggtttaaagaatggtatttgacatgggtttagaatgaataaatggatcaagtaatgaattttgagaaaattcatgtaaaatttatttttaaccattttattaacttgactgtggaattaataaatgattccaaattaatacaaaaaagtgcaatcacaaatgtatgaatgcccagaagtgtgaatgaggggcaatgcacacaagaaaaaaggtgtgcacaggaagaaattcttcattccacgtttttactgatccctctggtcaagatgggctaaaagtccaaaaatctgctttcctcacatggtcaaatgattcagcataaaatacaactgactgaacacaattatcaatgctttaaatatattagaaaaaatcaataaggaaaaataatcctaccatcactaagattttaagttataataaaataaagcctagaaacgtatcgtttgttcccaattccaatgattataggattgcagtgtttggctttcaaaagaccatttaaaacaactcagggaagttttcttaacaaactctatagcaggaccacagctaaacctatgagtagtagtagaagtaaacaatgacactgtctttaaaatttcattttgaaaaacatgtttgaaagtggctgactggctcctaatttaaccactaccatttgaagtcatatgttagattggcaaagtcgtcgtaatttttatgtattttatttttgtaatgcaagtgcttcactctgctatctgataaaagaaaataccaagccaggcatggtgatgcatgccttgtagtcccagctactcaagagcctgaggcaggaggttccttcagcccaggagttcaaggctgcagcaagctatgatggtgccactgcactccagcctgggcaacagataatgcaattttaatgtaaaattttagtgttaggagttcaaccttggactgattctgtgagatcctatttgagagaagctgttgtgtacaatgaagtttggggaatatcaacaagaagtaaatgcctaccttgtttctaatttacaaactaaaaggaaattccataaaatttaatgctaagctaaatcattgtagaatgaatgacaaaaaaattatcctacaaaacataaccagttgctagatatatttgaacattaattagaaaaaagatgaatgaaagccatgttttaggaataaaaactacaaaagaactgtaaaagcttatcatgcccttggctggagttacgcaaagttactactcacccgtaaattgggattagcatggtggctacttcttaaagttgatacaaggattaaatgtgttttaatgcatcaaaagcatctagaaaagtgcctgagacatagtaagtgctaaagtctctctaagtaaataaaaaatatataaaagtgatgctaaattcacgattctgatcctctgtgcacacccaatgtgtttaaaattctgttcatcttcccttccacattcacagtgaaatgtttctgattaatttaatgggctgtgtgaggtgttcattatcttttacattaaacttggtacattgtacaacactcttatattgtgataatttaccaagctaacacaggcttaccttgtttttaatccttttcacacacagcatagaattatattgctatatttttaaatttcagatgatttgaaaaatatttacactatagtagccaaacagtaataattataagcaacttggataaaacatttgaaattagagaactatatttagaataaatttctcaccttacagaaaaatttcccattgaaaacccctttatttcgcatacaaataagaattcagcatgtttttctatacccagagagaacagagataaacagggtcctttcgtgtggtttgggtattttattagatgctgagttcaagaaagtctcacccctgaagaagctgaaattccatttttcttcgaaatggggtcttttcaaagttagtaacaatgaagctgtcattcacacgatgcatggctgaacaaaaagacagagacagcgggtgctgcattttatttttgtaatgttgccttgtccacaagacactatttacacttaaatcaattaaaattatattaattttaaaagtcagttttcccagtttctcatttgtactagccacatttcaaatactcagaattcatgggtggccggtgactgacgtaatgaacagcacagatataggcattccatcactacagaagggagctggacagcagtgtgccaatgttttaaggacagaatcctgagtagaattataggatgatgacaattccgagttcccattccaattcatggtctcttctctgatgagtggtgtagggggaaatccatctcttttgtgagtaaaggttaatttttccaactacagataaataattaacattactttttttaaaaccagttttacactgttaagttacaaccaaaagtgaagggcttgaattacatttacattttaacacatggttttaaagggaagatccgtgtgaaaaagaaacaaaactcagaaaaaaaacccagaagttttcataccarttcccatagcaataacaatcccttttctgtcgttagagttcaccctcattctgatttcatagtaatcctgttcatgtctttctttaaagctttaccccatgcatatatttctaaaacaacacaggttatctcaaactttatataaattttgaatttttcatacaaatggaatcatgctgtgtatattcttacaagacctcattttagatcaaatgtatgtttgctaagtttttataggtgtctgtagagtattcatgtttattatttgtaacatttcattgaataaatacatcatatattaaattaacccttctctcgtttatggtcatttcatttgttgtcagattttttaaaattacaagcaatgctgttacaagycttctagcactagtctgttggcacaatgggcacatatctgtcaaaattatacacctaggagtggagttactggtatatgtgtatgatatcccactcaaagagatgatgccacactgctagataaagtggctgtggcaagcaaygtgtggtagatcttgatggtctgtattctcatcagtgtttggaaaactcaataattttaatatagaaattytagtgcatttttcaaaatatctcattatgttttcctcattaaactttattgagatataaatcacatactactcacmcatctaaagtatrcaattcaatggtttttcacatattcagagttttaaatctgcatatttaattttagaayattttcatcatcccaagataatccacggctttataatatgtctctctatacaatgaagtaaatccataaattttgagttttcacttcaggagtgttttttctatcattggcaactttcctagcttgacaggcacctttccaagtacctttaacaattttatttttaatagagatttcattcagtaatcagatttggagagcactgacaaattttgccacattgagacttataatycatgaacatgtaatgtttacttattaaatactcttaaataaagtattgctggttttacttgtgcatcttttagtagatttattccaaagatcttgaaatatggtgctagtgttcacagtatctctttctttgttgaatttcagtgttggttgtggtatgtataaatataaataattttatatagttttaattcaatgactttgcttaaagcttttattaattcatgtagttgatatattctgttgcctgattgcactagctaggaaatccagtgtgattttgagtgcaatggagagggcaggtctgctggtatcttctctgtgcactcctgatccacactccatgtactctccctgctccgtgtcctggacactgtgctgcatggcctgctggaccacaaaaggcagccttgctttctggcttttatttgggatcggctaaatgggagcatcatcacggagagagtgatgaggagcactggttggagggatttctccccatagctttcagtattgacatagggagaaatgagatgtgattggcctggattcatcaatatgggatcttcacccagtatcttagattaaatgtgttattttgaacacctaagagtgatgttaatagtcagccaggttagctaattaaaacccgaattcaactgtggcctagcacagtgtttctcaaatttgactgagctttccatcacgtgggagattttaaatagccccaggtctagatcaacatgtaaaaccaatgaaatctaattcatcaaaagtaggatcctggaaacagtattgttcctaaaactctccaggtttgactccaatcaacagccaagttaaaaactagtagctcaaagcagtggttctcaatatttggtatgtatcaaaatcatctgggaattgtagcaaaactacacaggcccagatattattctaatttaacaggctagrgccttgagtttattaaaacaaatcatctctccagattttgctatatgcaacagtttgtgaaaaccactagcctatatcaacagaatccctatcacaggcatactgcagaggaaagtgtctgaacacagctsagaragacggaaaagtgggaatgtatccattatgtgcaacctacttaacatctcctaaccacatctcccgggagggctgagaggatgcccccctyaccaaggyattaaggtgccacatgacacatacaggtataaaaactgctaggtctgctgagcagtcaccaaycttgagtccyggatattcagaaattcttatccagtagctacaccaaagccagytgatatgtcagagcccctcawataagcagaaggctggtgcccttgagaaaggaccctataattcactctgagataaattctttttacaggactttcccagaggaacatttagtcatttatcgctgtccactggggaatggaaaaccccaaataatctgggagctcaactttaatgtctttaatcctgtcaaagattaccctggggttaatactttgttgtaacctgcataaaaatctttccctacactaaagtaatgaagatattctactatattactgtaaagagatgagtacaatcacatttttttacaagagatgagtacaattgcatttttccagatagataaccaattgttgttaaattattttctaaatcgttttcctttacccactgatctgtaatgttgcctctgctctacatacgttcagggctttctattctgttcccaagttctagtttactaccctgtctcaacatctcgactctcttaattaaaataactctaacataagtcttaatatctgctaaggaaattctctctgcttattattcttatttagagtgtcatagctactttttctctttcatatttcaatataaggcttaaaattggcttactatgtgttgcaaaaatgcttgataaacatttrattgagatgtgtttgagttcttagagtactgtaggaaattaatgtcattattatattgaaccatccaagccaggatcctggtaaattgattcagttaattcactgtcttctttaattactgtcttctattattactcagtagggttttttaaatatcccaattgatatcttgtacagaatttgttaggtttagttttagaagtttatatgtacgcacttttgctgaatcaattttttaaaattttcattttatatctgtgcaaaacagctctataatttcttctacctaccaagcaaaaatatcttattaacttccggatcacgaggtcaggagatcaagaccatcctggctaacatggtgaaaccccatctctactaaaaatacaaaaaattagccgggcatggtggcgggcgcctgtaatcccagctactcgggaggctgaggcaggagaatggcctaagtaaatctgggaggcggagcttgcagtgagccgagatctcgccactgcactccagcctgggcgacagagcgagactccgtctcaaaaaaaaaaaaaaaaaaaaaaaaatatatatatatatatatatatatatatttatatatatatgtatcttattaacttcaagagtgttctaatcatttgtattttctgcattcagcatattaccatttgcaaattataagagttttgtgccttcttttcaaacctttttaagtatatttcttttcttctttatgacactgggaagatcctcaattacaatttttaataagagcagtgaaaactgctggaccactcaaacaaaaattgagctgccactcctgagaactgactgtgttgcnnnnnnnnnnnnnnnnnnnnacagacatgttgccagcctgaacacacctgtaggaggtgctggagaccctggttgggagatcttgcccagtcaggaggaacaggatcaggatctagaggtttacaaaaggaggaatgatcctacaggagacacagaaatgaaccattcagctggaagctaagacagccacctgggcccttcagctcctcatgattctgaatcaacaaaggaaggagttactgcactgtctggggtgattggtcctggtcatcagggggaattggtctgctactacacaatggcagtaaataggactatgtctggaacacaggaggtcttttagagcatctcttagtaatactctgccctataattaaagtcaataaaaactacaacaacctaagtcaggtaggactactaatgacccatacccttcaggaatgaaggtttaagtcatccaagcaggaaaagaaacctgatcagctgagggacttgctgaaagcaatgggaatatgggatggttagtgaaaaacaacaaaaaaaaagtatttataaatactagytgtggccagcacagtggctcatgcctgtaatcccagcactttgggaggctgaggcaggtggattgcttaagtctaggaatgtgagaccaacctgagcaaaatgctgaaactccatctctactgaaaataaatacaaaaaattagtcagacttggtggtgtgcttgtagtcccagctacttaggaggttgaggtagraggatcacttgtgcccaggaggtggaggttgcagtgagccaaggtaatgccactgcactccakcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttatgtctgtgtgtatgtatccatacatgtattgagcaaatacctttcttttcatcttttcctgatcatctgtaataaaacataagatgtgctaacaataattcccttttattaatgaaagtttaacttttattacacatggtatttgggttacagtacatcaaagagaagagtgcatatcatgcattcagtttgaatctgaggcaggcagatcacaaggtcaggagatcgagaccatcctggctaacatggtgaaaccccatctctactaaaaatacaaaaaattagccgggcatggtggcgggcgcctgtaatcccagctactcgggaggctgaggcaggagaatggcctaagtaaatctgggaggcggagcttgcagtgagccgagatctcgccactgcactccagcctgggcgacagagcgagactccgtctcaaaaaaaaaaaaaaaaaaaaaaaaatatatatatatatatatatatatatatttatatatatatgtatcttattaacttcaagagtgttctaatcatttgtattttctgcattcagcatattaccatttgcaaattataagagttttgtgccttcttttcaaacctttttaagtatatttcttttcttctttatgacactgggaagatcctcaattacaatttttaataagagcagtgaaaactgctggaccactcaaacaaaaattgagctgccactcctgagaactgactgtgttgctcttatggatcagccctttgggacccatcctaatcccagggatttacagtgccacatatgcacccgcagcctttagatgtagactttatccacctagccctcaaaggtctcagacactgcccagagcagccaacatcacccaggacaaaagcaaccctgcagctcaacttgctcttctagatttctgccttctcctggttcctggcctggcaaatctttactgcttggttagccccttcatactttccatcagatttttcaaatatgtacccttttcccacttgtccagtagtactcaatgggagggatgatccaaattacataattaataattgctgaaaactaaagtacaatgtacaatttttatgtcaatgtcacatgccaagggagaaaatgcataggtatcagtagtgactacttaagcatgtgtaacttagaggtaataaaaacaaaaatgttaggtaatatctatctattccagattaaaatctayatcaataaattcaaacttctaggaaaaatatctgcatatgtaatatatgactgtgactccgatagacgaacgtgggaatatagtatgaagatacttctcatcgtcttcactctgtgaggcagtcagtgtgaaatgagaaccagggattcaaaatgtgttgcaagactatgaaaagcactagagtaagttctacacaaataaagcaatctcctcataaattacactgggcttatctgtgagatgcatgtccttatcaaaatggagttaattctaggtaggtgatcttgtttaaataaaatggactctgactcactagctactggtccaccatcggtttttccctttactaaaagggaggccccacactgagccagcatttcccaagaggaggtctcttgctgacatcaacttccaacagggtaaattttcatgggaacccaaagagaagaggaagacctcaagaaaaaggrcctaaagaaatgacaagaatgataacattttacacttttattgtgctatgtgtcaaatagtggtcttcgcactttaaaaatgccaattcattttattctgactacacatccatggcttgtgcctgttatttttccctttcatagttaatgccataggaatgaagatcacacaaaagtagggatggagccgggtttgcacccagacaattctgccccagggccatgctcacaccactgcacttttccagaatgtgagggtgggcggagagtccagctcagggagagagattggagtgagagaagaaggagagggggccgactggatcactgtgatggtctggacccacgattccaggagagaaagacaaggattatgtcactcagggaaaatatccaaagtctctggtttaaacttaagcatctccagctcyaggacaggtggctggtgggaagacaaactaagccaaagccacagctctgaagatttccctctcctgagaattctgcaggggtttccctgacctcatggccacctctcacccttggctcttgtttttcccccaggactgataagggcgtccagatgggacgcctttatcagttggtctcgggttctagagaagccatcagagtcagtggaggatgagcttcataaagtgggagatctccaggatccttcctggactccaagatacccagagaagccggatcctgtgtcccggaacccccttcctgttcctctgtgggccctgaccttrgggagaactgggctggtgagaagatcaggatgaactgggctggggaggcaagagggaaagggcggcttggagggcttagtagctcctctcgcggcgcctccgtcccgggctgggatctgcagactcctcaggtcacttctcccagagccgccgccccaagccaccctcccctggttcccgtccctctgtcccctccccagctccccccacacagtaagaagctcccaagtgagcggctccggtgccgggcgggacgtgggagggaggctgtgtccccgcggggaggcagggcgacggcgtccaggagagaggsgagcggggcggcgtcccaggcaccctgcgcctctcccgcccgcaatgtgcgggttcccggagcccaggcccgcaccccgggtacttgaaggccgccgggctccgccttcaccacgtgggccctgagttcctcmgcggcgccttcgtgggcgacacgcgattcctgagcttccacagccgcggcgagaatcagagcgtgaagcgcgggtggagaagatggcacagggctgtgggcgccctgaggaaagttctcgaagaccgcagggaatgtgttactgaggggcctgaggttcctgggcccgcaccaccaccagggtcagccggtgagtgacctcagactccgggcacaggtgtgccccgccccgaccccagagtgaccagcccggttctcccagggatgggggggcggggcctcagctgatccctctcaggtggggaagcgctggggccattttgctccaggtttctccttcaatctggatcatgactgacttgttctgtgaccaatgacagagggaggaaggagctggggtgggcggggcgacctccctcccctccctggccccgcctccggctcaccctggggcaggtccagggcaccgcacctgcagatgctgctgyctggctgggtggtggctccggacaggagcttcctcgaaggacactttaagtccgcctacgacaaggagatttcatgtccctgaacgaggacctgcagacctggacagcggctcaaagagcggcttggaggatccatcacacctgggagaggttctggaccgcgkaggccacaagggaagccccgatgggtcactgcactaggtggctgctcagacacctggagcatggcaaggagatgatgctgccggcaggtactggggtcctccaggccccacgtcaggacctcttggagctggaattatgttccttggaggcatccatatttgaggaaagaggagaccgaacagtctccgtctcctcctcctcctccttctcctcctccgtcgccgcctcctcctcctcctccctactgcggggttggggattctggcccaggctcctgaggctctcccatgggtgggtggggagggaggacagagaagaaggagtgcagggaggtaaataggaaaggacagtagttacccttgtcaacagtgatgtacttgggtctagcttcaccgggaatctttttctttcctggccctctgtgcccaacaattacatataatctttaacccaaccagaagataaaacaccaggaaacggaatcggcagagacacagtagatgaaagtaccacgaaggactgctaggttctaatagaaagtagcagatgtgagtatcaaaagttataaacctttttgcaaatcagaaaagaaacagacttttttttttttttttttttttttttttttttttttttgagacggagtctctctctgtcacccaggctggagtgcagtggcgcgatctcagctcactgcaagctccgcctcccaggttcacgccattctcctgcctcagcctcccgagtagctgggactacaggcgcccgccactacgcccggctaattttttgtatttttagtagagacggggtttcactgtgttagccaggatggtctcgatctcctgacctcatgatccgcccgcctcggcctcccagagtgctgggattacaggcgtgagccaccgcgcctggccgaaaaagacattttaagactgaaaagtggtatcaccaatgttagaaccaaaaaaytggacctgagggtgcatcacccgagggggttaagttaaactctgtccctgttccttctagagccccgtggagattcctgctgtgcagcaaagcctgggaggggcccttggctgtggaaggcaggctgagacgtcataggtgagataggaggaaggggacctgctggactcccggaggcctggtacccagggaaggccagttcctagggctgcctctggacttcagaaccttgatgttaagtcagattttcccgctcctccatgagcttccaggagcagggccacatggggctcagaaagtcccacagtgcctaggaagtgggtctgtctcttgtgggacaaaaattctcaggtctttctctttcagattcttaaatttcttaaaagagattgaactggaattacccaggccccaaactgaatcaaggaattgggactgtgtaatgtgtgtgtgtctgtctgtgcacatgtggatgtataaacaggtatgggcatctatgtgtatgtgcgtgtttataagtgcgtatatgtatgtatctgtacatatttatgtatataagcaggtatgggtatgtatgtgtgtatgtgtgtgtgttactctgtgacttcctcatacttggcaccaccctggccttttcctggttgccccccacaccataggttgtaggggacagaacagygctccacctgcaggcatagaacgggggtcaggataagtgttggggagagctggtttcatcacacctggaataaggaaacaggacctaaatggatgggtcccactcttttacagaattgtaccttaaaaaaagtgtcagtcacgttcctaagggatttacatgaattaaatcatttaaacctcacaagagccctatgacctagagacagctatcagccccattttacagacaaggaaactgaggtcactaggaagtttagtaactgtcartgggctgactcatgactctaaggagacagtctgactgctgagcccaagtaactgctctgtcatactcaccctcacacccacctactactggctccctgtgggtcacctcctcctgtgggctctgaccagcttccctttcttctccaggcacagagactggactgaagtctattgcatttgccacagtcccgactggggagtcatggggttgaagtgacccataggctgatggagtgtgcttgctggatgcgggggaaagggagatttatatctgccctggagggagtcaatggtgtttgcatcatggcatatgaggtgcactatctagaatgctgaagggtaaagaccagcaggggccatgcagagtctattcatcacggttttatttcacagcctgcatgggcctgagagtggtggggtgttcactcatctccatccaatccctactggttcctgacctctcttcttccaactggtaatacctgcactcaaggttgaaccatgaggaggagtctacccacaccccacacttcctcctctctgcctgccactccctagtggggcctcctggatggtgtgagaggagagtgacggagatagtaagagaacttgacattcacactggtaaagagaaagtgggatgtcaacctatgagaaagataagggctgccacagggaaggggatgagataagttctaactggccccaagggtcgcttaactcagtgaaagctgtgggaggtgttttcagctatccattgctatgtaagaaattgccacaaacttagcagcttacaacaacacacatgtattatcccacatttctatgggtcaggaatccagacacagctatgcagctttctcacatgattttcatcagagtgccatggctgggtcttatctggaggctgaactggggaaggatccacttccaagctcaagcaattgttggcaggattcattcctccatgcctgttagactgacagcctcagttccttactggctggtggccagaggctgacttcagttccttgccacatgggcctttctgcttcatcaaaacttgcaaacaaagaaggtagaagacagagtcatctagtaatacagaagtgcggctgtaatatgacctcatcacggaagtgacatcatttttgtcactttctattggttagaagcaagtttaggccccatcggttctcagctggatgagatgccaagagacaggatcaccgggcatcatcttagggtctctatacacaggctggaccatgactgaacaagrtcattacaaacccgggtcctggactgggccagatgatctgcagagctgagctgtgtttatgaaatcgaatycctggaaacaaaaatcaagagacgcccactggaaaggctggtcttgcattctgtgtgaaagctaagatggygttctctccaaatgtttttctctattacttttcaaacctcctgcatctgtaaagaagcaacaccactaaacctatctggtttttttttcattcgagtgtcatactgttaggyaaatcttctgctttcactatttcttcaagcttgttttcatgcagaatcccaygaacttctggtaattacactttattgatttcttttccttcactcagtttattttttagtgattttatttctcttgtatggataaattagtccatttaattagggaatttgtgtcttctaaagaaatatttctactattttttggaccatatgggctaagatcctcttgccaagcctcagctcacttcccacatggacacgacaaaattactgggggtcctggaaagtcggggattggcatagttcttaagcaggatcagacatgtaagtcacaaagatatgaggcagatacctttgatttccttatgaccctgatgacagcatacctggcactcaatacctgtctgtagaggtgaactcaactaaactcctccctgatcactcaataccatgtgagcccaaggacctcttatgtcatgggccaaattcccttgttttatgtcatttttccagatggagtgctgttcacatggggacctttctccttttccacctcattttccatgtgtgaaacactgggtcttgattactcagatctctcagggtcctttctaccttttcctccatcctaacattctccctacagttcccgccagggtttccccgaacctcttcttctccatgtattcagtctagcatctctcagttcattcttcacacttcaccaaagtgatattctggaatgcagatctgatcaaggttcttcctgacttcagtgctgccagtgctgcacattgtcctcggataaaagccaaaggttctccccaaccccacaagccttagtcattgaatctgctcactgctccaagcttgctttttgcccctgtgctcctctttctctaatctctaccctgaactgctgacagttcccccagactccctgtgtgttctttcttctgagcctttgtttgtgatactgattccctaaaagatttctcctgccattcacctggattaactgtgttcctcatccagttctctgtttagacattgcatcctcttggaagcagttttcccgcactaattatagtagcctgcatttagctgtttttttagtccccttgtggaatctttgatgtttcactcattgaggcctaggagaccctgacacatagtaactgcctaataaatgtttgctarataaatgtgrggttcaccatgagataccacrttatacatgcaagaatggcattaatttggctgggcgcggtggctcaagtctgtaatcccagcactttgggaggccaaagcaggcagatcacgagatcaggagatcgaaaccatcctggctaacacggtgaaaccctgtctctaccagaaatacaaaaaattatctgggcgtggtggcatgcacctgtagtcccagctactcgggaggctgaggcaggagaattgctggaacctgggaggtggaggttgcagggaaccaagatcataccactgcactccagcctgggagacagagtgagattctgtctcaaaaaaaaaaaaatggcattaattaaaaagtcaaaaaacaatagatgttggcatggatggattacactgctggttgtgagaatgtaaattagtacaactactatggaaaacagtatggagattccttaaagaactaaaactagatctatcatttgatccagcaatcccactactgggtatctacccaaaggaaaataagtcattatatgaaaaagacacatgcacacacatgtttatagcaacacaattcataattgcagggatgtggaaccagcctaagtgctcattgaccaaccagtggctaaagaaagtgtggtgtatgtacaccatggattactactcagccataaaaaggaatgaaataatgccttatgtagcaacttggatggagctggaggccattatcctaagtggagtaactcaggaatggaaaaaccaaatactgaatgttctcacttataaatgagagctaagctatgaggacacaaaaacatacaaaatgacataatggactctaggggcttgttggtggaggttgggaatagggtgagggataaaaggcaacactgggtagagtacactgctcgggtgatggtgcaccaaaatctcagaattcactactaaagaactcacacacataaccaaaaactacctgtcccccaaaaactattgaaataaaaaaattttttagataaatgtggggttgattcgtaattyaaaatttattttgaatagctaatacaagaacaakatttaaaagattataataataaaaatgtgtatagtgtgcaaagcaaatttcsttctccaccccatccacaattcttccaaattccttgcctggatgcaaccactgttaccagtttcagcaagaaattaagacagaaattaaagttctgctcctcataataatcacgatcaattatccctgcttatacagtaacccctccttttcccaacagcctcctagcatgaggaacccaaattgaacaggtaacaaacatacccctaaacgtaatgtaacttgtactctgttccatggtaggaacttccttctctgggatcccaaactcctagaccagctgagtacgttgaggggatgggaagcaccaacaccccacgcgggttaccggaagtgctggtgagtatagtcattccttcttccagcactggtggttagagacttacttmctctrcctgttggagacttggcactrtgtaacagctgctgccatagcctaagtgtatgcttcatcctgaaggacattacccatcctgataggatgtgatcttcaagataaaacccagctgcaccctcaagagaccatyccactgctctatcagctggcagcgtgtgtgatgcagtatrgggtagaaccaggagatctcatggtcgtgtgcccactaccagacagcgttcgctataaagtaggtcccttagtctggggcaatgttatgtggttcccctattagaagatcatacatatgtgagcccttagataacgtttctgagtgtggcactrtgggaagaaagaacaaactcataccgctaatacaaggcaagctaaatctgacagaacccctgcctttttcattgtgaaaaagtaagagtagaatcaatttgccatcaaattgctcattggcctccataagcaaaggtaatctgttggagtttatttatcgttggaaggtaggttgtgacaataaccacgtcagccaygctgaagggagcccaagccttgggacycacccacagtgcatctcttccaccatagatactgctttcaagagcctgtttcatgagcactgggatggttaaggacagaggctggctgatgtgtaccaaatgattcatcctgtacacctggttgtttagactacttgtatagagggtaatttttgctgagtattaacatctgatacaaaagatccaagcactttgtatctactgtatgcctctttccagatattcctgttcctgatcttcctatcttgctccttccaggccccggacccgctatttaagccatttgccgttgcctatgagtctgtgcatgttctcacctcaggccacttctgtctacacaaagtgggcaaatcagagccccacctgcctattggcaggaccctcttcagcactgtctctgctcattcctgagttgcccacactgcagacacactctactgctgcctcacaccaacacactaagctggcatgtttatgaagaagctcagaattttcctcttaagtcagctggtcatagaaactacccataaggtcattggtgagagtcgaggtcaaggcaaatttccagcagtgtgaggtgacatggggtctgagcaatgtctgtatgtaattaacatcagtactcagaacatacatactttaacccaggggtcagccagtggtttcagtaaaggcccagatggtttccctttgctgtgtgtgtgttcattcccctctccgaagctatgtgtaaccccatagggatcacaggggttcccatcaaccacagccagttacatccacaaaagccttgatccttgttagcagatgggagagggtggctyggaggattgaaatccctacttcataggactctggatacttacacagttgcttcctcctgtgcttctacatgaatctcagcactgtatttaggacaccgtctgcactcttattcttcatgcaattctgtttgctcctcagatggccgcttttcctttgaagctcaacagtggtcatcacgtacttgggctgagggttactggttaactctgtgggattctgggatcagttccttcccattcttagccatccctgtgctttacaaaacttagcttcacaattatactcatctctctctgtgtgcacctctaagaaattactgayaaaacacttgagttttttgaaattacaaaaatatatacaagaaaatgtttatggggccattgattagcatggaaaagcataaactttcctgttttctgcctctcattagaatttaatcccccaaaattgaactcattccaaacttctggcttaactaggagttgctgtagccagcctattctagacagcatcctgtaagcccctgggattggcagacacaagaccactttttccattcatatatgtggttctgttctggccagatcaacggacttccagtgcccttcttgagtcatactgaggtaaattactcagaccacgaactcacatttttaaataaataaaatagcagcatagttaakaatttatttatcccattactgggcatatacccaaaggattataaatcattctactataaagacacatgcacacatatgttcactgcagcactatttgcaatagcaaagacttggaaccaatccaaatgcccatcaatgatagactggataaagaaaatgtggcacatatacaccatggaatgttatgcagccataaaaaagaatgagttcatgtgctttgcagagacatggatgaagctggaaacaatcattcttagcaaactaacacagaaacagaaaaccaaacaccgcatgttctcacttataagcaggagttgaacaatgagaacatgtggacacaaggagggaaacatcacatactggggtctgtcaggggatgggggcaaggggagggataccattaggagaaatacctaatgcatgcggggcttaaaacctagatgacgggttgatggatgcagcaaaccactatggcacatgtgtacctatataaccaacctgtacattctgcacatatatcccagaacttaaaagtataattaaaaaaagaatttatttcatttgtrtagtccattaaattttttgtacattttttaaacctgcacttttcatagtttttgatacatccttgctccaataaatagcttgctaaaactactaaatctcatagatataccaatggtttgcatcatctaatggcacatttgcttgtcaaactgaggtcagccagtcccccttcattcactgttagtaactcatgtgttgcattgttaaaaacccagtatcacctcatctcccctctagcatcttctctgcagaggagaagccaggcactatatctcccaggatccccttccctgtatagttccagtttacattttccagtgagagagacttgcmtaagaaatggggccctggagagatggtgggacagacctgtacccatcagtggtggctgcaggtagaggagcaggcagatgtcaggttctcagtggcttccctgctaggctagagacccacctgctttgcttgtgtggactaagatgagtgataagagctttctcataggttctggagaatatagcaatctcgcagcaggattctgagaacctcccatccatgcttcaagctgaagtcttcagtatatgcttccctgacctccctactgcagcttccaggagctccaatggtgactggtattattatagtatcctgctgctgctataacaaaytaccacaactatgtggcttaaaacaacaccaatgtattmtcttatagttctggaggtaagaagtcaaaaatgkgtcactatgggctaaaattaacatgtygtcagagctgcatttcttctgaggctctaaaggaaaatctgtttcctcaccctttccagcttcttggggctgcctgcattctttggcttgtggtctcttcctccatcttccaagtcagcagtcacatcactttgacctctgattctgttgtcacagctctaactctgatgctgctttctactcctttcacttataaggactattgtgattacatcgaacctgcccagataatccaggataatcttcccatctcaagagcctcagcttaatcacatctgaaaatttccttttgccctattaggagacatttttataagttccagggattaggacacagrcatatttaggagacygttattctgcctgtcacatgacttcaccaatatttgctacccgtggtttccaaacattagtgtatgctcttatttctatttattcctgaaataccagagtgagtctgtttttctgaaaacagctcactaatgcccagaggagctcaaaaattttctgtctgttgtctcaaagtctccaaattktactgattcttcaaygtgcatggctgtaaattaggcaataatcttgctggggtgttggaaggaraagaaagggaatgattagacagcccttctgattcgggacagaatctgattcgggacactgtccctgatggctggccatcttgggctgtaatccagtttccctcccacgtagacccggtcatttctgactccccaagaggttttcacagtattcatgtccacttccttcatcagtcrtcttcttgtcttatatctccatgtttacatttttcttctcttctaccactgyagttctgccttgattcttcagccattgccttccttttgcatgcatgtgcttcagccagttctctaggaagacattccagacagctcattatcacttgttactatgtttatttgactgcagagctttgaagatttgtaactttctattttttaaattttagtgtaaaaataattcttgctcacagtaggaaatgaaacaatcaaaatatgcataaatatacttttaaatctctcctttcactaaatccaaacccacttaactaaggtgattactattgtatcagcctactctctgcatgtctactttcttcacttgcacgcaaaccatagtgagtgtttttatctggtagcttttgttgagctgtaatgactataagttttatatgtaatttaatcattttcagggcaacttgagatataatttaaatagtataaaatccgcacattcaaaatatacaattcagtggcttttagaatattcacagttgtgcctccattaccacaatcaattacagatccttttatctcctcccagccctgcagaaaaatccatatccaaaccccagccctaagaaactaccaacctatgttttaactctacagatttacctattctgaacattttatgtaatgaaattatacaacatgtggctttttgtgtctgtcttcttttacttaccagaacattttcaaagtttgtgtgggtcgtagcttgtatcagtacttcacatctttttcatcgctgaattacattccattgtatggatatatcacaatttatttattagttggtgacattttggtccttctcatttggattgtgattaataatgctgctataaacatggcatataggtttttatgtgaactcatgttttcatttctcttgggtatactgtatcataggaggggattgctgggtcatgtaataacttaatgttcacaaatttgagctactgmkagcctgctttctaaaggggctatgtctcttaaatccccaccagcaaagtgtgagtrttctagtatctccacattctcatcaacactaattattatctttttaattatagccattctagtgggtgggaaatagtatctcatttttgggttgatgtgcatttccctgatggttaatgatgttgaacatgtttctatgtgcttatgggccttttgtatattatttgtcttattattattattatttattgtttattattatcttattattaatattattatattgagttacaaccattctttatatattctagatacaagtcctttccttgccagatataagatttgcaaaacttttctcccattcaatgagtttcttttcactttcttgatggtgtccttagactcacacatttttaattttgatgatgttcaatttatcttttatttcctctttttgcttgtgcctttggtatcatttaagatcaggtatttttacctaatccaaagtcatgaagatttatgcttatgttttcttctaagagttctctaatgttaagtctcacatttaggtctttgatacactgaggtaatttttatatgtggtgtgaagtagggatccagctttattcttttgcatagggatagmctgttgtttctgcactgtttgatgaaaagataatttcttcccctcactgaattatattagcactgttttataaaaccaattaaccatataagtgaagagtattgctgggccctcaattttcttctgacttcattstttttaatgctgttgtaagttggatttttaaataacatttgtattaatgcattgatactctatagaagcacactcaatttttgtattttgatcttgtagcctaccaatgtgctaaactaatttagtattagtggtttagtagttgctaagcttgtttttagtgaattctttygtatttctatataagattttatcatctgcaattgagatagttttacctcttgctttttaatctagatgacttttatttcatcttattgctcattgtagcttttgaaaaattacattgtattcacagtgccctaccatttgatatttttatttctattatatcatgaacatcctttgaatttcacagaaaaaatggtttaactcatcattttaatgctgttccatagtatgttatatgcacctactcccctggggtaaatatttaggtggtttcatttatttgtcacccactctacagacgtctatatgcacatattctcccagccatcccagagttttctgatttcccataacgtcagtgattaaactcctgatctgtctgactagctagacatgctgactgactgacagttccattgctactttryataatttaagatcaacagctacatttggatctcagatcatctaggcccagctgcagttagtctttcctagtctcagagattccctctctgcctgttaatttctctatccctgaaactgcccttgtactccagcccaagcrgyttcctagcccagtagtcctggatctgccacttgctaactagaaggtgtcatctgcagaaggtaagtaaggcatttatctccattcactttatatttagttatcaaatctccatgtagctcaggtagatcgagctgaaaacattcttgtgtttagtaatatagccattgagcacaccatcattgctcttttcataccttagtcctactcaaagattaaagtgacagcttcccagttatgataaaaaagtataaaacattctgagggacctgtaaactataaagctaaaatatcagcttctgcatgcaacatatatgtcaaattctatgtccaatactcttctcrtttttagaattaattctgcaaacttgaagattgagctttttatgaactgattggcatctgctatgctcaccagattattcccacttgactgagaggatggtggtagcaagagctccttcctttcagaggcttttaaaaatacttattgggaagaatgtaccacataaggcatttaactaatgaaaccacagatataaccactggcaaaaaaatcaaacaaacatttctttaactgccctgtacttggtacattctcttcctcctgctarggaagtatctcctctcccttcacttcacagactggaattttccaaattcctagtctcaacaagacaaactgtattttgaaatcactgttttcccagaatacccggagtgttaccatgactccagaagatgccttcaaccaagactcataatctgactgtaagaaaccttcagataaggtattgggaacttctgtaaaattgtagctgggytgtgattagagaattttcacaatatcaacraatcttacaaaagagctgctgatccaacaggtcctcagagatcctgtgtgggaaccagaaggtattctgtgaaaaacgacaataagaataaccataataacaataatggctgcatttaaaaggctcttgctatatttcaggcactggtttttgtacctacatggattattttgttcaatatttatcacaaccatatgagaaggatgttattatccacaataaataaatgaaatctgtaaactgtaacttgttcaagaaaattaggtacagagatgttaagttacttgcccaaagttccataattttgaagatatgaggctagaattcagttccaggccattttacactagatctactaatttagccactgtatgattgtaccaagactgacctaaagctacctccccttccccaacaggttcttttatgacagtgagtataaaatacagggctaatgacgtattgggtgcagagaggggttggaaagaatgtggtatttcagactatgcttactatgcttaaaaatcacaattccgtggtgactagagtttatcttaaactttcctccctggcattccattgcatccagttgagagagcactctagctccctacatcccagaacatgtagatctgtccgtggttctgaaagatacactggcaggtcccgccaactacatgaatggcattcatattgtggaaaactgcccactagtaaaaatgtacagttgaacttgtacattcattacttacaaggttggagaacgtgaagtactggacaatccaacaatagcttggaaagataccataaaaagacccgcagaatattcttttatatgcattatwctgaaatgtacaaaacaaaaccagaatgggacacattatgagtgagaagtttatcttgaaattttaatcagaatatgaagaaaagaaatccaacattagacctggaaaaagataaaataatttgtatttcatttaacaatatttatagattctcaatatatacactatccttttaaacctcaatttatatttaaccatccatttacctttattttttgtttgtttttttctttcacctcatactttctacctgggatatctttttgtgactaaagtacattctttagaacttcttgtactttactaggtgtgtttgtgttaaattgtttgtcttcaaaattcattgagatttaaattttattattatattttcatrcttaagtgttatgtgtttgtctcttcaaatttttctgaagattatttatagttttatagtcactaaatgtatttaacaatctgttctttaatcatagcccatttagcaattttatatcctatacaattattctgatttctcagttatatgattgtatgattctgctgtctgttgtattttcttgttctttcacggtgctttgtctcttatgaacattgttctctgttgttgttcttaactgttaagtgctccttttgctggtgtaatgattttttggaattttcagagtgccaatgacagtagaaatttttcagagaagttttgcttgattttccaaggttccttggagtctgcactactttaaaataaattcatgccttgatgatttttagaccacccagggagtgtgaactcgggctgcaaatccacttctctttaatctcaggagaaggttttgcccctctccactcagcaccaaggtgactttctggggagaccttcaagcaaggatgttttccttatactgaggagctggctttgggatcctggtgaaatgaggagaacactctattaaatttcccactctgagtgctacctgaactctgtcttctattccaaatgccttaggaggccatgaaaactaaaccttaattatcctacattaagtaaataagctcagcaaaaaaagtaaatgcacaattccgtgatttaggatttgacaatttttattaaagtttaagcctctcaatgcttctacattgtgttttattttttcactatccatttttgttagcatgagggtaggtatgtttacctaaatgtgccatgtgagtggttcaaatctcctccccaaygctccttatcacaaaccttaccatcttattcctttaaagtcactgactatctaaggaaactactagctactgctgtgcattgattaggacccaacagtaagacrtttctccttttggtaaactgcacttccagatggtctaattgaacatcttctcactggaagtatttttatttccattactcttaatgatgattcctgaaagagactctaatgccctgacagttaactctggggtatccaagcatactcaaatttttttccttctacagtcagttgtccttagggaactcctcaagacctcaataatgagacaagggagagtggactctccagtggtaataagaacattaggagtatagtacaaattattaggcaacttacctggccttatggaacctgctaaagtctgatgctgtgtataccatttccccttgcagactgagggctggtgagcatgagtgacccgataaaactcaggtcataatgggcatctcaagtcacttggtcattttctgtatcatgatcatagaattcagaatctaccagggcccagtagtaagccagaagctattactcaaattcagaaaaagaatggaactttttccccaaaccctgaaacttgggcaatgagtcctatgactgccacacacaaacacacacacacacacacacacacacacacacacacacacacactcaacaatatccaaataagcatttagggccaaatggcagatatgcttgacttttgcctggatcaaaatgacatttccatttattatggaatgtttctgtacttgtactagctcataggattttggattagagaaatacccttgcaggatatgaagtcatactttttcattggtgaaatcatctgtyctcattagagtttaataatatcatgcagttatttctcaaagagcttgtactccttagatttgctggaattcctcaagttaaaaagaccagggcctcaatratgggaggtctcattgccaatrgctacaaccggctgtagaatttattaaaaacatgtgagtgcattgtttggggaaagaatcaagaacaaaagcagtgcttgttttgtacttcactgaactacttccatggcctccattcaactttagctgcagttttggtgacttgattcacagactgtcggaaagttatgagctatggaatgtgctctctccaatactaaagaggccagtcatatatatgtagggtgtccttctttatcattgtaggttgtatgaagtcagtgattcccatagaaccttggggtcacagatgccaggcctaatcttcttttattattcattcaatctttattttttcaaacaatggtctcactctcttgcccaggctggagtccaatggtgcgaacacaactcactgcagcctcgaccgccccaggcttaggtgatcctcccacctcagccttccaagtagccgggactacagctgtgtgccaccgcacctggctaatttttgtgttttttgtagagatgggtttttgtcatgttacccaggcttgtcttgaactcctgggctcaagcaatccacccaccttggcctcccaaagttgtggsattacagacatgagccactgcacccagcyctaatcttattttaattttagaaatctaacttgacagtttctggtgcctggatccatatttgtctcagaagattgaattgtggactgtgaccttctctcccaaaagtctctttcagggtagaacttctggttatggcaacatgaagagatagaccagcaagttttcctccaacagcaacatgaaaactgtactaaatactaaaaacaaacatttgaagtcactggaaaattaacaaaggcaagcaatatgtgataagagctttcttgtttaagactccttctgtcttaggtaaggactgcaagttggtggcctttccttcttacctatgagtgctcttcagcctcccagcagataactgcagccctagtggctcaatatgggcagtttatagagttcagagcccaaatcagctagaaatgtaaatgagaatgttgaaagagagctgcagaagagttgagatcaacaatgtgaatgcaaattatgctcatccctagttgaacactaaactctgcatgggtgtgggccacttgggaatctggtgaaaaaccagaaagaaactagagggaggtctaccctccaaagagataaatgatcctggtragrtctgcaagtcttcagtaacatggactgagtrcatttgccaacctgcacagagctcagtagaagaaagcaaaaatcttactggcttgagaggtgaaaaggcaggatttgaggctaacaaaacaattggaaattcaaagagaattccagaaacaaagcaaccacaatgaagttgaatcacaaaatctgagtataaatgacccaaatacttggtcaacctctaaattacacagatgcaggacacacacycagaaacccctgctgaaaccacgtaagatactaagtggaaattctcaaacagaaaaaaaagaaaatgaaagtattctggaagaggtccacagaagttttgagatggcagaataaagaacaagcctgtgactttgaatataaatctccagaatgtgctcaattctaaaatccaaaacacagattgaaataagattaaagaaaaaaatgaagagaacstcatgaacccatcagagaatataaagcaggtgaccagatatgcaagtggatcctcaaaagaagacacaggatcagaaaaaaatatttgagaaaataatagttgaaagtttcccacatttggtgggggattttagctcatatctaaggygttcaataaatgaaagcaaaataactgcagagaaaattacaaatagggtgaccaaggccttggyctggcctgaggcaacttagctagccccagggrtgtgtgttctggtgtggagtaagatcagggagctaccagtgcaatctctgcctctacatcagcgggactgatcattttaattttgattgcagttactgctggtatctgaatcaaagtggtgatgcttcctgaggaaatttctgaagccattagtcaattagaacattataagccatgcctcccgtgaagaggagcatctaatcccagcatttgcaccagggaactctgcctgaagggattaccagtgacttgaaagtgtaaccaacaacaatcttgtcactattaygcaccagctaagcaatctgaacatacatgctgaagacayatttggtgagctatttaaggaggctaactrcttccacattagatcaaattctcttagaatttgttgcctcatggtcaaagtcactcagctggattcagcagtggaagaggtgtcaccacaggacatcaacatggaaaaagccctcaaaagttccccagcccaagaccagcaagcagtttcaaagagcagcattcctactcctgctgctgacatttacaatcagagtgattgaccacctcccctgaatagcatgagagcacatggagatgataaagacaggctgaagttctatactgatccttcccatttatttgacctctggaaagaagaagtgctgcaggacacagaagacaaaaggaaagacagaaggcatcaaaagtagcaaaaccacatagatggcaccacttatgatgtgaaaaggattacaaaagccagaaacaagcaccatgagtggaatatgatggcatatgacaaagagcttagacccagcaacaggttgtctcagtgtgtaccatggagcatcctgcaagaacccctgtccctagacagcaggtcccatacaatggatgttagggatgctcttatcgagctactccaaaccattctcacgacccttcctaggcagctgaagatgcatgtccacatgggcccacaaaccaggcccctgagcttgagtgccacccctcctctgcctcagtgaggcacatggccctaaatggacctcaagagcggcccccacttccctgccttaccccagctgtgttccaatcctgtgcacttatggctccaggagactacaggatgctcccagcacaggtgcttgcatattacaacccgtcaagacctccttctcttcccccttttacagtacaaactgcctttgttgccttctgcaaatcctcctgccgcctccttcctcatatcagctggctccacacaccctcctcctcaccctccctccactggcccctgggtccagcattccctcctccagccacacactttccccaccaggcctcttggctcagttcttcttttttgtcttccccatgcattcgcccccacactaccaccagtagctgaggcaaagtgtcaagaacctgcacagccaccaaaaagtgatacgagaagtgatctccttgctgctactggaatggggatttgactggaaaaggtgcaggatctgtgtgagcaagaggccaagagtgagccccttgggaaggacaaggtcacaaccctgtcaatacattgcagtggagaagtacagggattctgagggagacttagagtttgacaaaaacaaccggcccaaccaaggcagtgctggggctagctctatgcaacaggtgggtagctggtaccaggctgggtgacagccaggagaccatatgctaagaatgtacttaagatttcaagtggtctcagcactcaatggtattataatcccgcagctgagcaccttttgtattaatgatgtgatattgcttctgcacatccaaaaattctgggttttctcagtatttactgtgtaacatttaaatgccattaagcatagaatatcatgctgcacatgaagaaatagggtgtaactattacatcgtcctgaaaagagcgttttttttttttcctgtaggccatgaaagtatttagtgtactttgggtttactcttattgatcattacaattctgcagatgtgctgtgtgaagctgcctggtgctaggcctttgaagattaataactgtgtttcaggtggatatcttcagatgagtaattgatattgttttactgttttggggtgttttatgagtttgaaaagctgttggttctagagggaaaggtttaacaaataaggagaatccaatatttctgctttcattttcttggcgtggtatcctctgtgtgaatttgaatgctcagttgaatagytttattgccttagtacacacttgtcaaatgtaaagttggaaggacccttttcaggaagggtttcctgtgaacattcacttagtaaatgcttgtggatgattcttgtaagaggtctcagtgcttagaagtaatgaaaatgaagaacaagatcctttcaccttcaggggcctttgggaccaatactcaaaatatttgccagcccttacagcttgggcaccagccagcaggagcagaggtgagtggtccaggagctgggcagctctgggcagagcagctgcatgtgggccctgggtgctaaagcaggcctgctcattgtgtgtcctggaagagctgtgttctaaaggaggccacaggagttcttagctccttaktgtgtgacagacagtgcttcagagggcaccgtgctccacttggtcttaattttgaaagtttacattgaggtgaaagtagatattgacagctgttcactcttcatgtgctgtgttcagattacggatgaatccatgagcagggcctttgccttatcctagaaacacgtggttatcttccctcatgttgttgctggcacatcacatrttgataagtacctctcaagattaccttgatagacccgtagctgtagaagagcacttagttctcacctctgcccttccccttattcttgcactgtggtcatgctagagacccatggggtttattttcctggctaaggcaaactgttgggaaatgcaagaatgagagcttctattgtgtaattctggatgaagaataactgcttgtttagarcaaataaatgtcccaggctttgattatagttatgacttcaaaaatatgctaagaccatttacttactgaggaaatcttacctacttatagtatttcaaattgattgcagtcattagtgactttcagttacgatgaagggaagaatcttgagctaaacgcagggttgtctgaggtgatgataggagtggaaacaggatggtaactaatggatttaggttaatgagttctgagaaaatcaaccagcccctgcaagtcacagctctgtgtctctaagtggacacctgtctgtcttgaggcagtcatcatataatacgcatcacatagattttagtcatatggattttgaaactctggaaaccatatgtctgcagctccctttcatgaccatgcttgtgctggtttatctgatctcctcagctgtaccagctgctgtggcatgagcttcttgagcttctctttttagagctgatcattatctggcggctgtcgctataattttcttgaatacaagtaaacattatttataaacttttaaatttctctgtttaatttttctctctctttttttttttaatgtagaggcctactttgckggcatctttgggtcctactcagtcataaaccaccctccccaccctagagtagccactcttgatttctaatacagatgagttctgccaggtctagttgaatggcattatacagtcaccatcatgaccctgggtctcatcatctcgctgtgtgtggtcgtagcctattcactcccatggctgtccaatgctccactttataaataactcacatttcttgtcctttcactgttgatagacaattttgttgtatacagattttacaaatcgtgctgctatgaataatattttcatatagtttggcacacacatacatgcatttctattggtttagaactaagagtgctattgctggatcataggtgagtagatgattggcttagtctctcaaaaascaagtttctagtagtaaacaaacagtagaggagggtgaatctcttacttagaaattattcagataataaatgaagaaggaatgagagactgagactataataactcttttgcaacccatcatgaattaacagatttagccattgartagcaatggcaattaacaacacaayaaaagaaaaaactaatgtgaggttcttcctcttgatggaagaacacaatacagcrccatcaaacaagtccaagtgaaaaagaaaccaagcctgaatagaagctgatctccatagccaattaccaatttagaggcaatacagataatagaaatrcatattaaactatgccttggggagcaatcagcaaaatgcacactatgggaagctctaccacacaatataaatttcaaggaagaatctatagaataaagamaacaaaagcatatttctaaaggtaaaactaaatcataatattggatgataaaaataaaaataaaacaaagaaktgatgatcgtaaaagtcaggttgtgtttttatttgagggaagaaagagtttattgctgggctggagcaaatgatggggcttctggtttgccccacaaacatctatccctggtgattaatgggtgtttactttgtattaaaggacacaaattttagacakttttttcttttggagtcctakattttattttatgacacaaaggctaatgaaaaaataatttatagagtatggttactgttttgcacaaagcctcctccccatcttcttttctggacactgagcacccagaacaaccagcagccccaggacccccagcaggggtgacctcacttctaggtgtgcatgcagcttacatcaccagaggtaacatgcaggtctactccttgactcctggaagaacctgataggacacagctgaagggaagccttctccgccatctgtaggctcttggccatcagtgtagagggagcgggtcctcacttctccacaggcgtcttcatggccatagcctcctctctgcatggggagtaaggcctggcccttcgcctgaacacggtgacagggatctcgccaaaggtggagatcacaccattcctcctttagcaacctcacgcttcttttgctttacaggaaagttgactcaggctggtgtccagtaaagaaatcccaaggagaggccgggtgcggtggctcacgcctgtaatcccaggactttgggaggtcgaggtgggcagatcacgaggtcaggagattgagaccatcctggctaacatggtgaaaccccgtctctactaaaaaatacaaaacattagccgggcgtggtggtgggcacctgttgtcccagctactcgggaggctgagccagaatggcgtgaacccgggaggcggagcttgcagtgctcctgctcccaggaggcrgatgcccaggatgagctttaaggtggagagaggaatgtcattgctcatcctccaggttycaagtaagaaccttcctgcccagcccatctcgatctccctgaatcctcaacgctaatgaggactgtctccttctcacctccctagactgggctttttaacactggaaagtggatgtgatttctagtttcagcatgtcctggtttattgtgctgccagtaaaataaaatcaaaatacacattgaataaataataaataacccatagtgagcaaaggcttacaatgtatttttttgagtcaagacctcactctggcctgggctggagcccagtggtgggatcgtagctcaatgcagccttgtatttatgagctcaagggatcttcccacctcagcctccacaatacctggaaatacaagcgcccaccaccaggcccagccgtttactgatttttattttttttagagacgagggtcccactatgttgtccaagctggtctccaattcctgatctcaagcaatcctcttgccttagcatcctgaattgctgggattacaggcgtgagctgtcatgcccagcttgtaatgtactgacactatcaaggtttctttctccaagtgtggayacagcagcagacaccccttgtctcttgggtsaggacactgggtaaagtggaatagcaaggcaacaaagtcactgcagaaagcacccacgtggaagaggtccagcagggagagccacctgttccagggacaccatatttagggataactcctctttctgggcaggactgttctttgattacttttgtattcacaatagttctgaaatcgtagratgatgagactcaagactggctagggttttatttttgtttagtttttattttgttttgttttgtttttttcaaaaaaccatcatgagatttgttaatcttttgaatggtttttgtgtctcaatttccttcagaayttaactcttcttaacatttcacagtccactttcagttaaaaatgtactagtacccataaatagagaaatcttgcaaccatttatcctctataaaatgtccatctttatggtacagatattatatgtaatatatctatataggttataagtcccacaagaaaaaaacttcttcttatctttaaacagttctatgtatataaattagagtaaatgaggggaacaagatagccttttgcacttagctcagtatttaccatttttgatcatcttcatcttttctgataacctcatttcccacctggtatcatttgcctttagcctgaagaattttctttaccaattgttattgtgcagatctgctggtgacaaattctcttaattttcttttacctgaaacatctccttattttgcctgtccttgaaggacatctgtgctggatatagaattcttagttgtcctttttttcttccagcactttaaaggtgttattctactttcttttgtttctatggtttctaataagaagtcgttggtcaggacaagaggaacagagaaaccaaaactgaggaaataacatggtagacctaaaacttatcaataatgaaaaaaaaacctatatgaatcaacactccaatgaagggcagagattgtgtgaattggttaaaaaaaaaaaacaaaacacagaacccaaccatatgctctttccagatatgcagtttctttgtttcttttttttttaatttaacttttatttttagttaaggagtacatgtacaggtttgttatataggtaaacttgtgtcatgcggttttattgtacagattatttctgtacccattagtacccacccaagtattaagccttagtacccattagctatttttcctgatcctctccctcctcccaccctccaccctcaagtggaccccagtgtgtgttgttcccttctgcgtgtccatgtgttctcatcatataactcctacttataagtgagaacatgtggtaattggttttctgttcctgccttagtttgctaaggataatggcctccaactccatccatgttcctgcaaaggacatgatctcattcttttttatggctgcatagtattctgtggtgtatatgtgccacattttctttttctttttttttttaatggaaaataacttttattgagatcccaccagttgcaatatctgttcccagcattaagctccttcttcctttgcaattcggtctttcttgagtggtcccatgaatgctttcttctcctccrtggtctggaagyggccatggccaaacttggagkrggtgtcaatgaacttaaggtcaatcttctccagagcccgctgctttgtctgcaccagcaaggwcttgyggagggtgagcacccacttcttggttcccaccacacagcctttcagcatgacaaagtcattggtcacttcaccatagtggacgaagccacccaaagggttgatgctcttgtcagacaggtcatagtcagtggaggcattgttcttgatcagcttgccatccttgataaggtagccctagccaatcctatagatcttcttgttgatctcagtgcggtgatggtagcctttctgcccaccacgtaccacagagaagcccacacgagcaggatgccatgccccaatacaggccaccttgcacaggccttggtgggtcttgcrgggcagcttcttggtgtgccaacgactggtgacccttttgtagcctttgcccttggtcaccctgatgacgtcgatcatctcatcctgcccaaacacttggttcacaggtacctggtgcttgagcctctcgccagcccagtccagcttctcagccacagtgcctccattcacctggatctccatcaggtgggccttcttctggcacagaggaagcagttgcatctgggtgtgggcaatgacgcagatgacttggcagtacttcttcatgctgctgaagtccttctccagctgcttcttgccatcctcatcctgccrtttcttgcagtacttggtaaaggccttcttcttagatttatgccagttcttatagaaacgtctcttgcattcatcactgatgtgctcagcgaagacagtcttgcaagtccggaagccttgaggggtttccacrcagcccacaatgcccactggtggcctctccacaatrgtcacagcctycaccacctscttcttgttcaccttggatcctggcctgtcgacttcccgcaygaygtrggtcatgccagccttgtatcccaggaaggctgtgaggtggaccggcttggaygggtcatccttagggaagctcttcaccttcccayratgcctgctgctgygcttccaaggcaggaagccgagggacccatgtctgggagtrgagaactttctgtgagacatcaygccatcaaatcctgcyggtagagcatatttgccacattttctttatccagtctaccaytgatggacatttaggttgattccatgtctttgctrttrtgaatagtgctgcaatgaacatatgcatacrtgtaagacatgggctttctttttttaatttgctttgttttattttactttaggttccaggatacatgtgcagawcctgcaggtttgttacatacgtatagtctgccatggtggtttgctgcacctattgacccatcctctaagttcccgtcccttgccccccacactccccaaaaggccctgatatgtgttgttcccctccctgtgtccatgtgttgtcattgttcaactctcacttaggaatgagaacatgaggtgctttgttttctgttcccgtgttagtttgctgaggatgatgacttccagcttcatccatgtccctgcaaaggacatgaactcattcctttttctggctgtgtactattccatggtggtatgcaccacattttctttatccatctatcactgatggacatttgggttggttccaagtctttgctattgtaaatagtgctgcagtaaacatacgtgtgcatgtgtctttatagtagaatgatttatattcctttgggtagatacccaaggggtcaaatagtatttctggttctaggtctctgaggaatggccacactgtcttccacaatggttgaactagtttacattcccaacaacagtgtaaaagtgttcctatttctccacagcctcaccagcatctattgtttcttgactttttaataattaccattctgactggygggagatggtatctcattgtggctttgatttacatttctctaatgagcagtgatattgagcttttttaatttttctcattaagattttaatgtctcattttaaaaaattaaaggaagtttccatttattttttaagataaagatttagcgcacccaaatgcccccaaagccaacagaaaaatagctttgccctgtcatttccctaagaaagcactgcagttactcaaaatatgctcaaagaaaaaaatgcaatcctctgagttctaagtttcacgaaaggaccacatgttaaactatgtatatcgatttgatgtgtaagtatgcaataaatatgtacacatacattcctatctgcttcacatcattctagagtattcatagtatatgaagatgggatttagaaatgtgaaaaggctgtaacagtgaaaaggaaaaaaagggtacaaaggtttttagaccagtagaataataatgcttagctagttaattattttaactttggagcagactaaaaaagttgttttgaaataaatggtacctgtaagtgatgcttactgcaatacttgttaagtgttatttgtcaccactgacaggaattatatagtgctagtaacacagctcccactgtcctagaattcctctaaatggccagctattgctaccattatcttgataagcatttcaagaattgtgttgctgagccttttaaaagataactagtttataacctatgtctccttatgtgcctacatcagttactcatggtcccaaagaagtataaaagaggatataagctgctgaagatttcacagaagaaacagagatatcagaaacttcatgatcatcaaacttaaaccaccgctgttttgctgcatttttacagtaggctgtgtaatggcctccatccagcccaccgcagtgatctgaaacagaaaacaaattatatttcttcaaattgttctttggaccaataacatactgtgacaaggcaagattttctaacgggaagtccacagatgtctgtaatttttgtttccacctgccattgtaggaaaaatgtttcagatgcactaaaagcacaggtggtaacttccagatttcttttttaagaatcccgtcgagctctgcaaagattgcagtaaaatctgttattatctatgagtttttcttctttagaaaataatctaaggcaatcctataatgtacatttacttgtggatgctatcagtagagacaaatacatgaaggcctcaagtgtcctagactttttgtgacgggtgaggcactgtactgtagatttgaattgaccctgaaaaagtgcaacaataatagactcatagagccgcttgtgtttctgccaggcatgttctgcagctttaaagtcattgagatgatcattattttcttctttatatgtcttccgattatcagttttatttagatcttcatggagaccatccattaggaacagaagaaattcttgtgaatcttgactgtatcctgcaaactggtaattgatcttcccaatggtgactttaaggtcttttggactgatatatctatactgtcctgtccacggggctttcatgattataccaaattcttctgccacttcacctttatgcccctaacaaatttgacttgttaatatcatcctgataacagtttcggttgaaataatcagccaaatgtggagcattacataggcactgcaatattgagttcatataacaagtatttcctaagttacgaagtccagtaagagctggtccagaacctccaaaaacaggattgagtttccaaatctgagaagcagaaagccttgagatctcagctttagggtagcatgttggcttgtcttcctgattaactgttggagttactgctggcttcctcttgaatagcctgggttatatctggggaggagtaagagcatttcagtttggaaggttccctatcctgcttagcaggaatctgtggcttgcctttatgagttggaggggtggaaggaggtgcagatgaaggagccatttccagtgggtacatatgaacagtgttagtggtgaatgataataatgaaacgttccagtgattggatcaagaaacttggcccagcctgaaggcagtcctggtaccatcctccccatttcttcacttcgtgctattatcgaaggttctcgttgagttttatttctttcagtatcatctgtatcctctctaaaagtttctgtccttagaattccagtttctggttgtcctttaatcttaaaaggcttgcctgaacctgaatcccctgtcgcagatgtatgggacacatctcttgttgactttttctgtacttctggggttgaacatcttctccccctgtcctctacagacttctcggcaccagaggtttcatgatcacttttactttgtctttttactcttgttatttctttgcccttctttgctgagatttctttatcctctttcttggcctgttcacgttctttcttctccatttcttcttttgctttttgttgcttctgtgtaatttcattttcttcagcttcttgtttctttttggctttttgctcgtgttcttccctcctcagtttctttctgtttcccttgctgtctttcctgaagttctttttcttgtttgtttttctccattagaagagcagtttctgcatgaatatgagccttttcttcatctgttaacatgagagttggagaggaaactactggcttggcggaacaatcaggaataactttttcattctgaggagactgttgctcatgatttgtactttcagatttgattatatgctcttcaggcaatttgactgccagttttttagtatgatcaatctgtggaacattctttatgctaggcactggctgaatgatgggtgaaacatcagatttagaagcagcaactgattcaactggaattgatatattcagtggtcctgtcctctcattttgatcattatcacttatttgatcacttatcaattctatgtcttcatccacttctataggtggaggtggcatctcggcagcaggtttagaaggaattgattcttccaatgagggataagtaaaatccaatgagatagacaactcttcattctggtgttgtgggggtggagtgaccttagcatttgttgtatactgggaatagcaaaggaaccagtttttatagcctccctctaaaaccaaaggcccaaggcccattgcacaggacagttttactttcccacttgaaaagtgcatctttcagatgccagagtgttgttccaatctgtaaatcttttgcagaactaaaccagtcaagaagtaccatatactccacattccccctcttcttccatgtgtctatagaattatctgggaggtgtgcttcaatccaactagcagtgactcctggactgatggcttcttcaggaacactgagagaatgtaaaatacaggaatcctgataatmctgcattctttgagcatscattataatcaagctgatgtttttatccatcatcattgtgtatagttcctttgctgtgattgctcctttctctttggtctcacatttttcattcttttcaccattgctcttttgggttttgtctttggaatccaatacaatctccaaagaacctttagccaacgtgctgccatcctctcttcctgtttcctgccttttttgttgtagccactgtgcttccccctgcctgtccttttcctcaagttttttccagatttcaacttcttcatatcttagtttaaggctttcagagagtcgttcagtttctccagtggcttttttgatgtttgcaggtccaagtattgaatggaagcaatcctgctgttgcttgaaatcaggtcttttttggataggattataaacagtcacgtttcatatacgtgtgtgagctttttttcatatgtttcttggccacgtaaatgtcttcctctgagaagtgtctgtttatatcctttgcccactttttgatggggatgggtttttttcttgtaaatttgtttaagttccttgtaaacaaacatgtgagctctcatcattcttgtttaaacacctaacagtcatcctaaccagtgcaacaaggaccaggcatggtggctcatgcctgtaatccctgcattttgggaggctgaggtgggaggatcacttgagatcaggagtttgagaccagcctgataagtgagacctcatctctaccaaataataataattttaaaagaaaacagatcaatggataagaaaggaagaaatgaaagtctttctttgtcaccagcttcattgtatatgtagaaaacactagggaattctgaaaaagtctctggaattaatcattgaatttgcaaaatagttcataaaatatatgtaataagtcacttagatgaacatgaaaagatagcaaacaatactagtcatctaagaagtgcaagttaaaaccacaatgagaaaccatcacacatcacctagagcaggtaaagttaaaaagacatatgataagtcttaacactggcaagaatatggaaaaaataggaatgtctgatattgctggtaggaatgcaaaaaatgtggcagccaatttgtaaagtggtatggcaatttcttatacagttacccatctattaccacatggcccagcaattccacaaatacgtatttatccaaaagaaataaaaatgtaagtccacacttgtaagcagttatttatagtggcttcattaataacaagccctaactggaggaatccacatgtctatcaactggagacacagaaaccaatgaataaactgggattccagcaatactcggcagctgctcagcaacaaaaatgaatgaatggcatcatctcaaacatcgttatgctaagggagagaccaaacaaaagactacataacatatgattgcatgtccatgaaattctagaaatgtcactattgcagtgacagaaagcacagcagtggttgaatgaagggaagggggtgagggtgggaggcaaggattaaatagaaaggggcataaagaaagtttttagggaaaagaaactgttctctacagcgccacaattcaggagtgactgggagggggaagtaaggggagaaggtctgagggataaggggcagagagaagggctggggaagcaggaggagaggacgaggagcaggggaaaggactctaaagcagtggaggggcctagtaggaggatctttgcatttggtgtttctctactgggcagtgtggtagttacactataaataattaccaatatccaccaaaaagtgcagctaaaactggtgaatttttttacacgtaaacgccctaataagcaaaaaaaaaaggggggggggaggggggaggaaagaaggcaaaaataaagacattgttagatcatcaaacccataaaattcatttcctaggggtcctgtactacatgtaattttaaaggacgttctacaggctgaagggaaatgatactagatggtgacccagatatacagaaaggaacaattaacaacagaaatgatgcacatacacatatcacatacacacccattttcttaatttcctgaagatatgtgactgcttgtctaaaacaaaaagtattacactgtatcgttgagtttataacgtatattgatgtaacatatacaataataatagcataatgatagtttaaatgaaactacaccatttgaagtgtcctttattttgctggatgcagcttaatattacctgaatttcactgtgaaaagtcaaggaattgggtttcaattcttacaacaataaaaaattaatgtaaagaaatatagctaaaagccactaggagaattaaaaccataagctraaaaatgtttacttgacacataagaaagtagcaaaggaggaacagaaacaaaaagatatgagacaaattgaaaacgtatagcaaaatggtagaccaaaatccaaccattataagtgaagaaatgacacgacctgagtcacattagcaggactgctgagcactgtggggagaacagacatgggcaggaagtgagggacagtgttagtgccacaattcaggagtgacagggtggcggggactaaaggggaaagagggtgtgaaggatgagaggggcagacagaagggctggagaagcaggaggtgaggaaaaggagcagaggaaagaattctaaagcagtagaagagcctggcagggggttctttgcatccggtatttaatacattttgtgtgactgccttaaaactaatgggctccttatgatttttttttaaaaaggkgttacaaaaatatcaagtgtccaaataaaatatgcacactgcttagatgtgcatagttcacgaaaacgggcagtgctggagcgctggtgaagagcattgggactgcatggagccctcgcaactttgaggtgatgactacaggctcccggttgcaatagacrgtaacaaaccctgcttctttgtattcaggagatgttctggactcacacarggaaactckggctagagaatgaggataaytttaaatgcaacaacccagagtcacagatccatagtctgcgaaagtaaaacaggagctttgagaatttaattgtaatgcagttttgacacaggtctttcacagattggaattctaatcattcagggattaccaatattgtgctacctactgtatcaataaacaaaaaggaaactggtctctatgagaatctctacctggtgctttcagacaaaacttcaccaggtttaaagagaaaactcctgactctacacgtccattcccagggcgagctcactgtctggcatcaagttccccatggtgagtttccctgtacaagagtccaaggggagaggtaagtgtcctttattttgctggatgtagtttaatattacctgaggtgaggtaaggtaaggcaaagrgtgggaggcagggagtccagttcagggacggggattccaggaggagaagtgaaggggaaggggctgggcgcagcctkggggtctctccctggtttccacagacagatccttgkccaggactcaggcacacagtgtgacaaagatgcwtggtgtaggagaagaggratcaggacgaagtcccaggtcccgggcggggctctcagggtctcaggctccaagggccgtgtctgcaytggggaggcgccgcgttgrggattctccactcccctgagtttcacttctcccaacctgcgwcgggtccttcttcctgaatactcatgacgcgtccccaattcccactcccattgggtgtcggrttctagagaagccaatcagcgtctccgcagtcccggttctraagtccccagtcacccacccggactcrsattctccccagasgccgagatgcgggtcatggcgccccgarccctcmtcctgctgctctcgggagscctggccctgaycgagacctgggcckgtgagtgcgrggttgggagggaadcggcctctgsggagaggagcgaggggccckcccggcgagggcgcaggacccggggagccgcgcagggaggwgggtcgggcgggtctcagccmctcctckyccccaggctcccactccatgaggtatttckhcacmkcygtgtccyggccyrgccgcggrgagccccrcttcatckcagtgggctacgtggacgacacscagttcgtgcrgttcgacagcgacgccgcgagtccragagrggagccscgggmgccgtgggtggagcaggaggggccggartattgggaccgggagacacagaagtacaagcgccaggcacaggctgaccgagtgarcctgcggaacctgcgcggctactacaaccagagcgaggmcggtgagtgaccccggcccggggcgcaggtcacgacccctccccatcccccacggacggcccgggtcgccccgagtctcccggtctgagatccaccccgaggctgcggaacccgcccagaccctcgaccggagagagccccagtcacctttacccggtttcattttcagtttaggccaaaatccccgcgggttggtcggggctggggcggggctcgggggacggggctgaccacgggggcggggccagggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcwcccagcgcaagtgggaggcggcccgtgaggcggagsagtggagagcctacctggagggcacgtgcgtggagtggctccgcagatacctggagaacgggaaggagacgctgcagcgcgcgggtaccaggggcagtggggagccttccccatctcctgtagatctcccgggatggcctcccacgaggaggggaggaaaatgggatcagcgctggaatatcgccctcccttgaatggagaatgggatgagttttcctgagtttcctctgagggccccctctgctctctaggacaattaagggatgaagtccttgaggaaatggaggggaagacagtccctggaatactgatcaggggtcccctttgaccactttgaccactgcagcagctgtggtcaggctgctgacctttctctcaggccttgttctctgcctcacgctcaatgtgtttaaaggtttgattccagcttttctgagtccttcggcctccactcaggtcaggaccagaagtcgctgttcctccctcagagactagaactttccaatgaataggagattatcccaggtgcctgtgtccaggctggcgtctgggttctgtgcccccttccccaccccaggtgtcctgtccattctcaggatggtcacatgggcgctgttggagtgtcgcaagagagatacaaagtgtctgaattttctgactcttcccgtcagaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggasaagagcagagatacacgtgccatrtgcagcacgaggggctgcmagagcccctcaccctgagctggrgtaaggaggggratgrggggtsacrtstcttmtcagagaaagcagaagtccttctggagcccttcagcyrggtcagggctgaggcttggrggtcagggcccctcaccttcycctcytttcccagrgccrtcttcccagcccaccatccccatcrtgggcatcgttgctggcctggctgtcctggytgtcctagctgtcctaggagctrtgrtsgcygytrtkatgygtaggaggaagagctcaggtagggaaggggtgargagyggggtctgggttttcttgtyccactgggagtttcaagccccaggtagaagtgtgccccacctcgttactggaagcaccatccacacrtgggccatcccagcctgggaccctgtgtgctagcacttactctgttgtgaagcacatgacaatgaaggacagatgtatcaccttgatgattatggtgttggggtccttgattccagcattcatgagtcaggggaaggtccctgctaaggacagaccttaggagggcagttgctccagaacccacagctgctttccccgtgtttcctgatcctgccctgggtctgcagtcatagttctggaaacttctcttgggtccaagactaggaggttcccctaagatcgcatggccctgcctcctcccwgtcccctcayagggcattttcttcccacaggtggaaaaggagggagctgctctcaggctgcgtgtaagtgatggcrgyrggcgtgtggaggagctyaccyacyccataattcctcttgtcccacatctcctgcgggctctgaccaggtctttttttttgttctaccccagscagcaacagtgcccagggctctgatgagtctctcatcrcttgtaaaggtgagattctggggagctgaagtggtckggggtggggcagagggaaaaggcctrggtaatggggatyctttgatwgggacgtttcgartgtgtggtgrgcygttcagagtgtsatcrcttaccatgactgacctgaatttgttcatgactattgtgttctgtagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccacygtgacccctgtccccacactgacctgtgttycctccccgrtcatctttcctgttccagagargtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgcatgttcgctgtgctgagtctgttgcaggtgggggtggggaaggctgtgaggagacgagtgtggacggggcctgtgcctagttgctgttcagttcttcatgggctttatgtggtcagtcctcagctgggtcaccttcactgctccattgtccttgtcccttcagtggaaacttgtccagcgggagctgtgaccacagaggctcacacatcgcccagggcagcccctgcacacgggagtccctgtgctttctgagacaaattttcagacccattcagctcctgccctccttctagggctcctcttctgctttggtctcctgccctctctcccttccctgattccagtgatcttcgtgctgactccaatcccaactcatgaatctaaagcagagcctaatttagatttgtatttgtttgtaaaattgggtccatagtctagaattgttccttcctgaagagagaaacctgatcgtgtgctgcagtgtgcggggcggttggtgtgggaggagggataggggagggaggacacacaagcagccctgctgagaaaagtacaggcggcctcggtgtcagtgtgaggggaccttgtgctgcagctgccacaaaacagcacttggcctgaggctatgttaataaagatactggctttagagtaggaggtgctctacactgatcattcaactgacctttgttgtcagccagacacaggacagaaaagttctgcatctggggaacaccattgaagtaaaatcagaaaaatatctgagcatatgcttcagtggtaagaggcagacgatacatacactataaccacagtaagaaaagaaagtgatggaaggtggtaagtgccatgaggcaggtgatccgggtatgggcagtggggacagggaaggtggctgttggacaggagttgtcaatgtgtgccttgttgcaaagatgacctttgaggaaagatttgagggacatgaggatgtctggggaagttctttctaggcaaggaaactccagtccaaatgtactagggcaggaaggtgtctgtgttcccagaagagcaaggaggccaggagggctggacagagaaactagatgaggtcagaggtatggccagagcaggtgggcttgaggggagtggggttgcgtctgacctcgctctgagtgggatggggagttagaggacagttttgagcagaagagagccatgatatgacttctttcttaaaaggatctctgatggctgtgctgagaacagaattgagaggcgagggatgagggaggcagaagggaaaacagtaggaatcgagtgcagtattccaggctggagatgtcggttaccttgactggggtgtgagcacaggaaatagtgggacgtgaggggattctggatgcatttgaagatggactcacagcatttgccaatggattgtatctgtggtgtgagaaagacgaatcaaggacacccatagttgtaaaatgagtgagtagaaggaagggtggagctgctgtcagtggagatggggagactctggcaggagcatcctgaggagggggcatcacaggcactcagtggaggagatgtctactaggaatgcaggtgggggagctggggtggcagctgggcagacaactccacagttcaggggaaaggactgggctggagaaatagatttaggagctcacaccacataaacgatacttaaaacctcaagcatggatgaagcaccaagggagtgattgactgtggaaaagaatcagcgcaaggactgaaccctggacctccagttctaagggatctgatcagaccacagagcagactgcacagttctggccccaygtctagaggacgcttagacaaggaactcccgtgtgcaccaggatcacctggatgtggtgctgagatccaggaagtctggagtcgagcaagagattctggatttatgacaaggctggagctcacgttgctggtctccagatcacacttggagtagccagaacaccaggaccccacgtctgcatcggcctcgcctgtagggcttgttatgtaaatgattccttggtcttgtgcataatattgtgagacaggggttctgaggagtggcctgagtattttctaagcctccaccagaaatcttgttgctcagccagatcaggaacctcagagatcagagagtgcccagggtgggtgggtgggttttcaaaccctgtttaaaagaggatttttcttgcagaaaggaaagggaggatgtatatcatcagttaagagatgtgataatccctgttgatctctccaccatgaggtagaggccaggtagacaattcaggatgtggctgtcacacaaggaacacctccgaatgctgctctctgaccctggtccatagattcatttctcactcacttcttggagaaaactatggaaaacaaatttctgtaatttatacataaagtagtatacctggtattgggggttaattttattgtggggaaggccacagaaccaggctgaaaactacacatcccagaaaagaatccatagcccacgcccctggatcaggtccctcctaggaacaactgcccctgctgctgagcacagacaccactgctcacacctctgacatcctggtgctggacactggaccccaaggctaggatagatgtcactgctgcccctggcaactggacatcactactgacactcagccatgtttactaaaatgcattctgcacaatcccagcctttctgtgtcacctcattctagctcagagtctggcagtgatataggatttaagaagaaattatttaggcaggtagtgagggtacagaagtctcagtaaggttttctttttaatggaaagcaggccccaaatcgttttcttttctgacaaagaccagcctgtaaaatcaagcttcagacatagacaagcaagctggaagcttgcacaagtgaatgctggcagctgtgccaataggaaaaggacatctgggactaggcgtgttcacagtgatggctccatcttcccttctttttgccagccatgtgttcagtaaagagcagacaacatagcaccggccaataaactcactccttgtgtgtcactgtccttaatcttcttggtgagatacaatgaaccctgagtatttacctgagacaacaatgctgcttcagcaggtggtcatctgactgatggagtttaagactcatgtccattatcaactgcaggggtgactggagtgttgtgctcttctagggatgggggtggtttctatctcctcttaacactttacatgttgtaaaccgaaaataaacttcaaacccaccctctcccaaccatcttaatggacaccctcctcagccagggcgctcaaaaattaacttgaaagactggctcaggccaccatgggaagcaggtgttgaacatgcctcattatggcctcttcccttttggaattcaggaaaagctgaccagcaattaacatcaacacagaccttaagtctgatcagaaacattataatctattctctctgaagcctggcacctggaggcttcaactgcatgataaaattttggactccacaacctcttatcataacccagacattcctttttattgataataactcaaccaattgccaatcagaacattttaaaatctacctataacctagaagcagtaacccccaaccctcgcttgcttcaaattgttctgcttttctggactgaaccaatgtatatcttaaatatatattattagtgtctcatatcttcctaaaatgtataaaaccaacccataccccaaccacattgagcacatgctctcagggtctcctgagggacgtgtcatgggctgtggtcactcgtatttggctcagaataaatctcttcaaatattttatgaagtttgcctcttttcattgacagtatggaattctgacgtagtaagagggttcaagtgctggagtgtgaagggtgggaaaagaatgataaattttaattattggagcagtgctccaagacaagaaatttatttagtatctggtagggattcagagtgtctgaatcaaccggtgactaataaataacatctttccacccattcccttgaaaataagttattacatcaagtttttgtctatcccagttcatactccagattattggagtggcatggtgtgatggtgaaatgattattcacacatcttcccttggcattgtctcttactgggattaaaacacccaggttttgtaagatctcagaggatctggttgcacactgatgttttatattaatatttgtattttcttgtgtgtggaaatatttctggggagagaatctctgacacttattagtttttatgtgaccccctcaaaggcctaaaaaatcctaacttctagattagaggtagggccactccatgtctggacaatgaacagctggtagaaacctgtgtttagcagacttagggacatgaaataaatgcttaatttttttttatcttttcctctgggaccgaagaaggtagaggtttacttgcttactcttactgttgttgtgggaagtcaaggaccccgaatgagggactggctggagctgcggcagaggaacataaattgtgaagatttcattttaatatggacatttaacagttcccaaataatacttttataatttcttatgcctgtctttactttaatctcttaatcctgttatcttcataagctgaggatgtacgtcaccttaggaccactgtgataattgtgttacaatttgattgtaaaacgtgtgtttgaacaatatgaaatcagtgcaccttgaaaaagaatagaataacagcaatttttatggaacaagggaagacaaccataaggtctgactgcctgcgaggttgggcaaaaagagccatatttttcttcttgcgcagagcctataaacagacgtgcaagtaggaaagatatcactaaattcttttcctagcaaggaatattaatattaatacactgaagaaggaattcattcctggggggaggtctataaacggccgctctgggaatgtctgtcttatgcagttgagataaggactgagatatgccctggtctcctgcagaaccctcaggcttactagggtggggaaaaactctgccctggtaaacttgtggtctgaccacttctctgctctcaaaccctgttttctgttgtttaagatgtttatcaagacaatacgtgcactgctaaacatagacccttatcagtggttctgcttttgccctttgtcttgttccctcagaagcatgtgatctttgttagactcttattagtagttctgctttttgcactcagaagcatgtgactttttacctactccttattcttacaccccctccccttttgaaacccttaataaaaacttgttggtctgagactcaggcagacatcatggtcctaccgatatgtgatgtcacccctggtggcccagctgtaaaattcctctctttgtactgtctttctttatttctcagctggccgacacttatggaaaatagaaagaacctatgttgaaatattgggggtgggttcccccaatatactgtaagtttctctctgtgggatggtgatggggttttcctccagccaaataattttctgattctccaacagcaattgggagtcctaggatttgactcaattctgacactaactacctggagttagcctcagactccacaggtttaaggactcagtctcacaagtctgtcctcacttcagatgcaagtcacaagttatcgggttccaggttacctgcacttctgtctatcatggctgcaaagtcaggggtttctcacctcccaaggtttgggaattcttaaactaactcaaagaactcaggaagttgctataaccatgtaaaccaaaaaacatctgagacaggtatcaatcaatttagaagtttattttgccaagctgaagatgtaccttggaaacagagacacaaattattgtagcatct

SEQ ID NO: 10653 - DNA, 261922 bp, Homo sapiens
  misc_feature (1)...(261922): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtggggagagtaattttacagagcagaaacctcccaaacaccacagccaggtgatgaacaaggccaacatcaacagtagtaagtcatggggatagcagttactcttgatatgatgggaagaaaatggcacttcacctctgtggtcttcctcccaataactcataacccgagtattttctatgaggaaagacgtcagacaaattccaatactaggcaacctataaaatacttggcctgtactcctcaaaactaacaaggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaaaactgttctaaaaaataaagtttgttaaaaagaaaatatccaaattcttgtgaatattcttgatctcttttctactgattaaagggtatattagttatctattgctgcataaccaattgccacaaacctagtggtttaaacaagacatattcattgtttcacagtttctgagtattaggagtttcggcttggcttacctgggtcctctttaggatctcacaaggctgcaaagaagttattgggttggtgaggctgttctcatctgcaggctggactggggaagaatctccttcccagattagtctgattcttggcaggaccatttccttgcagctgtatgactggaagcccagctttttactctcttattccnnnnnnnnnnnnnnnnnnnnnnnnnnnnnnnnnnnnnnnnnnnnnnnnnnnnnnccagctttttactctcttcttccgggggctgtcctcagctcctagagggcaacagcagttccttgccaggtgagcttccccatcaaggccacgtggcttcatcaagccagcaagaagagtctcttgagcaagttggctagcaagatggagtcttatatgttgcatgtaactataggagtgccatctcaacaggtttaccaaattctactggttagcagcagggcacaggcacaggatttcaccaaagtatgatcaccaggaggcagggattatcatggggccacattactgtctttttgccacaagcctttattcatctaattcacatccatagtcatgaagggaaccagaagaatggagccatatactgcaggccacatccagccccaaagctcagcaacaaatcccaagtcccacactccagcattcagtcccacactcgcagctcaaaagccaccaagaagtctttggatgagcatctggttccagttctgaaagtctaggtctatgtatatactatactttgatgaaaagtttttaaaaatgttgggcatatgtcatcaggacctcctgaggttgtatcacaggcacgtccttaacttttgcaaaataaactttctaaatttattgagacctgtctcagatacttttgggttcataccttatatgtatcctttctcaggaaactactggaggatgttttccatcaaaacaggaaaggtaagcaagagaaagacatgggatccaggaaacccaagatctaattcagaagagagaagaggataattcccagaatgaaagacagtggagggggctcaagaaaagaactgagttccagccgcacagggaactgatccagttggaagaaaagactccctgagagatctaagaagaggaaatgggtagaattatagaacactacttaatgtctttgaaaacaccaagagcagacttgacttagccagaaagtttgaggtgttagtgctaaaagtgtctagaattattctgcccaataccatcgccacctgctacatgtggctgtttgagtttaagtcaaataaaagtctaaaaattcaattctgcagtcacactaaccacattttgagtgttcaatagccacatggggctagtggctactgtactggacagtgctggtatagaacatttcaactattgcagaaagctctctcagacaccacttgtctagaaaaaaattaagccaaggaagaaaataaaagaaatggagaaaaataccaacttccagaaaaacaagcccttgtagaggaaaagaaaaataatcataatttatagggttcagctgtgaatagccttttgctaatcataaaaatgtaaacattgagttctgaattatatgtgtagaactttattgaggtgcaggaggtgaggcttgtggtttagatgaaagagaattaaagcctcatcttcccggataggagcttaataaatgatgcctatgaatgaaaaatcaggaaggagcaatgtagacattttgttaaatgtgtaaaggaatataacaaaagattcagctaaatgagtccaagtgatgtctccagggaggggaaaaaggaatagaggaaacaggaaatgttgatttagtagcaagtcttatgaaacttaagcttgattcttaagctatgttcatatagaggttgatcaaaataatgaaatcaaagtaatgacaacaaaaactgttacaatcccatctccccttatcatgtcttttttggtctccaggcatgacacttctatattttcatatttagggaagccttatctgaagttccgatattggcacctaactgccctgctttggtttgtagccagttgtacaagcttctagtcagatgcctgcgtactcataaattcttagactaactattgtctgattttagaagcttcaagatatttggtatttcagttaaatacagagtaaagcgtgaagcttccaatataatgtaaaaaatgataatagtaaaaataataatagctaacatttactgaacacttaccatgtgcaaggcatataataagaacctaccaataaatcagggtgccaatgtactgtcgttccatagaagaggtcatagataggccaggaaaataaagctgttctttcatctctagagagcatcattccagattagaatctgcagaatttagtaaggaggtggcagtgtttttctctagtgtgactaggaggtaaatataagctgcttgctggttcactcacccctgtgtaaccatggtaggaatataaccagctctcctgtgagtctcttacttctgatggctttgcaaattattagggcaacctgcagcaggccagtttagcaggggctttggggctttcttttaggaggaatttatcccaagagatctaagccagggtaatttcatgtgaactcactcttgccccaccccccaccctaactttttagatgcacacttcattatgaatggagtttgaggttctgctcatctgtagcacttctatttactatcatagtggtttcaaaagtaatgtataaagagtgtcttagtccatttggtctgctataacagaaataatataagctggatggcttataaacagaaatttacttctcatagttctagaggctggatgtctaagatcagggtgctggcatggttgggttctagtgaggactttctttcaggttgtggctggccatcatccccctgtaacttcacatggcagagagagtgccaggcagctctctggggcctctttcataagtgtactaatcccattcgtgagggctccacccttatgacccaatcactttccacacatcggggggtaggacttcaacatataaattttggggggacacattcagctcagatagtaatgatttttcagtctaataatccctaaggatattgagatgtgtatacataggaaccctcattctctgttagtgaaacataaaatagtgtaaggattttgactggcaacttgacaatatctatcanttttcaaaatgtgcatatatcttctgcctcagtatttctatttctagaaatttaccttacagatacatttcatataagtatacaaaggtaatgtacagggatgcttactgtgtgttttgtttcgcattgttttgctttattttgtaatagcaaaaacctcgaaacaacctagatgtccattaataatgattaaactattatactctatccaatcaatagaattatttgtggaaattagagtaggatatgtttatgtgatgtttcataaaaatgtctattgcatattaagtatatcgatttatgtcaatatctatattgaaaatatctgaaacttaaaaatgactaagaaggtcaatgctcattttttactttatataattttgtactctatgtttttaaagtatgggcctgtattattttttaattcaacaacacattttaaagcatgtaatgactagtaagtcacaattctagtttgcagctaccaagtgagtgatctcatattacataaatatcctttggtcataagacctgtgagaacatacaagatgaacaggtataatcagttaagatgataaaattctgttagattttatttactaccatgtgaatcatggagggggaaaaggtacatgtatttgaaatatgagattactttctcaaactcctggcctcagacaatctgcccgcctcggcctcccaaagtgttgggattacaggcgtgagccaccacgcccagcgagattactttctaatgtttaacttaaaaaagaaaaaatattacaatatgtttaatctcaaatccatatcaagatataggtgactcacagggttttgcctgaatacaggagcaacccagagaaagagcagttctctgtcacataagagcctgtgatttctgtcgctgtgtgtaaggacagacagacagacagatagaattagattttaaattagaaaaaatacttcaggagcaaagaaagtgcaagaaagacatcaggcaagttttaagaaaatggttagataatttttatgaaggaaatgtcttacgttcggatttgccaaatagggcattattttctcctgataagttactgatttccatgttatctgctcttgctgttcagaaattgagcctgtttgtgtccgcattcacacgttgcttctgggagccaggagtcatctgagttaatagaaaaatcactaactcggttacatatgagagaggttctgtattcctagcagcttgccttatctaaggagggagaaggtgctaaataggattttggtataccctcttggtttagtaacagaaaaatgatggggtctaatctttctaattacaccctgtggatatcttatttagtgccattgtcaaatattttcacctttaacttcactcatcacatttttaaaaattgcttttgtcaacttgatgtttactgggtcttattcctcagtttctttcacactagcaccagtaacttacctgtagctcacctggtgaaccttaccagagtgagtacatttaccaccatgactggacaaatgacatgaagaaagcagtcacggaagggttaaagcctctcaaagtcatgcttattttctactaaattcttttgcatgaatatgacattgaatggggcctcagtaaatgggaaattcaacctaaaattgaactgcataggctggaagttaggtaaaatttgattccatttgaattgttctaagcaagcaatttgttaccctttatcctttagtggaattgatgaacaggtggttttcagaagatcacttggtaaatttagcttctgaaatttgagcaactcaagatctgattggttgctcttgccacatgataattcggagcccaggcatcacgctggcttttgcctggggttctcaggaggggagagttgggagaggctttgctgctgaggaaatttatttggtagattgaaggtaaggccagtttatgactttttctgtaatactctttcaggagatgctccacaacttccctcgaagtatttttcaaaggtttgggccataactgaggaaattagtggtagaaatatggctaggagagtttaaccccattgccctactaaggccctactaatatctgctatgtaccgtgtgtgattagagtcaagtcctttgctaaccaatttattgcttgactgaattggctctcttgtctaacatttttttgcctttgatatttttctctaaatatattagtgtgaaaaagaagatacgctgctctacgttcctatatttatcctgttctactgggcttcatttgcctgaggagtggcagtttcgctagcttaacaaaaccagccactgcagggtattggtttacatggcaaacatctttggatgaagggacagctgttccaactcatcatccacttcatatcaagagtcttactctctggcgtcaaactgtagaggccttgagagatcctttcgctgttttctgcattagaagcttaggctaaggactgacaatcctatatgtacctcaatcaatgctttacaactttgttatttttcaggtttgaacgagagctacagaaacgaaagaaaaagtctgtataagccaatggtgttcgggaagaaaataaccccattgccttgaggtttctttttttcttttaaaatttattgacagatgtatttttatgggttccaatttgaagcctaagatatattgcaaacagtggatcagggcagtatggaaaacaagtcagccctcttagaattttggtgctgggggataaatttcagcttcttctgaaacccaagctgacctttcactaaaatttttgctggaaaatgtcttttctctaagtgtttggaagtttaaattctctgttccctgagtccaaactctctcacttccttacctcaatttcgttttacaattttaactaaactgattatgtagaagtagcaattcccaacactgaaggaataaagagaaagaaatttgaagcttctgctgtttatacttgtattttaaatgtcttctctcctttagcctgcaacaatatatgaatttgtacaatagtttagcttcaaattctatttttataatgtcataagataatttctgtgctgggaatagactctaatatgttttcatttgtatggaatatgaaaagtttgtaggtgccactactactctggaaaaatggcagatgacgaagactatgaggaggtggtggaggtaagatttaaaaaaaaaacactgacagcaaactattttatgtagtgacaatcaaagctgtgtaggtgaattaatcattcgaaaaatacattgtctattataacttcacaaagagtcatcatttaaagcataagaaaggaatattttatgttcagtttcactataattatgtgggatttagaattgacaggaaatatcactgtttcccacttttgcttttctttaagctctcaaaaaaccaagttggagtaaaggcaggttttaattcgtcttctaaaactgctttcttccccacttcccaaccccgatgttcaaagggacagagaygaagagaaagttctgaaaatggaactctgtctcttagtatctgtatagcaatagaagaaaagatctactccttattctttgcttcaactagctaatcatctatagggtaacatgggttagatattcagaataatcatatgtatgaaattatatgcagatgtgagactttatacataatacatacacatgtgcacagacacacacatacaagcaaatataaataaaggcatgaaggtcacagcgattgttggagccacaccttcctaccaacttcattatatttacccaagtcaacaagactagcttttgcttttgaattttgaataagaacaaagactatagtgggtatcttgaaaattttccttccaattattagtggacatctaacacattttacaaagctgttaatcatttattttatatttattttacatccttttgtttttatcatcttacggtttttcctcaccggctcttgcctttagcttcacattctagaaataaaatctaaaggcttggaactataatgcacataaatacagtgccatgaatctgaatgtgcttaataattaccaattaatgatgatgatctaaacacatgaaaatctccaaatgcctaaggcacttggaggcagttttgaaaatctgtgctttttaataagactgaaattaactgtaagagctacccagaaccaaattttaggtggcagtgccaaaatttctctttggaaaattattttagtgaccagtctatatttagatgaagaaaattttatttattctacaaataaaatagcttttattactgaaggatatgagggaaaaaatagaatgaatctcgtacaatgtaacactcagcctctctggcttaaatgctgataccacatctttcatgctgatattatcactagtgtgcattttacttatgtacctaagggtcagaaatatcactgtcaaacactaatacaattataaattaaattgtcttccctatgataataatgccagtaacagtttttactctccaacttaaatatcccttgtctttcttaaaataattgtgtacctttgccactggaaattgtccttagtgctagacttgattgattcaactagatgtcataaaaaaggaggtggctatttttagacatcccatcsctaccattttgttcccattacagcatctgggtctgaccagcaggtgataaacgaatagactgcctgccagaaagtattgaactgagatctctttgacctcaaaaaagatcatgagcataagagggtggtgcattcgaaaaaatggccagggaagattttagaaaacagagaggaactagctttaaaaatatgcagaaaacagagaagaactggctttaaaaatatatctccttgggatcttggacatctgaaataaagttttactgttctctctactctaacttaaacttgaaaagaaagagagagaagcaaggatgcactatctaattagtggcncagctctaaaaaaagagtgagatttggcatacaagttaatgccaaccatttaaataatgttgcctcttttataagcgtatttctaagatggatttaccaatggtgagagcccagcaaaggtaaaattgaatggtttccaaggagctgcttttaaacttggatgctgagaaaatccaaaatagttgtgaatcttccattttattttaatatttcttctgaagccactgatgttttgtgtgactggaggaatgactctatgtggcgtcagcatcaaacaatattttctagtgtccaaatgatatttctcatgtgctgaaaagtcacaactgtaaaaaagcaaatctctgtcctgtcagtgcttgtgatttttgttgctatgtgtaacgacatacaggcagaattagattttaaattaaaacaatagctcaagagtaaagaaagcacaagaatgaggaacattaggcaagttttagacgattgttaacgcaggtgaaatagcacaggcggcctactgacaatggttaagtaatttgatgacacttcactgaaaagaatgcaggccattgagggaaattttgcatcttaatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggctaaggacaggattcctctctccttacacatctgaaaccaagtgtcaaccagttcctttctgcatctatttattgctggtgatgtcagaagtagaacaaaagtagacttggtttcagatccaggctgcagatccatcatgcaggccatgatgacctcagagccactatggcaaattgcagcctacctttcccacactttgtgatgaagaatcttctcattttccccttcattacttggcatttaccagttttcatattagcaccactctgtttaggacaatcacactattgaaagggactcacccatcactccagaagaaacttattacttactaatcaggagggtataggartaattgagatgtggatatactttgggatcttattatttccatgatgcaatccatttaaaaatgtattcacactcgagtttctgttttagtttattgttagtttgcaaacagtgagttttatcacagttcctctctgcccaacccacacactcaggatcttcttattgtattctcttctcagcaaattctatcttggggaccataagaaaaaaatttccatgtcccagtaaagtaaaatagcttctcttgattaaaaaacagcctcatacatttttctcagccctctgcatctctttgtccatttggatggcattcactttagctttcctgaagtattacaaagtgaagatgggttccaaaatatgaacaggctccctcacctacccctttcccacagacattccaaatcaaccgagctagtgcagtcacctaagtggttcagctgaggcagaggagaggtggtttctgctttggttctcttgccaatgcctttgtgctctatttacagtactacacagaagaagtggtttacgaagaggtgccgggagaggtaaggcccagcccacagctgcataaactgcattctcattaaagcaggaagagctttctcctttcttagactcccagggccacaaagatggcaaaagggattatctgacagaggatcactcacctacctgtgcccagaagctggtgtgaaagcacaaacattacctgtttgatggattatttcacctttttttcctattcaaaaaacgcaagatggcagggggtggttccccctatttcttctgtgtgatatttttgtgtagatgaagctaattagaataatgtcagtggctatcaccattctccaacagcagcaggagggatggtgacaacaagccaaggagccttggctttgtgattggcatagggacaagcagttttactgtgtggagttataacttgtaggacaccatctctgccaccagggatggtgtctccagggcttcgtccctnatgatgcattgaaatgctactcagattttagcacattagcaattctaaataacctattaccataaatattccacgttcaagctctttttttttcaaggtgaaatacctctctcatgctttattttctgcatgcagctgtttctctttgagcatgacaaacagtgatatggatggttaatcctgaagcttgttcagagagcctgtgactgcataaaaactagtatctgtagatgctgtaatttggttagtctctcacagtcaaccatgcctaggtaatcatgggcagaaaacaacctattagcaatgatgtgacaacactagagggggtttttgtaaatgtacaatttccttactaggttctcttttcataattgatgctagaattctttggtacagatgatattagctgtgaagggaaggatactgtgaaatggattgaagagttggctgcttatctttttttcttacatgcattatttttaaccttggattagacccaaactttgggtcttagtgtcttccactacagcctgctgtaagaaatagtaatttctcacctactacgtagataggactgttgtgaggataattaccccattatgttgtcatcattattcttgtccacctaagcatttattagtgtaaatggcactccrgttcacattaattaactgactaagccaagggaatgaaaatctcttataatattgatgcgattcatttttttaaagttcattattctttgtctcctactacagtggagaatgcctaaatccctgcagaacaaacgaccaattttcccttagtcatttacaagttaatattaaagtcaagaatttgagctttgtttgattatcttaaccttttgttccccgaactcaagtttgcttttactttacccaggcaacttaagattttcaactgttttaaaaaaatagtttattgccaatttcccccccactactttgaagtgttcgagtgtctttctgcaaatgcaaacttaaggcaatgttgcaaagtaataaggagtaaactttttattccacgcaatcccaacaatcagcattcagatttgtgtacataatgtgccttcatacggctacagtgtgccatttcctgctttggcttactttagatatggagaagtaacaccaggaatgtatatctgacttgaagttagactaatatatactaagatcacagtagcacagtttttactttcacaacaatgttgaactgcatatcaaattttcagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccagtaagtttcaaacaacttctgctaacctggcttgattattaagaaattactnatctcaactcactctgttttggatgctggctggatttgtttctcaaacctgtatgaaacaaaaacttattttgcaaattataggctcttgtgactgttgaattttccttttatgtaattcatttataccattgcagcataagaaagcattcttattgaaatcattcctgcaaaataagcataaggccaatcataaagcatttattggtatttaatcactattagccaatctagaataatgaaatcataaatacagatttaatttaggccagttcacagaagctacttaacatatttaaacaatgtcagcagaatagcttcttagtagactagctaacagyatataaaaaggtatgtaaagaggtgtatagtgaagaagaacatttattttaaaaatccaagatcagactaagaactcatttgaaattgaggatctgaatgtttggctataccttaaaacagtggttattaaccatggctgcacactggaaccccctgggaattttaaaactaatgatgctcaggccattctagtttaatttgttcagagttgggactgtgcagaaaggtttttttttttttttttaagaaacagaatctttctctgtagcccaggctggatcaagcaatagcttgatcacagctcacttcagccccagacccctgggctgaagcaatcctcctacctcagtctccctagtagctaggactacaggagcatgccaccatgactggctaattaaaaaaaaattgtagratctcctaattattttttcatagaggtagggtcttgctatgttgcccaggatggtcgtaaactcctggccacaggtgatcctcccaccttggccccacaaaacattagaattataggcataagccaccatgcccagccctgtacaaaaggattttaaaaagctgcccagatgattctaatgtgtacccaggttgagaatcactgctctcaatggtccctggtccttagattcccatgcacagttctgtaagttacactgactgattcagacagattcagacacatttcaatgggtctaatttgtttattgtccatggtgggctgaggtctcactgggtggcttgattgcatgtcctctggaggcttaaaaaaatgaaatgtagcttaagagaacattggattatataagactaaagtttatgtcaaaagcatcctattgaggttgagcaatacatactcacttttcattaaatgatagcagctcactgtttggtaaaattctagttcagagccttaaataatctaagacaggtttctagaaacaagattttcttaacttctttagtgctgcagtattcagcaaggatagaattttttgtcaatatattgccatacattcttattaattcagatcccatgaacctagaatttctgatgttctgaacagaatgccagcaaaggtctgtaatagtttttaagtggttagtaaccaaatcaatagtataatttagattgttcactactccacttaagagtactcccaaaacatttataatgataaattatgcacattatcattaaagcaagaattcattgtgtattcagcagaaataataaaatcacattcctaaatttacagaatataattcagacctgccattaattcagctggtgtctcagctatctgaactactgaagtttagctgcaacttctgaattgaatatttttgcattgtattagcactcaaatcttttcagaattaactcaatttctatatttattttctaaaataattgagatttaggctttttatgtatgcattcagacaaaaaaaaagattgaaagaatcattttagggtatttccaagacaatagtctataataaatttgcattgtctccaagatccaaccatgtttaggagaagcaattatcaaatctattttagtttttgctgagagttggggtaggggacaaaaagaaagctattataattgataattgctataacttgaaggatttttttttatcaaatggggtgagtatgttgcctgaaattttcactgctgtcttgttaggctaatatctgatattcttttcagaataaatacaaggagaagtttgagaaaacaaaaggacagccatacgccagcacaacagatactccagaacttcgcagaatcaaaaaagtacaagatcaactcagtgaggtgggctgcattgctgaaataaaggagagggacatttcaaaatacacctactgctgggaattgtgggctctaaatatgtgctgtgagaatgagcagttganttactatgagctagttcacaaatctagaaaagcatgaaccatagatcatgttgctgtaaatgtgaacccaaagaaacttctaaaagcttggcttagcaacttagcttaagaggagactatgagatggaagctccaactcactgtggttctccacactgtagcacagtaaggccaagaagcagcaggctggagatccagccaggaaagcagacaagcagtaaatgcaggtgcttctttgaagatcacatttttccagctaaaatgcagaaactatgctttgtgatgcagacctagagtcattggggtaatgctctgtggttataagaaattccttaatatactcacatgtacatgcctgtcatgaactctaactgtgcattatttgggcaggttaagtatcgaatggatggtgatgttgctaagrctatatgtcacgtagatgaaaaagcaaaggatattgaacatgcaaagaaagtgtcgcagcaagtcagtaaggtaaggcaatgatatggatggctggggtactcagtagcatgtgcatcacctctgcattgtcttataggagaaaattggacaggcctgatcctgcccaccagcctcatgggcagtgtgagttcaatacctgtattcatcaaggaggctgcacagatgactgagtggcctgtagaacctatgggtggatggaagagtccatgccctgcccaaagaggcagctgtgactcggctccaggctgttgctgcatgaagtcccagtgtcaccaaagaagctgaggagctaaatttttaattgaaaggaattagaattttcaatcaaaagctgactattgtaggaaaagtattataggatgttggcatggtcaatgttttcctagtaacccattggcaacctctgagcaagcatgccttcatgagtctccctttgttgtttaaatcctcatgcctttgggtgagacctcaagccacagatcctctgctccttctgtctaggttttatacaagcagaactgggaagacaccaaggataagtacctgcttcctcctgatgcccctsaacttgtccaggccgttaagaacaccgccatgttcagcaaggtaagggyctgctccattgccacttctgtcttcctatgtcatcccatcatatatttcatgtaatacttggtgaactcttgatcatctggaatacaattccccaatctttttatgagtagccttgagacatgtgagactgcagggatagggcttggcaaaaaggaactgagaggaaagctcctaggcagagtggggagagggtcctttgggaacctgagcaacctgggggcagaggggagtgtctgtggagaataaaggtgctctggagaaccagctgagagagccacaaagtaatatctcaaaattgtctgtagaccctttggtatactttggatgtccctggctattactctaattagaggtttattttgtgccccttcttgcaagtgtcctatattgccctgaactatgtgaagtgcttcctggctccttacattgtgttagcacttgtaagtgctattaataaacaatgacaaataatgaccaaaaaaaaaaaaaaaaaaaaaaaaaargaaggcaggtagagtcacagagaaaagttgaaacaaaatcagacacatctgcccctctgaaaataagaaaaagcagggcatgctatcagtaaaaatgacttgggttggatggaaagtgggaagttatctgtgaatttcatttacctttgctctcacctggcccttggttctttaggttattaatggatgaattcaaaactatgtattttgtgtaaacgtgaccctacttcctcctaacttttcactcttttttgatttagaaactgtacactgaagactgggaagcagacaaaagtttgttttacccctataatgatagcccggaactgaggagagttgcccaggcccagaaagctctcagtgatgtaagtgaaatgcaagtggcaccacttaggtgtgcagagtcaggggaacttgaattacatattctggccagatggtcactgcaactcttctgtataagagactaaatgttgtatttcagaggagtatgtctagaattgttataatttatgatgtctcatttaaattagatataatttacactttatattaaatataatcttgtccagttccctcttcttataggtggcaaacctgaatctggggtcacattagttagtggcagagcccaggcttgtgagcccaagactagtattcttcccattagagcatgagtccttctttccccttggctctggttgaagttgttctgtgacaacagaatgacaatttttaaaaacctattgtaatcatagccaccttcccaaatctattaagtaaacaatgttatggaagggttgtgccttactattctaatcatcaagtccaaattgtggtgtgtctccctttttctgtgtgtgggacctgactagtgtacttgttaaaacatatttgtggctggatgtggtgactcaccccctgtaatcccagcagtttgggaggccaagagggaggattgcttgaagccaggagtctggagatcagcctgggcagtaaagcaagacctcatctctacaaaatatatttttaaaaaattagccaagtgtgggggtgcatgcctgtagtctcagctactcaggaggctgaggtaggaggatcacttgaacccaggaggtcgaggctgcagtgagctatgatcaagccactgcactccagcctgggcaacagcgagacctccatcttaaaaacaaacaaacaaacaatgaccacaccaacaacaactaaacaaaccaaaaacacatttgtatagttatcccacaaagagctcttgctatcagaagatacttcagttagtgaaaaatcagtgatcccacttgccggaattttggtatcctagaccttgaaaactgtatgttagaggaacttaaaaggcttaacagagtccttaggcttgaaaccagcagcaacagcagcagagagacccacttgggcctaacactctcccttattttgaggtactttcttacatgaccattggatttgcgggaggccatattgaaaatccagactgctactccagtcttcagcagagcactgtattataaagcgacaagttatttgacattcaattgtcagttagatccctggaacctcttatactcaatttggacttagtaagccagttcagactgattgggatttacttctaatggaatctatggtctgatcttgccatgaaccaaaattatacacaccantttgatggtgtctccaacttttgaggtctaatttttaacgccaccctcttcatatcacctgcaagtttagtggacatctttttctatttcactttctatgtaattggttaaaatataacacagatacagtcgtatccttccacaggtaagttaggaaatagagaaggtgtaacaaaattttgaagtcatctagcacatgataccaattttattgtgtgagtacttcttgcttctctttcaagattagctttttgattctgtatctcacagattcacaatattgttacatggctgttaccaagtgatcaatagttatttattggaagtctattatgcatgcacacctggcaggatagaaaagtactacaagcagttttcatcctttcctcttagaatttataatcaggctgataaaataaaagtatgatatagcaaacaacaagaaaaaagttaaaaatgaaacaaaacccaacagtctaatacttgctacaagacagacagaacacgtgtgagtaatcagagaaggccatgtggaggtggtggtcccgagggcatgggtggtgatgaagaaaggcattttgagtagagggagcacttgaacaaggggacacaggtaaaatgaggtctgagttttgagggacaaggaaaatgaatgatgggagtgcctcatttggagggcacttgtgagaatgccggcagcaggaccttgaaaggcagacaaaattgcttcgacatggaacggtaataaataagaggcatcataagattttggagcggaaaacagcatgataaaaatagaatctggagtaattttgatgagcaatatgatagattgagattaggaaatacaggaaaaactgggtaatttggagaaatctattttagtaataattagggcaaaggagaggaagaaaggaatctgagggtaataagtattaataggcatgaatggcattggatattggagccaaaggagagaaagaagccctagaggagcttctgactgtagactggtggtctgggtgagtaggggcacagctggtaaaggtgcgttaatggaaagagaaatggagttgagatgattgaaggaaacttcagatcaaggcatcctatggataaattagaaagttccattgctcaggtatgagaacagggcaagaaattaatatttgagagtcatcagaacaaagtgatagccaaagacatgaacatctatgagggaagcagaagagtgcatggccaagggcagagttttggaggacacccacacttaggactgaacaggagccagcaaaaggatgagggaacaaacagcgaagttgaaaaggaaccaggaaatgccatgtcatgtaagcctgggagaggtttccaagaagacagttaatctcctatctcccttcatctatcaaatggagagatgaaggattaccttcataccattctaatgctatggactttgaacaatgaaagttggccacatgttttgagcaattacagtagaagatgtaatgaaagagaacatacaataatgaagtaaagtcttccctgctattcctcaaaaagatgtgacagttaaggcatagcttttattttaattgcagaccaagtgtgcactcagtatcagattattgacatgcctattaatactgttgtcagtactatgaacttctacaattattgggcacagagccctaagcaagctgttgtttgcagaatgcaccatgggtaggcacatagatttctggctaagggcttgggcttagatgctgttgctatctctcctgtactatcttcctgtgtccttcttaatctacttatcatgttttccttattaactaagtagagacaaactactttgcacacactaagagtctttaagctgatgcagaatactgaactttttttttttacttttttaaaaatcagattattctccataacaacagaattctaactaaacagaattctgaagaaggttcctgagaaattaggacttctagatctgatttgtctgaaacttcttggcaggatgtcatacttaataaacatttatcctattcaaatgttgcttttaccctaaggacttaaccagccatgaaawatcctgttgtcctatgcctaaaatraagtcttcagtttgtatttttttttttttttttttgagacagggtctcactctctcacccaggctggagtgcagtgatacaatcttggcttattggcttattgcaacctccacctcccaggctcaagtgatcctctcacttcagcctcccaagtagctgggactacaggtgcacaccaccacacccggctaatttttgtatttttggtagagacagggtttcaccgtattgccctggctggtcttgaacctttgagcaattcatccgcctttgcctcccaaagtgctgggattacaggcgtgagtcactgtgccttgcttaacttatttaaaagaaattaagccaggcttgtttgtggaatttgtgtaaatacatttcaaaatctgtcttttgtatcccaattgatttgatgtccatgaaagcttttggtatargcactaggtagatattattgggataagatacagttagacttggttaaagtataaagatgattgggaccttgggattattcaactgctttacttgataaataagaacactgccatgaggaagggaaaataatcgtagaaacttcacagttgtgtcacggaagattagaaagataattctcctcttgagacattcccccatggcctcagtgtgtaagacacacattgagatgtcagtcattgactcttgctctagctaggtactatgcaggccacaagggttcccaaggataggacatcttctttgccatcccagagctcacagtcaagaggaaagagacatgtagacaaaaaattacagtgtcatctgacaacccctctaaaggaggtaatggccaagttgagtgagatcccaggagaaggtcatcacgtctggctcaggagtcagggaaggcttgagaggggagtcatggtgtcctgagccatggagaggaaacagcggtttgcagacagatggggagagggaacagcatgtacgaggccgtgaagcatctgagggcttcatgtatctggggatctatgaatagctctgcattgttggaaacaggggccaagtctggtggaacaaaagaaccagaggaatcagaaatgaagagagaaaggagggcaagagagaaggatatgcattatttgtgggcaccatacttattttaaggtgatagaagtcttttataggctgaagggaaggagctaatgaagaaggagagtttggggttgtgagaaagaggagggatgactgagagagctgggtgcaaaaggatatgctggaaagggcagcaccctgggtgcaggagtcattccctctgaaggatgtttctcctctgagccagggaaggggtgggagacgcagggatgaatatggagaagayaagtgtgtagcgtttcttcactctatgaaagaggaagctgagagtaaggtggggttgattgtgggcttaaggacagtgttggggttttagactggcccctgagagtagggactaaccagagactcataatgggctgtgaaagtttccttgaagacaaaatggcattagtataccatagggtcatagagtattgggcacagagccccaagcaagctgttgttcacagaacataccactgggcaggcatgtagatttcaagctaagtgctggggttcagagtctccctgccctgtaccttcttcctgtgtccttcttaaccctactcatcatgttagcattgcctaatccatggagttgcaggttttcttctgtggcattcagcatcctaggcataagaacagaggaagttggccaggcgcggtggctcacgcytgtaatcccagcactttgggaggccaaggcaggcagaccatgaggtcaggagatcaagcccagcctggctagcatggtgaaaccccgtctctactaaaaatacaacaaattagccgggcacggtggcgggtgcctgtagtcccagctgctcgggaggctgaggcaggagaatggcctgaacccrggaggcggagcttgcagtgagccgagatcgcgctactgcattccagcctgggcaacatagygagactccgtctcaaaaaaaaaaaaaaaagaacagaggaggtatatggtcaagtcgatccaaggctgggggtttattgaatgtgataaaaagacaaggggttgggagttgaagatgctggttaagagaataattgcagttgcaaaccatggcatggaaatgaatggaagaaagcagatctagggccatgagtcttgaggaggagggaagaaaattcagcaaaatagaaatcactagcagtactgagagcaatggtatgtaacatctaggacaaattataacatgttacactaaaatttaagacttcaaataaagatgaaagcataatcgtttttaaaatacatccctgtcttttatttcatcaggttgcctacaaaaaaggtctcgctgaacagcaagctcaattcacgcctctggcngatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatatgatccccaaagactctacagcaaaagcaatacatccataaacgtcaagaactgtgttaataaatgtttagccagcttgatgactcagtaattgataaatgtgaaaatcaccttttgaaaacagaagccatgttctaatgtcacttgacatttttacttatgacagtaatactacagagtcaccaaataaccacacacttccgtgaagagctggtttaaattcactgtgaagaccttggatagttctatcttatccgtcacacttggaaaaataagaatgtgtctcagacatagcttagttaacagcagtgggcagtggacctcataacttttaaggccctaacaaacagcttagtctacctatatttaggcagtaaactagctctgaggaatgtggctctgatgaggaatgcagagagacagatgcttagctgatgaataggcccatgctaaattcctattttaaattggtccaaatcagaccactttctcctgggatactgctgcttttaaatactttatcttgccctctgtggagatgagtgtcagtttgttctgcttgaattttgatgaaacctcaagatttttatcttaagcattttctgggtaaagtatctagtagagaagaatgatgaaatgatatggataatgatgtctattcagtgatgtttattagtgttttatattgtagattacctaactgtgtaactatgagctgtttggataaaggatctagtaagtatagtaaaatttcaccaataggaatactatcaatctgaaattttgcccaaggctaagcagaaattaactttagaactgtacataaatacatgatccattgaaagttttgatattggccaggcgcggtggctcacacctgtaatcccagcactttgggaggccaaggtgggttgatcacctgtcaggaattcgagaccagcctggccaacatggtgaaaccccatctctactaacaatacaaaaaattagccaggcgtggtggcgggcgcctgtaatctcagctacttgggaggctgaggcaggagaatcacttgatcccgggaagcggaggttgcagtgagccaagattgtgccattacactccagtctgggcaacaagtgtgaaactgtctcaaaaagagaaaaaaagaaaaaaaaaaagaaagaaagtgttgatattgtaaataagacgggagaaggacaatttatctttttggaagaaaaataaaaaggtgttttcaagtggtcatttagaaagaaaaaggaatctatttttaaatgtttatttaaagtctattttaaaagatactttactaaggaaacattcttttgccttatttaaatatgcagtggggattcttaaaagtgatttttgaaaatcactttcaaactcgtctataatcattctctccaccaatttagacttgccagttggtttagtgctacactctccagtacagtagacactagccaaatgtgactaggaagcacctgaatttgatcagtataaactgagtatataagtcagcttgggcttctacaacaaaataccatacattgggtggcttaaacaatagacgtttattttctcacagttctggaggctgggagtctaagatcacggattcagttcctggtgagagaccccttcctggcttgtagatagctgccttctcattgtgttctcacacattggagacagagagccagctctgatctcttcctcttcttcctcttcttataaggatgataatctcattatggggttcccaccctcatgacctcacctaaacttaattgcttcccaaatccccttaccttcaagtaccatcacatgcttgtgagttaggtcttcaacatatgaatttggggggtggggatatagacattcatcccataacacttagtgtccaatatgtgagaaatagacactggatctgaatatttaattatgaagaaaagaatgtttcaaattaatatttttatgttgattacatgttggaatgttaattttcagatctactgggttcagtaaactgtattattaaagttatttcccacatgtttccttctacatttaaaaatgtggctacaagaatgacttgcattatatatgcattggatggcaccactctaggtgggcaaggtgacagtgttgggtactttgaaagcattgccagaactggctttgccctgtggagtaataatatgagctaaggggaggtggctgtggaaaaaggtcactggatttggccatggtgacattatttattcccagtcttaacccagatttctgagttcttaatgactattgtgcatccaaaataatagttgtgttagggagaaatgcttgtgattggtagaagtccacccaacaacaaaccatccaacaagggaggcacagggctgccaagagtgacttacctttggtactatcttccctcctcactctcaagatgcattggcccatgttgcagcaggatcatatcttctttctccctaaaataggataaaaatctcctttatctaccctagaacttaaagtataaaaaaataaattttttaaaaaacctcctttatctagtcactcacatgcatttaaactcaatatccccttgttgaatcatgtctcccagatccatctgttggggccaaggggtcctccttggcccactgaaggttggctgaaaaatcagcttgcaaaaggcagattaattggagaaaaggcatacaaatttatttaacatgcacacacgggagccttcagaatgaagctccagctccccagggggtgcagaagcttatataccatcttgaggttacagaaagactatgaacttggatcctggcaaaacaggttatggggagtggggagaagaggaattctgttgaggagcaagaaatgattactagggagaattcaatgggtttgaagaacatacaatagtctggggtgaagtctgttgggcccacaaagcgaacaatggtttatgacagtagtctgtccaggtttctgacagactttagtcttccctcctgcaatataggttcagttgaaaactcagggaaggggtcagagggaattgttttcttttttggtaggttccggaccttagacagataaggaaacttgagcnnnnnnnnnnnnnnnnnnnnnnnnnnnnnnnnntgtgctttgggagagttggaggattgagagacaggatgggggtgggaggttagcggggaaacaatttttcttcttagtgggtctgtctggtctttatgtagaaagaagtctcttttagcttccattaatctctaagggcctttaattcaaaatactcattatactagggagccatattttggggtggagttctctgttcatcctcacacccttttcttacagctcccagttcagatggtaatgattgcatatctgcagtgattacactaatgttaccttccgtttgccagccttccttactacacctgtcagaatcaattctctcacctttgtctttggccaaagccattagctacatacttccttctgtctcagctgtattttgtagctctaacatagatgaacagtcagagttgttcatagaaacaggccttccaggtggggaagctatgcacaccatgaccagctgaaagtggggccctgaatgcgacactggaaagtccctttagtttctctgtacctgcctctctgctcccttccagatccacaaaagaaaaaatatgagatttcaggttggaatttcccactgataccaactggagcctaaattttttttaaaaaactaatctttcagtgacatattgttacacagcatgaggataccaggcccaggccctctaaaaccatgganattcttccatcacatagaattgggaagatttccattgatttcaccagaagagatttgattgagtcaagcaggcagtgttaggcccactgtggacaataaaaataccagctgggttctttataccttttctgcagggataacttttctatgaatggaaccatcaggagtcccagtgcttagcccctcacagaaaaagagaagggtaattaactggctttgtattcctttccatttggtaaccacataaaaattacagattcagatgttgaaagtagataatgaagctatatgtttaagcaagacaaagggtacccagtttgtggccccatggaagtcccctcagctgacctctgaggaggagggaaacaatcttactgtatctatggacacatggtcaccctcttacccagagaaggtgtcccagagcttggaattggcctgacatacattcctctgttaaacaaaccaaaaaaattctagagaagtgaaactgactctttcttccaagtttccatcgttcaactgcaagtacaacagattttggaggaggaaaggtttccccctaacctttctctccaactctgttgtgtttggatgttgggaaggttgaatgttggaccctgacgtgagtaacccgtctccatgtattgtacaaaagctctggcctcactctcagacttgcagagtgggaccccttcgctggtagagagggtcccacatggacacatacctctctcttcctctcactccttcacctatggacccttgtcctttcaaattctctcctactcacaaatgagacagaaggccataacttcctcagtagccagcaagctccagcctcctcctgtgtcatgaaaaatcttcccagacttggcagtgctcgggagtggattgtgagagctcgatctcccaccctgacccatttcagctgctggataggaggaaataacatgtcgtggtctgtgaagattaagaaggaaggaaggactttggatgagggggttgagtgatcttacactcttgttttgcatcttgttttaatatcttcttgaaaaccagacatctatctctcactgtgagaattaatctcctgctcaattatccttaacaaatctacatatgcaatgcctatttcttgataaatgcccaacatttagacctcattaagaatatctgctaccttctcaactttaaattatatttcaaagttctctggatctcagttttggggatcaggcccaattgccccttcccaatcctaaggtttttctcctttgacaacaagcaagaggtagggccatgtctctccaaaaaatgatgcattaggagatcctaacctgaggtatgtgtacatcaagaacctctgaagttataactgtttgtgagcattttatagctttctcagtttcttgaagaggtctgtctccaaaaaaaagatgagaaacatttctataagtagtcttagcaaatccagaaatcaattttattgacttctgttctttaaatcttcaaaacagagtgcaggtaaatcaatcagcagtatagcacaaatcttatctcagcaaagatttccattgaagagttgttccctccccgcacatacaattttctttcttacagagtttctttctgttatgatgatgacaatagtaataactattattattattacaatttttataccctatatttgcttagcactgtggggtttacaaagcactctttagcgaatgatcttattaaacttcctagcagccttctctgtaaatattattgccagcacttgtggctgagaaaacaatcatatttggtcaagacaaagtcaagtcttggtcccagagtttgaacccaggcccaggactctaaaatttatagctacgaaaaccagttggctatttatttacatattaaccttttgagaagaaaggaaattaggcatttgagtgagggctaagtttcctctaacccaagctcgttgactctgcacatcactcaccttctcttaaaggtataccagaaagacattttctttttccttaaagggtattgtggggatgtaggcatatgccagngccttgagacccattagttatgtctgttaacacatttttatgagccatggagggagaattgctctaactcagcttgggctctagctcatggacccaggtttggggttggcttggttaattctgctccaagaacacttcagccaaggtatttcaaaaccgcatatcatggtctcagtttagtgtagttgaacaaacatttatgatgtaacttctgtgtgctgcattttgtgttgggttctgaggctatgaaagtgaagaagacataccacttctctcttccaggagccttacagcctgggattcagatggagtgggatttgggagtcagatggggcaataattcaatttttgaattactttccagttcctattaaatttaactctaaaggcgaagatctattcgttagcctgcaagttgaattttattgtggttgtttctttctggaaaactaggagtgtttgtaaagcttagaaattaacggctaagttcatttggcatagaaatctcaggttgataggttgtattgtaactgaaatataaatagaggatgacttctgactctatttctttaaacatcaggggacatctgcaacttccgaatgaatgaagtccccaaactcagcaaggggagggggcgttagtaccctctttctccattctctatccctatcgcccaactttctggttgggtaaattgacagtacattggaagatttttttwaaaggcatttattaaggacctaagaatggcttgctgaagatatttttaaaagttaatcattatttcttaatttgctgtcttatttgtcaattcatgagttatgcttgtcttattttctttttcttttttctagcaaaaatacaaagaagactatgaaaataaaatcaaaggcaaatggagtgagacaccttgctttgaagttgcaaatgccagaatgaatgctgrtaacattagcacagttaagtgggaagggatggctggttggtcatcctgggagggagacccctttccttagtgacttctagctacttgctctacctgaatgggtgccagaacacttgaggcccctcttcttggggcaagacctggtgcagagttccttttaagaaagaaatttcccaaactctctttccttttgagaaatattattttggccacatgccattatttctacctcaatttttacaacacattatggtaagaccctcttactgactgcaaagtgagattagtacaagttaaagggactctttttaattattctttgcctgaggagccaaattgtacagttacgaaattgattaatttagcatctcctcactggaaaacataagtctattgtttttcttttctcttaagttccctgctcctggcccttaagagatctttcttggtagccaagaaaagcctttctaattctgtttttagcctattttaattgttctaaatctctgttaagttgctaatcatttctgtaatggtaccacattctctaattgtaatctgaccagcctaaaccaaggacagggtggcattgtgtaacttttccaaatccctgtgtcttctcatggaaattcttgcatagttcatttccacagcagttcttcagcttgtctgatgtcttacagaggaaataccaggaagattttgaaaacatgaaagaccagatctacttcatgcagaccgaaacaccagagtataaaatgaataaaaaagctggtgtggcagctagcaaggtatgaggaaatcatcccatttatcttgatggtttgagtgtgggtaaatttcttataactttggctcttgtatataattagtwaaaaaggggaggagtggttcttgggggaactaccagggctgagaccagtggatgtgaggcatttgaaaaagagtagaattgaaacaacaagaacaacaacaaaagtactttggaattataatggggctactaaaaatgttttgccatgtatgagcattaataacatctaattacyatcttcaatatttcctaatttattatttgcctgaggaaccaaactgtacatttatcaatttgatttagtgtcttctcactggaagggccttttgctgtttagaaggagaaagattgtaatcttagacagcaggacttctccccccaggaagaggcaattggtggccttatatgaagataggcaatcatacatgcaacactatcattatttttcttattttcccactgactatgaaaaaacctggtcgcaggttcataaatccatggatatttccatatgtttgattgagtgactttggtgaatggcctgagtccttagcattctaaagcacgatggtcactaaagagagcataaacttcgaagccaaacacacttggttctaaccctggccttggctatgctggagaaagcaggattacatcacttagaaggctrttacagcatccacgtgtaagacggtgttttggaccaggagggtagcagggcaggtgataagaagtcttttgaaagcacagctgacttgatttgctgatggattggatgacacgggttttggtctaagcagttagatgaatggggtttccctttattgagacagggaagactatggaagaagttggtaatttttttggaggacagacaagagctcatcttcagatatggtagatttgagatgccttttagacatccacatggaagtgtcagaggtcagtcgactacatgagcctgaagtttcaggggagatatatggaaagttgtataaactggggtgtcatcaacatacagagagtgtttcatgccatgagtctggagagcatcaagggagtgagtgtaaacagaaaactttaggggctgaactctggggtccttccatgggaacatatatgtaagatgagggagaagcaaaatcaggagagggcaatgcgttgggaagcaagtgaagggggaagggagtcatcaactgtgtcaaatgtctctgaaatggatttaccaatgtctggtctctggtgacctgaacaagagcaatttggtggagtctgcttagagaggattcacaagtgaatgaaaagagggaaattgaagatataagtatattcaactctttctaagtattttcctggtaagaaaagaagaaaatgggcaagtagctaatgaaaaactgggtaaagagggactttttaagatacgaaacaaaagcatcatgttgatggaaagaatccagtagaaagggaagatttggtgatgttggaatggggaagaatgtctggagtgatatcctagagcaggtggaaggggaagagatttggtgcttaagaggaggggatggctttgccacaagccctgacagttcatctgcataacaggggagaaggctgtgtatcccagatgcgggtagggggagagtaaagtttgtgaatctgctttctggtcgtttccatttttcaaggaaacagttaattctctaaggtggaaaagtgatctgagtctcccattactgtagcatactgtcgtgatgctctgtggaggctgaggggttgatgcctctgtgcttcccttgtgtgtctcttgcctttggataccaagctgattgccttgttttctgagttcataagtggtagatttatctaggattccttgaacttctgtgcttatattgcctgaataaagggcttacactggggatcatggtgggaaccaggatcagtttcttgttctaatccctgtggacaggctcctgatgggggcttgtgaaccctgccttccctattctcccccaacacccctcaacttgctgcttctgccatagctggaattaaaagtgcaaataggaacagcagaaggaaaagcaaggctccttctccctgctccatcctcctcctacttgtaaattgaatacatgtgtgctccatgcacagttgcaggtgaggcataaaagcgtggattagtggtacttccagcttcctttctttaggagcgtgttggcaggtaggtagctgggggttgagagctgagtgaaggttctatagcagcaggtatctgggacattatgcatgatcactatttggatttctttctccctcctattatttctgtatctctctctttgagggcaaggaccatgtgttctttcttatatctgtccccaagccagaaacagaattgacaccctatggataattttgaatgaataaatgaatgggaagaaaaagcatcctggaaatttatgcagtttctctgctgcttttaagagttactatgagtattttgtttataaaatgtcaagctgccatttttctaaagagaaaattgatttgtggaartatgtcatattcataatagagacgggggcaaaaataacccatagagttactttatcattttatttcactcctacaggtaaaatacaaagaagactatgaaaagaataaaggaaaagcagattataatgtgcttcctgcttcagagaacccacagcttaggcagctgaaggcagcaggagatgccctaagtgacgtaagtatatttttgtcaaagtgtttttaaaccttagctgcaaaagagrtgaaaattttctcctttaatgactaaatgaatatataactttgcaaatacattaaggttatggagtggtaggttcattggaactatgtaaccacagaaaggcatgagtccctctgagtacaatgtgccttactgtttgtggttctgtggggttaattcaatgggcagggaaattctcacttgcttaggagctctgggcacctgggcctccatatggatgtgttgcttatgagctccgggcacctgggtctccacattgcagacgtgttgtgattttgacagaagcagaaggagactttcaaagatagatcttggccccagaaaccatcatttgccaacaacagaacttaaaagatgggcccctaagtcttcacaggactttctaattgtgyaattattaagagcccgactaagccgttcaatttaaagcatattaggcaaacgagactgggcttgggattaaaggactaacagcctgagagagagagagagagattgaatatgtgatgatttgagtttatctcttacggttaggtttgcattaagctttcctagcatttgtggattttatgtagctgtctgtgtgggttagttatcttttctttgtcccttgaactaagtcagcagcataggaaatatgtgtgtgtggttggggagcaggtgtgggaaagtggcaagtgagagggtataaatggatctgcccaaatagctctgctgggaaatcactgtaaagcacgtttgctttcttttaaaaaacattttatttcagtcattgttggggtacaggtggtttttggttacatggaaaagttctttagtgttgattgctgagattttggtgcacccatcacctacagtgtacactatgatcaatatgtagtctttactccctcactcccaccccaacattccactcaagtccccaaagtccattatatcattcttctgcctttgtgtcctcatagcttagcttccacttataagtgagagcatatgatatttggtttttcattcctgagttacttcatttagaataatggcctccagctccattcaagttgctttgaaagacattatttcattcattttcatggctgagtagcattccatgctgtatatataccacattttctttatcctctcgttggttgatgggccctcaggttggttccacatctttgcaattgtgaattgtgctgctatgaacatgcttatgcatgtgtctttttcatattatttcttttcctttgggtagatactcagtgatgggattgctggattgaatggtagttctattttcagttctttaaggaatctccatactgttttccatggtggctgtgctaatttatattcccacccatagtgtaaaagcagtttgaagcagttttactctctaagtgaaaaacatccttattaaacatctaaaagcccaagttcaaatctcctttgttgataaagacaggaatataaaaatattaaacatgaatagcatcatttacattttgaaaacccagaatgaaaaaagtgacaataatctgctttatcagctgcatatttaaaactaatcattgcttcttcttgttcaagctaaaggtaaatcctggcagagaagaagagttagtagtaactcttagtaccagttcatatatatatatataattttgaaggctaattgtttgtataataagagatttcttataggtataggagggagggagattgcgtatttctcaccttatataastttttcatgaaggtttgtttaaaaaaattaaacaacttgcaattgcttaaaacctgtgtttgctgtggtgctatcagtgaggaaagagtatgtgagctaagagacagagagggcagcaatttacaaatacacaagaatctctgctactaaggacgtggtcagaggtggcatattggtttcttaattttttgagtttggggaggagccaagatggccgaataggaacagctccggtctacagctcccagcgtgagcgagcgacgcagaagacgggtgatttctgcatttccatctgaggtaccgggttcatctcactagggagtgccagacagtgggcgcaggtcagtgagtgctcgcactgtgcgtgagccgaagcagggcgaggcattgcctcacttgggaagcgcaaggggtcagagagttacctttccgactcaaagaaaggggtgacggacgcacctggaaaatcgggtcactccctcccgaatattgcgcttttctgaccggcttaaaaaacggcgcaccacgagattatatcctgcacctggctcggagggtcctacgcccacggagtctcgctgattgctagcacagcagtctgagatcaaactgcaaggcggcagcgaggctgggggaggggcgcccgccattgcccaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaagagtagataaaaccacaaagatggggaaaaaacagaacagaaaaactggaaactctaaaacgcagagcgcctctcctcctccaaaggaacgcagttcctcaccagcaacggaataaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaagtatgggactatgtgaaaagaccaaatctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagacagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagcttctgaaggaagcgctaaacatggaaagcaacaaccggtaccagccactgcaaaatcatgcccaaatgtaaagaccatcgagactaggaagaaactgcatcaactaacgagcaagctaacatcataatgacaggatcaaattcacacataacaatattaactttaaatgtaaatggacttaatgctccaattaaaaggcacagactggcaaattggataaagagtcaagacccatcagtgtgctgtattcaggaaacccaactcacgtgcagagacacacataggctcaaaataaaaggatggtggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggaacacccagattcataaagcaagtcctgagtgacctacaaagagacttagactcccacacattaataatgggagactttaacaccccactgtcaacattagacagatcaacgagacagaaagtcaacagggatatcaaggaattgaactcagctctgcaccaagcggacctaattgacatctacagagctctccaccccaaaccaacagaatatacatttttttcagcaccacaccacacctattccaaaattgaccacatacttggaagtaaagctctcctcagcaaatgtaaaagaacagacattataacaaactatctttcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagaggggaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagacacaataaaaaatgataaaggggatatcaccaccgatcccacagaaatacaaactaccatcaaagaatactacaaacacctctacgcaaataaactagaaaatctagaagaaatggataaattcctcgacacatacaatctcccaagactaaaccaggaagaagttgaatctctgaatagaccaataacaggagctgaaattgtggcgataatcaatagtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccagggagagacacaaccaaaaaagagaattttagaccaatatccttgatgaatattgatgcaaaaatcctcaataaactactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaagtaggaaaagaggaagtcaaattgtccctgtttgcagacgacatgattgtatatctagaaaaccccagtgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattagccgggcatggtggcaggcacctgtagtcccagctactcgggaggctgaggcaggagaatggcatgaacccaggaggcagagcttgcagtgagccgagtttgtgccactgcactccagcctgggcaacagagggagactccatctcaaaaaaaaaaaaaaaaaaaattaatgaagtactgatacagggtacaacaaggatgaagcttgaaaacatgctaagagagaaatcagaaagaaaagatcacatttcatgattcagtttaaccatttcaaagtgtataattcagtggcattaattacatttacaatgttgcacaaataataccatctcattccagaattttttttaatccccccaaccataaacctcatacctattctcccttctttccaggccttggcaactacagagtttttggtgtgtttttgttttgcttttttgagatgatgaaatgttttaaaattgattgtggtgacagttgcacaactctgtaaacatactaaaatccattgaattgtatactttaaattggtgaattgtgtggtatatgcattaaatctcaataaagctgttacaaaaaaaagaaagaaaaaaaatttttttgagtttggaatgtatgaaacttaggccttataataattgctaacagaacagtcttataattcatgacattccgtgttcgattgtcaggtttttttctttttgttttgttttgttttgttttgttttgagacggagtctcgcrttgtcgcccgggctggagtgcaatggcgccatctcggctcactgcaacctccgcctcccgggttcaagcaattctcctgcctcagcctcccaagtagctgggattacaggcacccgccaccatgcccaggtaactttttgtatttttagtagagagagggtttcactttgttggctaggcttgtctcaaactcctgacctcgtgatccgcccgcctcggcctcctaaagtgctgggattacaggcgtgagccgccgcacctggcctcaattgtcagtttttaagacagttgacaggcgatatcttttcttcatcttttgtttagtgttagaaaatgtaagtgttataatcagcgtgggagtgacaggaatctactttaactgaattttttttctttgacagaaactatacaaggaaaactatgaaaagacaaaagcaaagagcataaattactgcgagacccccaaattcaagctcgatactgttctgcagaacttcagtagtgatgtaagcaatcctwctgtcactctttctgttaaaaaaagaacccattatttcaccaattaataaatgaagtatgttttgtcttgcagaaaaaatataaagattcctacttaaaagatattttgggacattatgtaggcagcttcgaggatccataccattcacactgcatgaaagtcacagctcaaaacagtgatgtaagttctaagacaattgtttgactttccaaataacatttttctcagggcatgaatacaatggctgcatcttatgcctaatttcttctcctcatagaaaaactacaaagcagaatacgaagaagacagaggcaaaggcttcttccctcagaccataactcaagaatatgaagcaattaagaaactagatcagtgtaaagacgtaagtctgtagtctgaactttgaatgtgactgccttccatagcatctagtggtcaggatatgtttaaaatgttgccacttttacaaataaatgtaagccaggcaatcgcaagaaatgaagtctattttgtagtaaacatcctattttcccttgttgacatccctacattttaagaggtaattctagctcattttcccaaagaagagttattggaaacccgaagatataggaaagtttctcatacagatataagagcacctctcaaactacagtctagttagaaaaaaatatattttattaactacaagtttcattgctttgtggggcatgaggttctatttgcttggcctgtgggccaccttggatctgacaggtgatactactaaaccaaatgcctttgcttccccacagcacacctacaaagtccatccagataagacaaaattcacccaagttacagactctcctgttctgctacaagcccaagtcaattccaaacaactgagtgacgtaagttcctctaactactcaggacacccaattatgagggataacatttcataactctatacataaaatccaatgacttatcaagtttattcaaaaggctaagtaagtattagcaagtttaaacagtatacatttgtataaaaatatatttctgcattttcttgggtggataaaatttacagtgaaacaattctgtgaaggaaacaaatgtagcttaaagcaatggaaagaacatgagttctagagtcaaacaaaaccgcattcaaatgttagctctgtcattgatgtctgggtggccaaagatttaacccccctctgcctgatatttccattttataatttgtggctgttttgaagagtaagtgaaggaagaaatatgcactgcacataccctggccaacagcaggtattcagtacatgaatttctctctccctagtaagtttctggaaattggaatctctgagacaaattttattatatgagctttaagtgtggatttccaaagctgtgttgaactaaaaaaataaaagtgacctcaatagatgaatggccagaaatgaaggctccaattagagcatcaaaagccctgatgtctgtgagaggactcttaatcagatgaaaggaaagtggctctggtacgtgagcactgacagtgacaagagagacagggcggggcccctctcagaacctgcagggacaattgtgctacgcagggaggggaacatgtttgacagagccacctcattcccttagggtcctaccatggtgacagatgtgataatagctgccaagtgtcctgcacacaggwtcagtaatgcagatggcctacccaagctctagatgtctcttctgatctcaataatgctgtcactaactttacaaaatgtaccacacaagaatttttgtattctggaacaattcttctgaactaattggttctctctctgtcatagttaaattacaaagcaaaacatgaaagtgaaaagttcaagtgccatatcccccctgatactcctgcttttatccagcacaaagtcaatgcctataacttgagtgatgtaagttccttatgccctgtaccatgtgangtactgacaacctgtgcttttatgtttgaactrctttgttgcaattcaatgaatagattaatgttaaaaatgagaagaactgttaacatttgtatcatgttgctatgcctctgccagtataactgaattcaccttacaaaatatgtgtagcaatcttataagtaatttcatacaattagataatcgtaatatatagtattgtaaccagccctcagaatgctacgtctcatgtatgcttaattgcaaattttaatggtagatcttttagccatatattcatttaaattatatataattcatttattccctgggcctataatgtcccttatttcacacaaatgatacttatttctacatatatgagaacttgcatgaataaagatataggggattgaaagggcagaagtccagatacccatttctatccttcatttttcaaacttaattttatagaaaagttaaattatccttggggttctcaatttcttcaataattctataaatgagtactaagattatctggcatcactgagtattgtaatgatttatgaaataacctttgcagagaacttaaaggtcaaatgaaagtgatgcctttatatcataaaaaagtaagttaactgtagaatatatgtgctactctataaaacattcagtgttaggaatcaaatatgagtataatagctagaattaaattaatttgataaaaaattctcatggggagtagagaagcccaatcttggagaattaatagctccagcttgagaagaaatatttaaaatatgcatgatttcctagacaataaaaagggcccatttattttatattaagataaggtatttagttacccaytagtctttaaaggtcgtgacatgcatatcacttttgccaattcctttgctgaatttttttgtccagaatctttataagcaagactgggagaagagcaaagccaaaaagtttgacattaaagtggatgccattcccctgctggcagccaaagccaacaccaagaacaccagcgatgtgagtgtggcctggggacctggacaggctggcttcggggacatttcctcttgagtggaatctggcatgtgtgatgtctttgcaggtgatgtacaagaaagactatgaaaaaaacaaagggaaaatgattggagtcctcagcattaatgacgatcccaagatgctgcactccttgaaggtggccaaaaaccagagtgatgtgagtttctttgtaattcacccctattttcagacgtggccacaaagttgctgtttaatataaccttggatggacgttagcctaactgaaatcttggattcaagatgacraatcacacatgaaagcttcacccaggtgctaaaggaagatgaacttccttattcttgttgatgcctttgatgccagtgaatactgcaaattttccttaatctccttaatgccctctgttttattaggaggaaaaatattctgccaatatcattgtttttattatttttcctagaaacgagcttaatatacataagtataggtacatgtgcatgtatatattcacccaatgccctgaactgattaaggtagtttgcaaaaatatatatataggaaaatgaaaagaagtaaagaaattaatktaagggcaaagtaagaaaaactacataaggcataaactcaaaagcaaagcattttattttaagaaatttatagaatattgatcttattttaaagactttaacatacttattaaaaataaaatatgacccagcaatcccattactgggcatatacccaaaggaatataaatcattctattataaatatatatgaacacatatattcattgcagcactattcacaatagcaaagacaaggaatcaacaacgatagattgkataaagaaaatgtggtacagatagaccatggaatactgtgcagccataaaatggaatcagatcatgtcctttgcagggacatggatggagctggaagccattatcctcagcaaactaacgcaggaacagaaaatcaaatacctcatgttcttacttacaagtgggagttgaatgttgagaacacatggatacatggggggtgcaacacacactgttggaggctgggggtgggggaggcgggagaacatcaggaagaatagctaatggatactgggcttaattcctaggtgacaggatgatctgtgcagcaaaccaccatggcacacgcttccctatgtaacaaacccacaatcctgcacatgtacacctgaacttaaaataaaagttggaaatcaaacaaaaaaataaaaaataagataaaactcttcacagaaattgctttcctaattcctagcagaaaagaaatacagacaagtaatattttcatttattattgctctaaagaaaactgttaggtcttaatgttaatagccagcttccggaggtgttacaaaatgcgttttcaccaagtgctcaacagaatactcttccaggactgtgcttaattatctaaggttcaccttataccctttacctcattttgcatcaattcttaaactcatttttctttccttctttgttttttgagacaggctctcgctctgtcatccaggctggggtgcagtgtcacgatctcggctcactgtaatctctgcctcccaggttcaagcaattctcctgcctcagcctcccaagtagctgggattacagacatgtgccatcacgcccngctaatttttgtattttyagtagagacggggttttaccacattggccaggctggtgttgaactcctggccttgagtgatctgcccaccttggcttcccaaagtgctgtgatgacaggtgtgagcccctgcacctagcgaaactcatttttctttaaacatattcaaatgaattactttaagacaaaaaattatttaaaaaaagacagcattggtgtgcgtttttcagtctgaaaaaatattaggaaaagtaacataaacatcttcatgattattagcagatgagattatataaggcatgagcctctaccacatctattctgcttttctgctttgtggaaaattgatggtgagaaaacataaattttgccccttcagttaaagtgcagcaaagacatgaatgacttttactttatgagatatatatttctttctttttggtttaatttatttttcctttaacagagattatacaaggaaaactatgagaagacaaaggcaaagagtatgaattactgtgagaccccaaaatatcaacttgatactcagctgaagaacttcagtgaggttcgaaaagccacggttacctttcgggtaggagggctttcctactgtttgacaaatgattgttaacttgaattacatttgttttatttttcaggctagatataaagacttatatgtaaaggatgttttgggacattatgtaggcagcatggaggacccatatcacacacactgcatgaaagttgcagctcaaaacagtgatgtaagtttgaagacaatggttcatgcctcacagtgacattgtttgagagccrtaacaatcatgatctatttttggtttttctcattatagaaaagttacaaagcagaatatgaagaagataaaggaaaatgctatttccctcagacaataacacaagaatatgaagcaatcaagaagctggaccagtgtaaagatgtaagttagctgccctgaattattgaaattgagcttgggattcctgtgacatctagtggtaaatttagcaggagtttacatgctaatatctagtgattagaaggagataattacattttacattttggttttggggtggaaccggggaacacaacaattatgttgaggaaggccatttgctacaaaatttcagatttttataaatcttaattttcattagtttatatctacacgaatttggggcaaaagaaggacatgcagatttaagataagtgttcattatttaacaaattctatgtgagaagccatgctgggccaggcactttccttggtgctgagaaagacagagaaaaagccagccacctcttgagctcccactggagtggaggagacaagtaataaacaaaggaaggagcacagaaataagaaagatatcaagcaataataaggaaactaatacaggatgatgatacagaattaaaataggacaatgtgtgagacagtgactggatgggcgtcttaggttgggtggtcaaggaaggtctaaaacaggcatgaccagtcaggccaaggtcaggggaacagcagcagggaagaacggcctaaggagagaacaagctcagcatttaaggaattgaaaggatggggtggctgaaatttactggggaggaagacagtagtaagaggtgaaatggttggagatgaaggaggggatggattctgtagggatcataagccaacgtgcagttgaagctgagtaccaagttgactaaagagtcactgtgtaaggcttcagcagggtaaggttaatctggttgctgagttgctgtaggcagaccagaggcaacttgggaagtggggattaaaggaaaaagagagagagagagagagacagacagagaagtgagaatataaacgcatcaactaagttttcaggaacaaaataaactctgttttgacctggaaccattttttatgttagcgcatgtataaccaagaatatactgatatttcattaaagaacatcttcttttctagcatacctacaaagttcatccagataagaccaaattcacggcagtcactgattctcctgtactgttgcaagcccagctcaacacgaaacagcttagtgatgtaagtgctttgatttatgcaagcgtgggtgacccagagtgctttgctcatttaaaatgtaagcatttacatgcttaatcttcatgggctcatctaccatcccaatattattatttttcaagatttgtttaataaaacacaaatgaggctgctagattgaattgcagcctgaggaaagttgtgttagacaataataaaaataaatattttttaataactcactgatttttagtaggactatcttacttattcattaggatctgtcacatgcacactaaaacttcatgccaacttaaataaacagtgacaacaaaagcatctatttgtgtaggacaaggcaaatatttccgattcttgaatttgctaacaaagattttgcaaaaagaaagggcacagtaacaagacagacatcaaacagtgataagaaaactaatatagaatggtgctacagaattaaagtgggatgacatcaagaactggatgggcactttagattgagtggtcaaagaaagtctaagacaggcgtggtccagtcatgccaagatcgggggaaaacagcagtgcttctcagacctccacattcatgcaatcgcctgctgaccctgttgaagtgcagattctaattcagtagatctaggggactccatattctgactttctaataagctcctaggtgatgctgatgctgtgattggtaggctactctttgaacagcaaggtgctaacatagctaagtcctagagagtagtacatccttctcaagataggtaagtgaaagatacagtttgtcctactataaaatatattttaatgacacaaattagctcatacccaattagtaaagaggagaatggcatcagtataactcagaagtcatttcagctcgtgtgccacttttctgagcatcttaatattttgtgtcccaataaagaacagctaaacactaacatcactgatctagctgaactcagcaagctgcagagaaatacagtgctgtatgtggtcacagtcactatcaatcactcttcttattggcttaggtgggcaatggactctgccttggaattacttcttgcatagttctcaatcttgtgcrtttttgcctttggctccaaaattaaacagcctcatccgttctttacactcccttccttacacctaacgtcaccttttaaaaaatttaaataaagttctgtgtttaataatttaaataagaattcacaggcaggtgcagtggctcatgcctgtgatcccagcactttgggaggctgaggcaggcagatcagttgagcctaggagtttgaaactagcctgggcaacatggtaaaccccatctctacaaaaaaataaaaaaattagctgggtatggtggcacatgcctgtagtctcagctactgaggaggctgaggtgggaggatcacttgagcctgggaggcggaggttgcagtgagccgagattgtgtcactgtactccagcctgggtgatggagccagacacggtctcaaaaaaaaaaaaaaaaaaaaaaaagagtatatatctttttaactgtgctagtattttatttagaattattgttgtttttgttagtgctttaattacagaagttcgtgttctccagacacaacctagcagtatagactggaaatgtgttcctgtgtatataacagaatctatgcaatggcagctggcagcccaaagtatggttacacagcaatcccccttatccacggttttgctttccataatttcagttacctgcagtcaaccatggcctgaaaatatgaagtggaagattccagaaacaaacaattcataagtcttaaattgcatgttgttctgagtagcatgatgaaatctcacaccatccccctttgtcccttctttatcaagatgaagggtgaaaacatacagtaagatattttgagagacagaaaccacatccacataacttttattacagttttgttataatttttctatttattagttattgttgttaatctcttactgtgcctaatatataaattaaactttatcacaggtatatatgtataggaaagaacatggtatgtatagggttcagtgccatctatgatttcaggcagctactgggggtcttgaaaagtatcccccaaggacaaaggaggactgtgccacagtccctgaaataggggatgaaagtttgaatcctgtgcgagactttgactgaattgagtatctctttgaggcatttttctaaaaacagcactaatgccttagctatatatgctgccctaaataaattcaaagaagttcccctgaaccgttcaaatatcctttgtttttcagctgaattacaaagcaaaacatgaaggtgagaagttcaagtgccatataccagcagatgctccacagtttatccaacacagagtcaatgcctataatctgagtgatgtaagtaccaaagccacagaagcctatgtttggtgtacatgaaaagagaaaatgttttaaattttaaaagacaagacaaggaattgtgcaaataaacaactttaagatggttactttgtaagtggagcttttaaggccaaaatgctcttaagactcctacttatctatcagatttcattttctgtggtctctgttactatcagaagatctccaattacccgtctactattccctggagttttacaacatctttcccatgtaaatttcacatttcaccttctccaagtgagtgtcactttatagcatccttatgtaaatcaggacagcagagtgcttagaaagtttacagaacattaaaaagagtagttgatacttatttagtggtagggagaaagaaactggatgatagataaatcaatacttatactacaatttgataaatatagtttttataggagaaataagtctatacatacacaaattttcaatatgtttttatttttttactggattacactgttgttcttatcattcctttgctgaatttttcttgtccagaatgtttataagcaagactgggagaagagcaaagccaagaagtttgacattaaagtggacgccattcccctgttggcagccaaagccaacaccaagaacaccagcgatgtgagtgtggcctggggacctggggacctggacagggtggccttggggacatttcctggtgagtgggatctggcatgtgtgatgtctttgcaggtgatgtacaagaaagactatgaaaagagcaaagggaaaatgattggagccctcagcattaatgacgatccaaagatgctgcactccttgaagacagccaaaaaccagagtgatgtgagtgtctttgtgaatctgtcttgttttcaagatggactccctgttacgatgcccaagggtagtagtgtggaaaagaatttcatgagcatgggctctttcacatcacattcacaaaagtactgctgtagagaacttcagaatgatgccctggattattgtgcctcccacatttgaggggagaaattactgatttgtacttgatgtccatttcactttgaaaaatgtatgcattaatatttaatagaatattgattgtattcttaaaaccttttggaaaacatcactagatattttcatattttcttctaattgaaaaataatttttaaaatgataattttcaaactgtctttactttggaagacatttatgagtcacaaaaatcttaatagagtatcgttcttcattgactttagtaatgagtttggtctagatccaagaaaaagactccattgattataaacccccctgagactctgataaaagatttgaatcatctatctagaaaatgaacatttcttttcatgccttttgcctgaattttggtgaactcatgggttgcttaaggctcatctatgggccatgtaacattttgcagttaaaattcttactacagagagacaaacatctactactgcaaattatagtatatattgtgtataaaatgtttagagaatcccttaagagtactgagaatgttcagtgtagcttgcagatactagtttttttaatgatgaaagagaagggtatttgtatcatttagatttaaccatgcttttatataatgatctatacatacctctttaattcattttgcatctattctgtcattacatagcactttaaaacttctaattctgtaattttctctagtaacttcacagtgaattatgtcagtatatagtgctcacttatattactatcttgttcactagttgagtcttttcaactcaagaaggatataactccccattgatagcatgtgtatttttatcttttgtttttattcctatcacagaacccagcagtaggcacataataaatgcctaataaatatttgttaattgattgatgtagatgaccaaaacacatagcaaatgagtcattctcacataatatccaggcaaaatgctaagctgcagacacagaatatgaatggctttttaaaaagaatcttttaaagccatttggatctttgacaacattttatatgtactggtatgtgtcagctggtgtgaacatgaacaaaacagtaacaacaatttcttcaaaaatacttccacacacctattgctgttgcaatattgctttatcagtttatttctaacgaagacaaactgttgttttcaatgttgttgcaaactatcacaaagtttgcatactttatttttataaaccagggtctcaattttatagttaaataataaatgtattcagtgaaaatgatcacccacaaaatatgagaaggaagatcaagttcccttagaaagccaaaagatcagatcatttgcaaaaggaattgttacagaagatttgtagtgcacatctgtacttgccagcttgggtcaccgtctctaacacatatgtgaccatgggaaactaggatgagtttagagttttctgaaaggcagtgggtcaamatttttctgtcaaagtaattggtgagtggatacaatgaagctgggaatttgacccaactagcaccttgtctaaccattccagaaaaccagacaatgaagggagtccttgaggcccagccaggacatttggtttataatgctgtacggaagggccaacgttattttaatggctcagtttctcaaacttttctcctgtgaagtcttttaactgctgcaatctgaagcttcttttaaattgttgccccaattgaacttgatatgaaaacaacctttgagattctcagtggggttatctcctgtcaataacaggttaaaaaaccagttgactatccattcaaaaatgactctatacagccaataaactaagtctacagccctgtgtatgaagtagtcattttattaaaatccaattgtcatatggttttcattacaattaaaaaatgcttctttactgaaaactcttcataggttaaattacatgaataatagtaacacttgttagtggtccttgagaaaccctggtttagaataaaatcattcctgttcctgactgaagcagaagctgtggcccgctgtctgctgtgacccagacagtttctcattgatttgagaaggtctgcccatgcgtgctttttgggggaatttcaatggtatgtaacatatgaacacatttttgggcaaaataactactcagatgtttgactctttctctaacttgtatttattgtttatgaaagatctctgtcttttctggaaatccatcgaggatttgtgataataaatgataatttcctattcacagcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgtgagtaaccagggtttctgtagcccctcttttaaaaagatggaaactgaaatggactttgaagttgagtgaggtttttgcacttcttagaggtatctgcattgtcctatgtatgtaagcaaacgacccttgtggttctataagagcatgcccttcanggttaggaagaactgatctggcttgcaccctatcactgtttccctctgggaaatatntcaaccttgctaagtttagagtcctcctctgtaaaatggaaataaatcaaaaacattgtttggaggatgtaaatgcatgcaaaatacttagcatggtgccaggccctggtgagttctcaataaacattcagtatttatcatcgctattatcataatcatcacattcatcattatcaatgatttttacatagattactatctgaaaagaaaatatatgatttaacataaatatttataacgnttttttctgcagatcagaacttctttaagcaaattcatttgtccaaaccacacaactgaatacttcatcctaacaattctattttttaaaatgtgacaaaatacatataacataaatttaccacctttgcaattttcaagtgtacagttcagtggtgttaagtatattaacattgttgtacaaccaatctgcagagccttttcatcttcccagactgaaattctgtattcattaaacagcaactcccattttccttcttcccctagcttgtggcaaccaccaatctacgctttgtttctaagtttgactaaccctagatacctcatatatgtaaagtcatacagtatttgtctctttgtgattggcttatttcacttagcaaaatgtcctcaaggtccacccatgttgtagcatgtatcagaatttccttcatttttaagggtgaataatattctattgtatcgatatgccatattttattcacccattcatctgttggtagacatttgggttgcttccacctttaagctattttgaataatgctgctatgaatatgggcatgtgaatatctctttgagatcctgctttcgattcttttgggtataaacccgaagttgaatagttggatcacatggtagctctattttttatttgtagaggaaccaccatactgttttctgcagcagctgcaaaattttacattcctaccactaacaattctatattatacattgttattctacttgttattagtttgattttgttatgttttttcatctcaaatagatcataagcctctgacaggcaggaactaaatgctttcttgattttccattctacttaaaatgcccagagtaaaaaacaacagtttgaattttgtatctaaaacgtaaatttttggtaccacctatggtcagacaayaagagtagcattttaatagcgtcaagtaactgtgcctcaactaggaccaattccaaataataaccgccctcttatgcaaattaacgagtgcaactgttttaaagtgttttgttagccaatgtagaaacactccaaagttgaccagtacacatgaagggccatgtgtgcaaatacttagtacgaatagttctattaagtcttatacaattaggaaattagaaaatgagcaaataacccaccttcaatgtggccttctattttaatttgatagaaacataatacttaaagttccagggaacaaacgtctcacatttggttaactgacaatttcacttactctttgaagtgcagctttgactcgagcattttccaggttggaattagagtaccacagacttccattaagttggaaataaggatgaaatggaacataacrccagttagaaggaaagcaaaaatcgaagagctgttactatatctcaccaaagaaatatataaaataaccttaatgtctggagtaaggaagctggtcagaaatctcaaaaacattgttttgggtaaaactttgatgattttacataatgaggatgacacagcaaagaaatgtaacctttctcttggtgttttaggttgaatacaaagctgactacaatagctggatgaaaggttgtggctgggtgccttttgggtccttagaaatggaaaaggcaaagcgagcttcagacatcctcaatgaggtaaagccactgggtgtgtcagagggagagtggtgactgtgttgtgttaaagctctcaaaagcatgggcagtgctccttcattgcttcattctcagtcactgttgctgaggaaaagagcttaccacgtgcacaaattacccagggagaccagcacaaacctttatattaccaaaatcatttatgttaaccattccttacagaaatatttttaacaattttattaaggtataacttgttaaccatttacgttaaccattcatttatgttagccattcattatagaaatatttttaacaattttattaaggtataacttgcatacaataaaagtaactcacattaagtgtacactttgacaagttttaataaattcatataattgtgcagtcatcactgcaattgaattttaaaatgctgcaataccccaaaaagtttccccccaaaatttcagctctcatcttcagccccaggcaaccactgatttgcattctgtctctaaagttttatcttttctagaaatttattttgtatctggcttctttcacttcatgtaatgtttctgcttgtaatttggtttttaaaaattattaagtaaatcttttgtatggatttattaggttggtacaaaagtaattgcagttttgacattaaaagtaatggcaagaaccacagttacttttgccccagcataatacacaccacattgttattattgcttcaccggttgggggatatgtggatggtttctatttttttgtgattatgaataatgcagttattatagaaatcgtctttgaagaattattccatatgtcatattctggttggctttgaagtaatgtataaattataattcagtgtaagaaaaaatagtgatgatcttgaggctcataaggcagcaagattatctgtccctcccctgtgacagttgaagagtctcactgctgtcaggtgagtacatcctcaaggagggcagactacacaaaggacagaggtgtggtatgagggttgtcttccacgctcaagttttacttcttgttcggtgttttgttttcgatgaaaaccattttgtctgctcaaagatcttccagaagaaagttctgggttagtggtttttagaagtctgaagccgaaagagtgatgatgctaactgggatgtacaacatgcacaaaggaagaggactgggaaaataaatagagacgcgtacaggaataaggtagctagaagttgccagctcctagtgggcacacctacccagggtctcctctgcagtgccccttcagcgttttggtgataacttacgtactaaccacattaagacttgcagagcaaaagtcctgtctctcttaataattcctagctgttggcctagttcctcaattcctccttcctcaaccggacagcttcttgatgccatttgctgatggagtaacagggaaaaagagaacttgtttgtgccatgcaaaggcactccaatctccttgcttgcttttctgttaaacctttagaaaactctgtgatgtttccagattctgcttagctgagggtgtcttgtttcatgtcataggcaagaaattaagaaaggagtctgtctggttcctgagagcagtatatgtgtctgtgctgtcccaaactatccacaattaaatggatttttaaagatattgacttttgtattgcattcatcaagccaatcaagaatctagtgtttttgcattttaaaatcatgaaaaactcttccttttcgcttcaaaataaatttcaaggattttgacgtattaatcttcagtggaaaacaagattgtttttctctttttgatttrccaaacagaaaaaatatcgccaacatccagacaccctcaagtttacctcgattgaagatgctccaattacagtacagtctaaaattaaccaggcccagaggagtgatgtaagtgttaatgctatctatatgttaatagatgttaactaatacaaatacatttgtatttcaaatgtactgatcacctctagttattatacaatatgaagagacccaattacacaagcatctgtagaattccccagctgttcattaataaagcatgcctaattcatatatttacagtaatgtatattgtgctgactgtccttttagccatttgacatttctttctaaggaaaaggtaagagggacttctcttaatgacaacaaaaactacaagcctttttctaggaaagaccagaaagaatgagtatatcaaatggggagcagttatattttaagtcagtgcaaaaaaaaaaaaatcatatataatcaaaaccatccctaagtccttttaattgcccacaaaatataatataggtggttggtgtattccaccctattacactttcctgagctaggcccagaggttcctactgcaagttccaagggatctttgcaaaactgaataagcactgagacagtatcctaagcaactgcatgtgtgaccttgaatgcctacagatatttgcacatgaatatgcaaatgcacaaagagtgtccttcctaaaaccacctctgtgaaatatgatccattaggaaatwattttctggtgccattaaattttctttctactttatttgtttgtttatgcatttttttctctttcagatcgcttacaaagccaaaggagaggaaattattcacaawtacaacctgccaccagacctgccccagttcatccaggctaaagttaatgcctacaatatcagtgaggtgcrtgggtggactcacgggctgatgcgtatgtccagactttactaacacagtctctaagttgtacttaaatgacatttttctttcagaatatgtacaaagcagacttgaaagacttgagcaagaagggatatgacctgagaactgatgcgmttcccatcagagctgccaaagctgccaggcaggcggcgagtgacgtaagtccagctgtggtcatacatgggcaactagaaaatgtgggtggrtgggcttggggtctgacgatgacccaaaagtctccatgcatgcagtccccaattggaagcaaatctgattgaaaactatttaggaaataaagttccctaaatagatttaaattttctggagggaaaagatttgtataaccttctactgatcagttctaatcaagccccctcatttaaaattctcatgtatagttctacactaactcacattacttctcttgtggagatccagaagtgacttaccatttaagtcataatagcctcctgatggtaaaatgttatctcaaaactttattaatttatatgatttccttcttcccctttcctctccctttttccttcgttacttctgtagacaggtgaataggcctcaatttcaccacctgtaatagccagtctttgggttctattacagttaagaattttatttcttatcctatttatctttaaccaagatgtgaactgaagtcattttgctctttgagatttaaataaaattggctcaagcccccatctgttattctatagggagtggaatccccctccccatgatttctgtggagtctccgaggtttttgtttctctgcttacctctggctcctggctggcttgagctcatctgcgccctcctcctgcgggtctcctcttgctgctctgtatgacccagaaatgaaacacagccccttccttttgacttcccagagtcccaaacaccactttactgattgtttgaaattaggtttacatcgcaccagtgtaaatatgtgatgattgaataacaaatgtcctcgttctgaaatgcccctgtcccacccgaagttctcacccaccccctttctctgtgggtactttcctccagctgcccctgccccaactttccacgaaccttccctcatgtctctgcttctcagtgtcccacagtgccctccacatatctctgaggaagctcagtccccctcactttgttatccagagccagttagtgtttaccccctcctggctctgggtctccctttgaatatccaaggacttattaaattctactatcattnatattaacatcctaccactactactaaaaattctaaaactaattaaatatccagctacttgtactctagtagcacaatgtaattggtagagattgtgacatatttatcttttcatttttctctaccaatgtctaaatgcaaaggaagaatataaagatctgttttgtcactgatacaaattatggtaatgccccatctcaacctcacttggataggcagaaacagctatagacaatcaaatgggttccataatacataacatttttattttaagcaggctacatttcagagcatatgcaagtgaattgttaattgtttggttattgaagtacagtaatttttgggaagctcaattacttcaaatcatggcctcattgtttagtaaagccctcaaaactacattttaaattatgcccacctttgtttacaataggttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgatgtaagtgtcatttacttctcaagaaacccccctattaagttcagagcctgccatgaaaagaaccctgtcctaggccctcactcctcttttctccattgctgtagaacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatgtgagtacaataaaatagagaggacagaggatatggaggaagctttttagaaaagtaaacagcagcccaatatattttttttctgggccaatatctttccattttaaattattttgtttatttaattttttaaaaattacagttatgtgtagtttgggcactaacattttcttctctcttgctttttatcttcctttttaaaaacttttcctttttaactgtctttgaaatattgtgttattgaataaacttgacatggtgaaaaaattctattctaggactacacacatacacatgcaaacacatacatacacagaatttaagcttaaatcccagacactttattgtggcagatttgttgtattcaattctatgttaagtttctcatattttcttttcatatataagacattaatacagagaagtaatacatatgaatatacgtttttgctcctaagaattcagcatacacaattatcacagagactttttaacttacatctgattgaggtgtgtatcgtttgcctgcctgtccatgagcagcgtctatgctctggctaaagtcaaagtttctaaaggaaagtttggtatacagaagatcaaaagcattcactcgtttatttatttaatgaatgctttttgaacatttaccatgtgccaggcactgtattacctgctgatggcataaagatgaaatagatgaggattcatgggatatagaaattcacaagaatgtagggtaagagcataagacaaagacatggctacaaacagagcattgtcatccagagagacaaatgccgcaggagaggaaaatgttaaatacaagggaggtgccttgtacacaggtaactgcctaccagagtttcccaggcaagtgagagaagtgagcattcctggcaaaaggaacaatataacagcagtagaaaaggaatgaacaatataacagcagtaggaaaggaatgaaaaagtgtaaaagcaaaaggttcaggattgtaacctgattagtaagggactcgtatgctaatttttagagtctggatattagggggtaggtaagaagagatgttgaatatgtttaatcgatggagccgcattatcaggcttgtgttttaaaagacaatgctggccccaagtgtggagactttggaaagaggagagactggaggtgagaagatgaattagaaggctgtcaccgaaatccaaggaaggcttaattggactgaagctaaggcagtagcaatggcagagaaggagctgtgtagaaggtcgaattcatgaatctgtcattgcttagatattgttcttaaaggcaatgaggacttagaggtaactctttgggtcctagaagaaattatttattatttggggattaatttagctattagccatgtcagattttatcttgggtacatgcataccagtttacatgtcatattccatatagtcatgccttggaaataaggatatatatgagaaatgagaattatgagattgaaaatctacttgtgattctggctctattttagttttaggaactaagtaatatatttctaataccaggaggaggatgcagtaagatttctgcatcacatactttgacatctttcagtcaaaagtgtatataattctttaaagtaacaacatagggcaaatatgaaatagtgagccttttgagtatgctagattcatgtataagcacctctacattatgaggaaattattgtatgctttcactgatacaattataatttggaaagtttttagcagaagtgaaaaacttattctmwctagggmtaatactttctctctagggataaaaaaatagaaactaacaaaaatggaagagctattaactcacaggcaaataataaattgatttggctttggtgaattctattattcttgctagggtttcatggttgaatttaccttccattcatcttgggcagtgaacaatttctattttcttaaggattttttctccttctattttaacacacaagacttgttggtattaaagataataagatgcttgttttatttaaaaaaataggaaaatkcctttgatgatttttaacactagaaaatcatgggtgattgtgctaaaaataactctttaaagcaaacaattaatagattttcctttttgcactatgtgaaatgcattttattgcagatcttatacaaggctaaaggagaagatgtgaaacataaatacaccatgagtmctgatcttcctcagtttctccaggccaagtgcaatgcttacaatataagtgacgtaagtagggtctttgctgkgatgtgaaattcggacctgacaataaaattatagactttaagagtaggatggtgccttgacaatttatttaggcccatttctcacaaatcccctactggaacatatcccataaggatggttctttacctcttcagttggccttttcaaatgtaggacaattttaaaggacataacattcttctctatttaggggatggtagagctcaccatctattcccctaaaacttctacttggttttcctagttttgcatgtgggggaggttattatcctccagaaacataagaataaatgagctcccttttaaaataacaacsctaaaatttctaaagctgaccaccaggtcttctcttgacattcctttcatgagaatgaacaacttcattgtctctagttggtcctcacataccatggtttccagaacctttatttgtttttctctggatccagtctttcaatattcctctcttcaatatgtgtcaaaaccagatgtaggtgaataattagtgcagagtccaatgatctcatgctacacacagtgtgacactttgccaatgtgatttcctaaagcagtatgtgctatgagggattccttcaacttctgtctggaaaagaacaaaacaatcccagcagttgaggaatcacttacagatgctgacattctgtttgcttttctgtccaggtctgttataaacgggattggnatgacttaatagccaagggcaacaatgtgctgggcgatgctattcccatcactgcagccaaggcatcgagaaacattgccagtgatgtgagtacaaattttaggtgaagtttaggtgtttgcctttttgaaaagtaatcaaatgcttgtttaaattgataccttattgaaagaaatatgttaaattaatggcatttaaattctcaaaatattgtttggaaaaacctgtcacttttagaaacatttttgtggttcttttcagttgaccccacttggtagagctgtcataaatctgacagtggctttctcctttgattcatagcccaaattaccttcactgacacatttccctgacagcccacatttattttcagtgggaacaccctgactgacattaccacattaaattcaaatgactgcctgcattataattgtattaaaaagattgaaaagatgttatataaaatgtacagatttttataaaccaaagagggaaaagtccacttttttaggatataattttgattcatgtaaattgatgtccatttcctgtaacagaaaaagtatacacttctactcctttccatctttgaaaaacaaaattttggccgggcatggtggctcacgcctggccaaaatttcagaagagcggatcacgaggtcaggagatcgaatggtggcgggcacctgtagtcccagctgctagggaggctgaggcccgagaatggcgtgaacccgggaggcggagcttgcagtgagccgagattgcgccactgcactccagcctgggcgacagagggagactccatctcaaaaaaaaaaaaaaaaaagaaaaagaaaaatttttagaaagcatgcatgccctgcagagttcactgttacatgctatcccagggaataaaatcttggtttgagaaaagagaagaaagaaaccaaccaggtatacagaccacataggaaatagaggtgtaaaaactctgctactttccttgtaggaatgatactgaaaacatcttcctcggaggtctgcacacaatgcacatcactatgaaatacatttctagtctaagtagaaagtgaaagtctacagtataactttattctttttttttctttttttttttttagcacttacacagtgatttttcacatgttagaaattacttgacgatccttttgcctgctaaactcttatttatgaattaaggcttaaatagcaggagctgaaagtctgcagggtttaagtggatttgaattctcttgcataacagttgaggttctgacctgttacaagattgctccaatttatatcacattgctgattccagcagtgagagactttggacagcagaactttttccattaggtttttattgatgggaaaaccccacagcaggtccttactgtggctccttaatttatttgcagctgtttcagcagtgagcttggaaagcagctgctgataaaaggagtcagtgaaggcccagctatcctatagctggtactcatatttgtgatgtaaataacatattaaatcgaaacctatgaaaccctatgaaaccaagagatattggccttatatttagaatgtgtcatgttcatattaagtgtgaaaattcagtttgtttaaaataaagttccacatgcaaattatctgtaggagtcatagcaaagaaaataaactgatcttgaatttatcgtgacactcacttgtaactccaatatatgttttcactgaactttttggagggggttgtggtttgcattttttgtacactcttgagaaagtcacaaagctctgagtgtctttatatgtgaatgtaattgcagcgctaatgctatcaatgcctaggactttgctaacccaattctgcctccacagtataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacsaggaatgtcaatcaaattcagagtgatgtaagtatgtgtaacaacagacccagagatgtttgcacttaaaggatgatcacttctcgcttttattagacttcatactacagtcagctatttgacaaatgcactttagaataaacaaccattactgaaagactaccaaaggcatggtagacaagctgtttttgcctgctttctgtgcttatatcrtaattattgatgctgtctttattaacttatggataaaagataaaactatattccactaactatgagagccactttgattcacagcaagaggagatgggtattcctgatgggttggctgcaatggtgatagatacaaaatgcaaaaatagaagaattttctatccttcctgaatttgggaaaggtgttttttttttttcctttattaactcaaggtcacaatgtcatccatgtaaatctctgtaatgagtcatctaaaattaaccaggaaggttttgtgcttgcaacatgattcatggagagttgcatggaaaggtgtttaacattcagagcctctcctgctgcaggagccagatttctgttagaattgtcctctgtaaaggaaagaagtgttatacatttattggcactcgataaaaatattgctccccagatgagctcaagcatagcctaggtggacagtatggatgtaatttagttttgaagtcttcagtggaatcaaaaggaaagcccaatttattgtcaaaagtgacaaaatsctttttagcagcacccatagtgacctggattcccctctgtgttgcataatgcagtctaaagcatgatcatttctattttattaggcttcataatacagtaagtgacttgaaaaaaaatgctttaagataaacaaccattatagaaagtaccaatttattgtcaaaagtgacaaaattttttttagcagtacccatgaaaatatgtgacctagattcccttctgtgttgtataatgcactctaacaacagaacagcttcttcttattaccacactccagataagctctgtgacagacagtcagacatgagcatgctgaagagttgctattcatttcccttggatagaattgcagatcccagaaacatcccttgaatattctccagggtatcttctcatattagcttacccttttacagaatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgntgttggctcagcataacacaaagcagctaagtgatgtgagtgctttcctttcaaaatgatttgcccgtaaataaccacacgtgtctgagccgctcctccgtccttcttaattcaatgtgtgaggatgcatctatgttagcaaataaactgctttcataggtatgagagaaagggctgccttttgaggcaactgggatcttgaacatgggaaaaacagggagatgaaaatgggggactattccaaatttgctttgttttccaaatgtagagagcctgtgctattcataagcagatacgcattatacatatgaaataacattattactatcattatctgtggctctgtatgaattgcaaaacaagctatttattgctcttggttgcaatatttctacctagccacatagggaagaggcataatgtcctaatcccctcgcataatagctccatgttctgagaggcaatcttagaatgaggcctctagggaggagataagcagtttatttgcagtcatctgggatctcattctgagaccacgtctgtatggactcttacaccgtggactcataccacgtctgtatgtctcattctgagacacgtctgtatgtctcattctgagacacgtctgtatggactcttattctttctgtcagaagcgaattacaatgctcagggcctcacatgacttgttaattttagagttctgttaaaatgcctccaccagaaagagacgggtaagtaaaaagcaaagaaagactttttgtattttagccccagattttggaaggtggggaaatgctttgcttgccttggatttgaagatctatggattttagctcctgcccccacattatcacagatgtctaagggttaattctatcttaggagtaataactggtgtcaattctttttcttttgtactgagcgagatgtcacttctcatggtgtttttccagttagctaggcaaactgtacactcactatataaagtcttccacatcacaataaatgccatcaacatctacctcgttactcaagctggaaacttggcagtcacggttaacacctccctgtgtgaactcccacatgcagtacctctgctgagtcagcttcctaaatatctctcagccagtctgctctcaaatgccaccaaccctacttccagcttctgtatggctcgtgtggacaactgcaataacctgttatctggactccctgcctgaggtctcaaacaatcgcaagagcctgtcttaaaacacgaatcaaatcatgtccctcttatgtgtaaaacctcttaggaatttcttgaatgtgaagtgaaatctaaactcatcaacttgacaaaagaccctcttctctgtggcccttctgcaccttctgtctaatactgctccacccccacgtctacccaggcacattccagccctgtgacttggactgctttcatttcctcaaggtggccaggccatttccagcctcaggtcccgaangctcttcctctgcccctctctccaagtttgagtgtaaatgttacctctgcagagtggctttactgaccatccttgtttctttgctacaatgattccattgacaacacatcacaaattctagtgatagtttgtagtttacatgttttatgtctgtcctttctattggacagtaagctccaacaggacagatatgccttcctcacctctttaaacacagaacttaccaccctgcctggcccacagtgctgtccaataaatactggtagaatgggaacataaatgcatctaccagggcccctcccttatgacagagtaggtatttgtctcgtaawtggaaaacacaaatgatagccttccgttttaaaggagtctctgcttgatgaaatttatattatgtcagctaatgatatgtgcatgctgtctcctttgtttttagttgaactacaaggtagagggagagaaactgaagcacaagtatactattgaccctgaattgcctcagtttattcaagccaaagtcaacgccctcaacatgagtgatgtgagtatttggcccagtgctaatattgcgtatgcgggcctctcctttctggttctttgcaactcttgcyctgagaattgtagggggcgcaattcagtgtggaccctgagcctccacattaaacccttaaccatgcaacatgagcctagggggcggcaataaaattttgcttaatacaggcttttccagactatgggctgtggcttattagtgggttgtaaagtcagtcaagtaagttgtgtcccatttaaaaaaaaaatggaacatgagacagacaagattggaaaacacaagagtgcctagtctgtagtatggaaaacattgctttttacaacttttaattatttattaaaacatccaaaaaagtttagttttcttcacaaaatctttttttgtatgtaactagcctttctcttgagtggtctagacatctaattggtggtaatgtttaaatccactattatgaattgtttccttttttaaaaaaaggatattgataaatcctaatttaaaaacataataaaacttggataaaattgttaattttttaaaagatggcttattcattctttccaatgtttttaggctctgtttcatatccaactatacattcctgtgcttttgtttcattaaggggaaagatttttctaagtaatatttaagcattaagatcaattaaagctgagttgtactacatctggatttttagttttagtattcatatcttcctataagcttgaaatgcttcattacaagaaaygtttttccaaaagtattatatatttattatagaaaagttggaaaatatagaaaattatgacaaataaatgaaaaccttctgttatccaacagtcaaagcattacctttctgttgctttgttatgcaagcatatacattttttgatcagttgagattatactgtgtatacagtttactgatccttttaaataaaatcaattatatacataaaagacaaactaatagtcctaacttcatagattgtcttaatagaaagggatctattacgacatgttttataagaaacattttggcattctgtttcattcctcttttaatgatgtcaaataataaaataacctctacttttttgaaggctcattataaagcagattggaagaaaaccattgccaagggctatgatttgagaccagatgccatcccaattgttgctgcaaaaagttcaaggaatattgctagtgatgtaagtctaacttaaaagtaggaaactttctatctaaaagacttcaggagttcaagaccagcctgggcaacatagcaagaccctgtctctacagaaataaaaaaaaaaattagccagatgtggtggcgtgtacctgtagttccaactatttgagaggctgagatgggaggatctctttaacccaggagtttgaagctgcagtgagctgtgattgcactccagcctgggtgatagagtgagatcccatctctaaaaaagaaaaaaaaatctatatgtgatgtataagattgtatcaactacataaagaagcaagtaaagaaattataatataaaaatatttcctaaaatcctaattgccaattacgttatttatattgcctcacttaaaatatttttcacatatttaaaagcttaataaagttgttagaagaaaattcttttttaaaaactgtgacgtacttaaaactttcattagtatcattgttatgaacttaaaaaccactttttatttggattttgtcatgaaaaaagtcatgatatactaaaatatcactaaattagaaaagtctccaagtattttaaaataattcagtgttttaattttataatttccatgaagaaaaaaaatccatggaaatagaaatatggaaaaccagaaaaaatattttgctgattctttctggtttttcgtatttctatttccatggattatataacaggattttagttaattacataacaggattttagttaatttttttttttacaaattaagttatattcctatatgaattgacataataaatgccttgatagagaaaaaaggcattaatttcaagattaatacactaatttgtattagggctgaaatttactcatacaaatacgttttaaggtaatacaaattaataatggaaatatagtcataaaaaagcatacattgaccagacatggtggctcacacgtctaatcctagcactttgggaagctgaggagggagggccccagaggctgcagggagtcatgactgcaccattgcactctagcctgggggacagagcaagaccctgtctcaacaaaaaaaccaaaaaacaaaaaaagcgtacatcaaatgcttcataagccaacttctcaggaacctttgagtatattcaaataatctacttatgaagagtattaatataaactattccattattccatttttaatgatctccagggcaggtctcaagatgagccattaaaaatattttgctaattgtttattttaaaatacaaaaaaaaacttygatgttacctagattcagactgaagttggcttttgcttaatttgttgtataaattcagtttatatcagacttctatgctagccaacttctgtttgccctttgttttcaaatagtgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgatgtatgtactggttaccaagttgttatccatttctaatgggtgggaggraaaaacaggagccacttactccatcccacacctggctgcactcactgtaattaaggattccctccagaactcagagttttaggatttcactcatttgaactataggtggctttgttgttaattttatatatatgcatacaaatatatttaaaatgttggtattagacccaaacatatgatgttgtctatgaaaaattaggaggctcagatagatgttatataattttccttccagtgcaaaattctgttaatttttcatttattttcctcaagaaagttaacttgttaaaggaattgctgggtcaggatttcctgttcaaaaccactatgaatgcaattatttttataattaatttcttctgaaagactgtagggagtaaaaagcagattattctccccctcccagcttctctttttctttttgattgtaagtaaatcayatagccaaagaaacacaagccctgactctttctgaaatgaaattttttttctcattgtaaagaatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaaggtaaggactcacctgccagcctcgcccagggaaccctcatggtgttcatgacattgagcctggcagtgccccaatcgtctcctacagtgtttctttctgatcgtcttcgtgccggtggtgggagggggactctattgcttccattatgtttagagcgttctctttcatagtgacccctcagatcatctctcaacagcatgttaagaatgtgacagaaccacaaaactccacatggttgtgcggtgggggcaagatggtatttggtgctttggtggtagagggttgccgtattcaacaatttttttctyattgtgtatttagtttacttggcccatctttttgttatttcatccattttctaatatccatttaacctcttttaccatggagttgtaaatctcttcctcttgctagcattgggtcaaacttgtcctgctgtaaaatcatgcacctgactttctcattgcagaggctctacactgaaaaatggaacaaggacaagaccaccattcatgtcatgcctgacacaccggatattttactctccagagtaaaccaaatcaccatgagtgatgtaagtaggttaacaacagcaaaagctggggagaaggttaaagggaactgatacttatgtctgcattctacataccaaccactttgtagtcaggacctctattctaaccccaataacaagatgctgttgtttttctattttattgtttagaaactgtacaaagctggctgggaagargaaaagaagaaaggatatgacctgaggcctgatgccattgcaataaaggctgcaagagcctctagagacattgccagtgatgtaagtgcttgcactgggcctttttggggttgagcaagtaagaacaaatgcgctaagcttgtgtgtatgtaggagcagtggtcagctccattcagggttggtgggaatgccatcccatgtgacacaagacacctcccttcaccccatccaagtaccctctaatcatctgttcattatttaatgtaagtagtgactgagtcttgttaaaataagtagcctttagagtctattcaaatcacttacaatcctaagcaaatgtaaagatgcaatctacgtgttttaccaggaggcccatggccaggccctctctttaaagatgcaccatgagaaatcctgcctgcagccttttctgtcacttagacaactgagtggggaaatctgctttctaaatctctctaaaccaatttatttacacatctcttcgattaactctgagattattttctttccatggactcaagtctsgggaaaaaaaaaatgaagtaaaaagagtttgctccctccctctcacgagtgcctcccttccaattttagagtagctctaaaacccttcatctaagacaaagctcacatcacctagcaaatggtactttgttctcttttaccattttcatcaccataatttcttctctgtccacagtacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgatgtacgtgaaaaccacatttgcagagcgtttactcyggataataagcaaccatgagtgaccataagcaatgacgttttgaaaatcctgaaagaaattcatctgcaatttcccaacatagtgtttcatttgttaccttagattgaattcatgtcctttaacaaaaggagatcaattctagaaactaaagtcttgttttctactattgttgctgggagcattgttggattctgaattccacaacagcaaatggaacttcatttcagaaagagtgtattgaaagraatatgtctagcaaagatggtcaaaagcataataggcttttaatagaggaataaaagggaaagtaagaaatcagataacctgatagctccagcccctccctcccaaccgggtttcattctaccacttctaactttgcaattgcctgccttactaatgaaattttgagaaggtgatgactgaggcagcctttagactaaatataaggaagacagagaaagaatagagccaagaatttagctaaagagtccatttgatggttggagaggtgaattaagttacaaacccaaagcagacgaaagcaaggctacatttctctttgggaatgtgagggctgagctattaattgtcagggaggtagtaagtgcctgaatgaaagcagccatggcacaggtgtagagagaaatgtcaaagctgaggaggaaaaaatgaaatttacacaaagtaccaggaaggtttctggcatacctgagggaattgtaatggtggtggttgatcaaagacagtgaaagagaaaaatggggtttccatagtcatctgttaaccaaggggacttgggaatttttataagaaaggtcagcatagttgcttttctcaaggagataacagtcacctgggagatgaatctatgtggtatttcttagtactttttctttatgaaggcattgagaaaaacaagtcacaaagacatttctgcttatttttaatttatcatgcaaggaaatataaaaaggataaaagtttagggaagaaatggttgaagttcaacatgctattggttaaataccaatattcaagcaaatattgaagtggaaaagttacagaaaatttacaaatgaaatggaagttacagaatgttaaacacacacttaggattcttgggaagttccagtttcttctcataatttaatttttcctcttttgcagaatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaagtaagtctttcaataatgcagtgtttcatatgcatcagagagaatccaggtataatttacatttaatccacaggttttgctaatacagttatagggcatcacacttgaggttattttacctagaaaaagagtccttgtcgttaaaaaaaaaaagaataggaattatttctaannnnnnnnnnnnnnnnnnnnaaaaaaaaaagaataggaattatttctaactagtagtcttcaaatcttcaatgaaccatcctatctcattgacataaccaaataaatagggacttttttcttttactgcacctcttgaaaatgagtcctgtttgtctaaggtgaggttgaatagacattcatgacactgaatcagcagatttcctgatggtagctggtgttggaaaccacctcccaaaccccagcttgctttctgctttgatgggatcaaagaaaagtccaagattacatgcctgtagcagcatttcaaaccaggacgttctctgggtaatcttgagggcagttgttctacatcagtgtttccttggttcatgaattattccagcttttagaaaagacttactctatttttacattgatttgcaataagagatcaagaccaacaagtacaatcaaccttgaacatctgtttttgaagttaaaagtaataaaataactgcagcagcactggtggatcaaaatgagaaatgcctttgataacagagaaaaggatgatttggatctaaacgtgaaacagttgcagaaaataatggccatagttgtgctagaaagatagaactgtattatgctaagccacggagcaaaccccctggagtcttcagagaattgaatgatttgtggagctcaacctccttgaaagggacctgcctcaaagacaaggcacaaatttctgtgcctcttttaagatttaaatctaaactacatgaggatatctatttttttcagtgttagtgattaacatttcaggataatgatgccaagaggagaatcatagaactagcacgtactggcaccaagagacatcttgatgaccatcaagttgaatcctcccattgcagagttgagaaaagaacagcccagagaagcaaagcacctcccacacagcgggtcaacagcagggtctggactagaacagggattctgataactagtcaccactctttccactagcatttcactgtccaatactattactactagccacatgtgttgatttatatttacataaatcatattaataattcagtttctcattcacattagctacatttcaagtactcaatcggcctatgtggctaggttctaccatattggattatgcagaacatttccatcattacagaaagttctattgtatagtgctggtctaaaacagagttcagaaaaatgactgtttttgtaaataaagttttatagtgacacaaccacagctgtttgttggcgtgtggtctctggctgcttttggactacaacagcagagttgagtagctaatgacagcaattgtttagcccacaaagcctgaaatttaaggaatttctgtctatacagaaaaagtttgccaatctctagtccagaaaaaggttattcttattttaattaagatgggctaaaacaaagagatagcatttatcatctattgcatttgcaaatattaaatagctgtgttacatgcaatatctgtaagggagtttctgttaaagcaaacttttaatgggccatttgttaatgttcgttaaaatttaaaactcaggtatcattaccctatagaaatccttatatatgtgtgcaaagatatacatacatacatacatacacacaagaatatgttttgcagtttagggtttctgaaaggagaygctaagatgaaaattggagtacagagtattttttagggatcctagtctttgggaagaaggactaggccggaggagaagttgaacagtgatgctggcatgacaaagtcttggccagtcccacagagggctctcaagtgtctctgtcagtagagacctgcactgaactgaaatggctagatctttgtacccccacttcgatgagttgttgaatgtggttatctgggaagggcatactcttgagtgagacagctggtgactggagactatttgccaaaagttggggaatcaggtccttccttgaatgagtatattggtggcacatctccatgtccaccacaaggatcatgacattgcttgtagcagaaaaaggctagaggccataagttaaatattcatcaccagagaactgattaaattaattagattatacctcctaatgaaatactacgtagctctaaaaatgaatgaagtaaattattttaagaaggttcaaatatgtctaacctatattattaagttaaaaatcaagatgtagaacatgacttcatgtatatttaaaaaggactatatgtctgttttaatttacacagaaaattttaggaggcaaatgctaccttcatgctgtaagataaggggaaaaaacatttttactttccatcttacatcctccctgctgtattgtttgaataagcaacttttccattaaaatttttttgggccaggtgcagtggctcatgcctgtaatactagcactttggaaggtgaaggcaggtggattgcttgagctcaggagtttgaaaccagcctgggcaacatggcaaaaacccatctctacaaaaaatacaaaaattagccaggcatggtagtgcatgcctgtagtcccagctactcaggaggctgaggtgggaggatggattgtttgagcctgggaggtggaggttgcagtgagccataattgcactactgcactccagcctgggtgacagcgcaagactctgtctcaaaaataataaataaataaattaattaatttaaacctagctaataaaaatacatgaaatattgatatatatgtacaatgatatgtatgtactaagtgagcttcttttaagattttaaacactaatttacactgtttttttcctagcatctctacaaacaagcatgggaggctgacaaaaccaaagtccacatcatgcctgatatcccccagattattttggcaaaggcaaatgcaattaatatgagtgatgtaagtatagttccccctgttgtcatctttctctccagcagatttgaaccagtaagaacaaattaattaatatctctctcagttatgagagtgaatgttttaaaaataatggtggaaatccacacatgagactctttctaattttgctttgcggagttggagtaggactgtggatggggttgggccaagcagttaagaatttgaacggtgtgattggattttgttctaggggggcactccttattaaattgagagatttggtagaaagaaacaggctccggggccaggagaagagaaaaaggaaatgagagtcctagaatttcgttcttagacagcccttccatcaagcctttgagatggttctaaagaaggggttaaatggaaagggaagaagaacattttgaagaatctggggcaaaaccccaaaacaaagaatgtgcaaatgtattgatattttatttcatttcctttttcatcctaatcatagttgctaggaaatcctctaatcctatttttatcatttctttgtttgaattccacagagatttggaatagctgacctttttttttaattgtagattccacattattatacaaataaaagtgctgattctaaaacagagatgttttcttttgatgtaagaataaggctgttttgtagtcttcctttaactcttatttgcatcaataagaatctctgggactttcacattttttaaagtatatttacaacctaatagagaccagtaacttttactttttctggtattttcttgaaaatatgtttaagtttgttatagattgtttttcaaacacagttatgttrcttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactctacaaactttccttggaagagtctaaaaagaaaggctatgatctcagacctgatgcaattcctatcaaagctgccaaggcttccagagatattgcaagtgatgtaagtccaaaggaaacggtcacctggctgggggtttctaaggaaccgaaataataagggctgagttctggaaacactgagtggacacaatatgaaaaacagtgggtctcactctctgtgaatgcttcttaaccttgcttttgtgttttctctgatatttctgaaaaaacaccaagctaaccacatggtgaccctcatagatgtcagctccctgactcatgagatctagataaacttactttgaatctgtcaccaaggctatggcttatagaaattcaaagcccttcactaagctttcttggtgaaagtcttgtgttgttcttgcctcctgcttcttcggatctgattttctaacaggatgtctcatgtatgcaagggtgctgatcatttgggctcatgatagttgatgagtaaataatcaggaatttttgcaaaccagttgttaaactatcggtggcttgatatcagctgtgacgggcatatttacaccacagaaattggcaaacactacaaagtgaggctttccctgcgctggccggcaaaaaagcaggtgtaccaacacatcactgtcatgacatgccacctatatgaaactcaattctttcatttggttgtttccacaagaaatccactcacagggaacatttaatgacttggaggtcctgggaggagcatatttcaaaacaatctctccttggtcacccatcagttttactttctctcccatctctrttcttcatcttccctacctatccagcccatcccattctctcttattatcctgagaactccaaattcttctcccctctattacgctggagtaatttggctctactagcttctacccccaacttgcacacgcaaccccaaaaggagacaggcagaaaaagaagctctccatggatcaagatctcccctctgtagaagaaagttgggatgataaatagtacaatttcttccccattatagcagtttagagagtcttaaaggaaaaggagctccacgaatataaagctattctaaaattacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaatctgggttctaatcctcagtggcctcagcaggttgctcagctctctgggtctcagcttattcatctrtaaaatgaggagagtaataagaacttttctatctacctcacaagggagagttgtattcagttacatcaataaatatgaaaaattagtckgaactatagagctctatacaaatataatttttaattatattttataattatacaaaaataatatagcatattgacactagatcgatttttagtcaaaggaattgctctgtgtaaaaactcawattttcttcacagtataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgatgtaaggctttcttctacttgggtgatggttggaatcctagcatgggaagggagatcacagtctgtttacatgccatggtttgtgtctaaatggataagataaagtagaatttgcttatcttctttatagaatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaaggtacagagaacagtggccgtccacacagctcccacgtgaggaaaggctagcaggctctggttcttgtttggagaaatctaattaaggtccatcattcctaggctgtggcaaaccattccagatcattcccctacaccatcttcttctgcccatctcttattttttttcttctcttgaccttctagttgggttagaaattatttatgtttttaattattatatcttcaatactttcagtccattgtagaaaatagaaaatacttaaaagattttttttttaaatctgagtttgtttttagggtcttttctgaattatatgctacttagttattacttactacatcaaattgagtgcattcaagtactaatatataaatacatatttttctttcctgcttgtcccagttattcaaatttcatgtctttttttcccacttcctagcatttatacaccattgattggaataaagataagaccaagattcatgtgatgcctgatacaccagatattttacaagccaagcagaatcaaacactgtatagtcaggtaaakttatataaaaattaattttaagttttgtattgaaacttatgaacttataaaataatgtaacagtaaatactgatataaatgttgaagcaatggaagtttggaaatgacacactgattagcccaggatgttgcaaaatagagtgcttaagagcaaaggcttcagccacaactgtatgctttgtggagcaggttctgtgtctgtttatctctgtgttcattgtgcttgataccaagcaggaaatcaatagaaaattgttgaaaawaaattgcatcaaacagccaggtgtgatgacatgcacctgtagtcccagctactcaggaagctgaggcaggaggatcccttgagctctgaagtttgaatccagtttgggcaacattgggagaccctgtctctaataaataaatacataaataaagtaaaaattgcatcaaacagacttggtatgagttttggctttgccatttttgagatgtatagtactgggtaactcaattacctatctaagtctcactttcctcatccctaaaattgggaccataaaagtgcctatgacattggattgccatgaggactaaatgggaaattctgtataagattctcaatacagtacctggcccatggaaagtactggataactatgagctatttttgttattacccagttttaacacacatacatccattcaatcagtaaagtcaactcagaaagattgcaactaaattattgcaatttataaaaggcatttcatcatttattgcttttatcacttagctaattaaaatgttgtgacctgtttttctttttattagcaattatcttaatatctatcttcaaaatagtaagcccaggcggtattaaacagcagtgagaaagatacgtgatatgcctgatatgaccatattgtttctgaacagcagaagctatgataaaatataccaccaggattctcacagccaaaaaagattaaagccaggtcatatgatgctgagtcagtgctttttcccctcctttaaacagcttgttttatttttatccatatctttaaagatagggtagatgatgttcgatctgatattcactctgtaggtaaacttttccctaataatctattgatattctttatatagacagaataatgctgaagaatatctttaattttcagaaactctataaacttggatgggaagaagctttgaagaaaggctatgatctcccagttgatgcaatttctgtacagctagctaaagcttcaagagacattgctagtgatgtgagtactagtttgagttctataaggctatatttttatctgaatcaggtgacttaatgtcggtaactatttttatggatagtctttacctttcaaaatataatgcttccttcattttctcctaccctcttcatttatccggagttcactcttctctttcactgttcatatgtcaaaagggcttcctgaatagaggtcgggccagacgacctctaagatccattagagtaagatgctctacttggagatgttacaaaggacccgagattgcaagttttccctactttgcctgaaaatataataattttactgctttctacttgtctattttagacaaattcaaagtgccagatgataaatcaacctcaacaaactgatgctgatagattttatatgcacatattttaaaataggctgtcagttatttcagtttagcccattttgcacttatataattgtaataaattaccttgggacataaaaaatccaagaaggtccagaaatttaggtttaagttcccaagggcttacttaactcttctttctgaaaatccaatctaaagttcatagattcactctcccaaaggtagattccagttatgattagaaacggtagcaaatctggtgaaaaactaggtattgtctctatttaggtattgtctctattggttaattttttacaagtattttacttagatattctgcatattgctagcatatcattttgttaatcccaaaacttaaccacaaaaattcagaaggtcttggttatagtgaataaattaccaggatttcatagggaagtaggacctcttaatcaaaatctttgaaagaaaacagggatttggttaataggcaggttgaagtacagagtgcaggaaaggaatgcctaaaaatggaatctgacaataaattctaagaatataggggaagattttatttaattcacttaatttctggcactccagaaatgttggaaaattaatatgatgatatattattacccactctccagcttgcaggtcaatcccttattaaaataaatcaatgaggtgataagcctaaagcaataatgatgtgtaaactcatttccatttagtgctatgtgctaaagatagtttaggaattgaagaaataacatcaataatttcctaacaacatttgatagtacctcatttctttttgtgtgaacccattaattcgaaccttttgaaatcttactctcaaatgaactataagtgaactttcccactattatagagatgtatttccctcaatttcaaatgtccttgtatttataaattttcagaaaattaaaacaattttataagtatttaatgaattagaatcatagaatttagagtcggaagataacataaaggacatttaatctaatctcccactcagcatcctaccttctctccatctccaaaattctgtagatacttaaaaatataagaattttggaggctgggtgcagtggccccgtcccataatctcagcactttgggaggccaaggcaggaagatgatttgaagccaggagttcaagaccagcctgggcaacgtagtgagactctttctttacaaaaaataaaaaattagctgggcatggtggtgtgtgcctggagtctcagctacttgggaggctgaggtgggaggatcacttgagcttggaaggctgaggctttagtgagccatgatcgcaccactgcactccagcctgggcaacagagccagacggtatctcaaaaataaaaaaattctttaaaggaattttggagtccttcagggcaggtcatttctttgttagatcatttctaattgccattatataccttcttatttttgcctaaatattttaccaataagctctagatctctgttctacaacaccacaaagcagcctatttccacttccacttgataggtcttcaaacattttcatatttgccctcctttgttttcagttttataaattcttcaatcttctgatcattctatttgtaatttgtgctattttttcaaaactcttgtcaaaatagaatccctcaaaatttagtgttgttttcttgatayggaaggtcaggtcagaaagcttatttgtgccccatacaaaatctatggcactgctttttaaaaagcaattttgtcagattgcttatgttgaagttaaagtccacttaaactcctgaatattttatatatgtaataatgaagctgggtatcatgtaacgtataacatgtgttcagcacctaacatcaagtaaatgctgttagtatactcattattatcactgttgttattgtcatctagtactaatgtgatttttcttaattgaatctaaataccaaattttacttttactgtcttaaatttatgtaatcattttgacccatttggcagtatgttgagctcctgtggaattttcttcctaatctaacatatttagttatttttagccatctgcacatgcaagatatagatcccaaacaggacaaggttatatgacgtaaccacatggcaaaccacaaaaagatcctgctatttaatggattagtctgcattattaggcgtatttacttagtcatgtatcttcctgatttttctgccatttagcccgtaaggattatcatttccataagaatatcacaagagctgtattaaatacaaccccaaagtcagaatacacaatatctagcacaaccaaacatatatttctgcatctagttagaattaatttcttatcataacctctcttgatactcaattacattagatttcttcagaagcttccatgtaaacaaggcttagtttaagtaagtaaacattccatactaagttagcatagacaacacttctctcatttcagttttggaaaacaaacatgaaaacaaggcaaactgaagctggatgaggtggcatgtacctgtaaatcccagctactagggaggctgaagctagaaaagtaggcctgggagttcaagaccagcctgggaaacatagacccctgtctcaaaaaaaagaaagaaagaaaagaaaaaaaagcaagttgagcttaacttggcctttgtgtactaaaagagctgtgttttctctgatttcagtataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgaggtcagtttctattaaatccaatagtttatatattaattcatattttatatgagtagctatttagtcaaagagaagcagaaattaggaattattattgaaaatctaaaatgcatctgtttgtaatgcatagaatcacttgaatcaagggtccaggtgagaatgggattttgatggcttgctctgtcttttcacagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatgtgagtagcactctggaaataaatagattatagtgcctgctacctagtgtttgctcaatagcacttgcttaataaatgagtagaaccacaaagcattgcctcatacatcaccacataaaattttatattggatcattttatttgaattagcaactatcctacactgaatcatgtaaaaatgggtcagtgtcagtttttgtcacccaaagcttatttattatttaaccaaaatataatgggaaaatgatcgaacaaactgtttttctttgaaacttgactgcatgaaacacccagatgttttttgttggggtagagtatatgagggggaaagattctgagtaccttacacaggcacaatggatgtgttataaagagtgtatttcctgacaaatgattataatgcttttagtttagctgaatcaggataaatggataattctgtcactgtaaataagtatctattccatcttcaacttattttcttcaccagctctgacaccagtatctagcacataataggtactcaataaatattcattgaaaaaatacataaaatatagcaggrtggagtaattatatgcaaagaagggaaagattactcaacactgctcagctaaaagcctaactttgaacattacagaatactgaagtatgtgccctgaaatctgtaattggtaagaagatttaaacagatatataataaccgtctgttattaggaggatctaaatatatgtactgtaggtcttaggaggatctgaatatatatactatatgtaatatgctatacactttacatatatcatatatcagaagttttatataatatataagcccataatcagcttagaatgagcattgataaactgtagttcctcttttcctaactaacccctcacagactttttataatgctgatttccagaatgtatagtaaatgctgacctgtcagcttcattatgaatgtttaagcatttacttattcttttactatttttatgatgacagaatccaacaaaatgagaaaacaacaaatttgtacaaaatgtttcccccttgttggaatccaagtttcttttctttccatgaaacaggagataaaaagatctgaacttaataaggtgaccaaatgagaacccctagatcattaagtttatcgatatacacgttctgggacaggactccccagcagtgtgctctagtttggggaatgctgaaacatggagctctcaggcctcaggactgccacacaaaacccgggccagctggggtccttgagcttgcagtctctccttctgaatcaactgatacacctatcccagtgtaaataataatagcattttctctgcattccatggggtgaaagtggcacatgccattgaagaaataatctaacttagtgactttcaaccagaagcaattttgtcccacaggaacatttagcaacatctagaaatatttttggtttttacaactggggagtggcatgctactggcatctagtgggtagaagccagggatgctgctaagcaccccacaatgcacggggcagcccccacaacaaagaatcatccatacacaatatcagtggttagcaggtagagaaactctgctgtttgcttggtgggtacaatgtgtgttgctccagtgatggatgcactgaaggccctgacttcaccacaatgcaattgctcttgtgcccccatgaatatatggaaataaaaaaattttttaaagagaaactctggtgttactaaatccaaaagggtagtgcagaactgggatacacacatatggaaattaacaagccttgctttgtttgggtgctgagggtcttaattggcttctctgggttatatgcaccataacaaacatgtgcaggaaaaagaaaagtgccagacacacacatctcatgctgcatacctcaaagggaaatggacaagtttaaggaatcaatgagacaaaaaaattttttattgaaataatttcaggcactcagaaaagttgaaaaaatagtacatgtaattcacatatgtgtgtatgtgtgtgtgcatacatatacccagattccccaaatgttaaaattttaccacatttgctttctctttttgtctctttttctccctttctttctctcagatctatatctatatatctatatgagaaattaaattgcttcatgatgcctaaatattccgtctgtatttcccaagaataagaacatactcacataatcacattgtgatgattaaaatcacagaattaatttccactggtctgctagtctacagaatttattcarttttatcactaatatcctytmtaagaaaagaaaatattttctctggctcaggatttaatccaagaccacaggttgcattacttgctatgtctttagtctcctttactctggactagttcctcactgtttctttgccttccaagtttttgacattcgtaaagaacataggtcagttattttgtagaatctccctccatttgggttttctggtgggttcctgtgatagactcagattatcttttcagcaggagatcacacattgtgtcctcctcagtacctcatatcaggaggcacaggatatcaatttgttctattactaataacttaaacacttggttaaagtgatggtgccaggttgctgtactgttgagtaaccattttatcctttgtaattgataagtaatctggcagggagatattctgccctgtgtaaatattctgtttttaatcaaattttcctagttttagccgggcacgatggctcacacctgtaatcccagcactttgggaggccgaggcaggtggatcacctgcgatcaggagttcgagaccagcctggccaacatggtgaaaccccatctctactaaaaatacaaaaattagctgggcatgtggtgggtgcctgtaatcccagctacttgggaagctgaggcaggagaattgcttgaacctgggaggtggagattacagtgagctaagactgcaccattgcactccagcatgggcaacaagagtgaaactccatctcaaaaaaaaaaaattattagttttagtaagtctgtgaaacttttgtttggatccccttgtcttctgttgaagagacataaggatggctctgggacatccaagatatcttgataaattcccccccaaaaaatccttttgggaatcctaatccttcacaatgattatgaggcataactataaatactaagtcacatagaagctggacacagtggctcacacctgtaatcccagcactttgggaggctgaggtggggagttcaaggccagcctgcacaacgtagcgaaaccctgtttctactaaaaatacaaaaattagccgggtatggtggcacatgcctgtaatcctagctactcaggtggctgaggcaccagaatcacttgaactcaggaggcagaggttgcagtgagccatgattgcgccattgcactccagcctgggcagcagtgtaagactctgtgtcaaaataatgatagtgataacaataagccacataggaaataaaacttcctgatttctaggcatgctttgaataagacatcttttgaaaaggcaagggctgcctctaaattaaacactgagggacacaacccagaagatggagaagcctgtttcatttgataatattggcaaggcatgtaattacctagattgatttcttgtaggcaggattatctgtaactttgaaaatgtgacccataatctctgtgttgaaaggcagttatgtcccagataagtcaagaaatattgcatctattttctgcttatgttgtctgcttattatatcaattctgtataatgtttaattcagataaattcagcaattctgtttgaagccaactgtatcattcactaatctaacaacaccactgaaaaattattatttcttattttagagactttatagagaagcttgggacaaagacaagactcagatccacatcatgcctgatacacctgacattgttctggctaaagmaaacttaatcaacacaagtgatgtaagttttcaaattcagcatgtgttttcagaaagctcattttaattgtttctaaatcagtgaaattgtctagaagttctctgaatccctgaattattttaattaattaactacatatgacttagattccttatttagtggcttttagattgaatatcgaaatgttagtactcactatgtcaggcagaatggggagtctgtattctctgttccttgcagtccgttgttatacatatcatcataaggtggcttatattgctcttcccagtgtggacaggcaytctttgcaggcagaggcaattcttattgaatctacagtgcttatctagaatcgtgcctgacacatagtagacactcaatgaaattttggatcagtgagcatacaaaacccacgcaggagaatctcatttttattgtcattatcattgcagcataatctcctgaaatgtatacatctgaaaattaaatattttaaaaacaaattctaaattctaatagaatgactttaacattaaagaatgtattaaagtagttccacgaaggactgacagataaacacaagtccaagatcaataggcactttaaataatctggtttctggataaaagtacatttaaatcatattctcaatttttaaattatgttacagatctgaaaaaacaaattctttcacttaagcttttaaaattcattatttaaaccttcttcaaaacataagttttagaaattatggtggactcagtatcttacctatagatgtggatcctattttggatggtcccattttgggagacagactatttcacaatgcatcagctacatagaagagataaccccttaggcatgatttttccccattagaagaattagatgctcttttctaacaaaaacttctaatgaaacagtccatgtgaattgaaaaacagcacctcaataataatccatttcatttctctattgttttacttctgcctgattcttgcaagtatagacatgcactgtataacaacagtttggccaacaaaggcacacatacaggacggtggtcccgtaacataatcatactgtatttttgcggtatcttttccatgtttagctatatttagatagacaaatattaatacttcccattgtgttacagtggcctacactaacatgctctacaggtttgtagcctaggaggaataggctataccatatagcctaggtgtgtactaggccgtaccatctaggattgcataagtacactctgtgatgttcccacaaggacaaaatcacctaacaatacatttctcggaatgtatctttgtcattaaccaatgcatgactgtatttgggaagagctgacaattttgctgatttaggtaattgaagagctttaaagtttaaaacaggatcattagcaatcaatgggcataatttctaattacatttgagtattttagggcacagatgctattctcatggactcaaaatatttagcacatttgatcattatgctatatttgtctatggggaacagtatttcccaaaatgatcttcatttcttaacagaaactctaccgaatgggttatgaggagctgaagagaaaaggttacgatcttcctgttgatgccataccaatcaaagcagcaaaagcctcccgggaaattgccagtgaagtaagattttatcctctgttgatattgatttgattgcaatttatcacttcaaagcagtctcaatttaattttaaattgaacaaaatctaaggggtaacaaattacagtggaataaaatgatcccatgcagtgtgggatgaggataagatcaaggatgcatttattatgtatggaatttcatagctgaatttagcctttaatctttcttatcaaaagactgaagtctttggctctctaggcttagtaaaatatttagagttaatgcgctttgtaatttgccacaaagatggcaacagaagtaaattttgaaaggaatgagacacattttttttctctagtacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgatgtgagtctaagattttcctttggccaacaaaacattatgtctgctttttaaagtatcagagtcccatagtgagcagagttgagtttacacaattaccctggactaatgcccaagcgcatctagtcacccagacatctggaggcaccattattccacaaagaaagagccagcaaagccccattgctttggtggaagcctctagattgtcgagctagacaatcaaaggattgagtcctttcctatgtgcttctgtttaaaatgtttttcaaaatatgcttttaatctgaatattttgttgatttataattcataycaaaaatttagaattttctaataattcaagtattaaaaatatagagtataatatgaacttttatttaggggcaaatgatttaattatgacaaattatgacaaattgtgataaatgatttaattatgacaaatttgtcacttgcactttcagaatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatgtaagtcctatgtttgtttgaggaggttattaattttttttgtttatggaaacactgaagtctgtttgtataaaagaaaacttrtttttgattcctttgcttggtactaatgtggttttaaagtattgtgcttcttattgacacaagacatttagacctgaawatgtcacaaataccgattcactgagctgaaattcttgattctcattaaaaatcagactgtctgcatgtgtctatttattactggcctataccagtcatgtttttctgtttctcttagcgcctctatacagaagcttgggataaagataaaaccactgtccacattatgccagatacccctgaagttttattagctaaacaaaacaaagtaaattacagtgaggtaagtaatatattcatagtgcgtgatacattttccttacaatgcactttataaatccaacttactattaatgtctattttagaaattgtataagcttggcctagaagaagccaagaggaaaggttatgacatgcrggtagatgccattcctatcaaggcagccaaggcctccagagatattgcaagtgaagtaagtatacttggaaagttatttgccttagctttggctcaaagatttatttctctctcctggatttatagtggcacaagtaagccatgaggttaaagctgttgctaacagtttattgtttcgatgaatggtttaaaataatggtaatagagttatcaacagaaaggccaaattcaagttattgttgagtccatagcaacatgcatttcaaaacatgtccgtttcctgctgaacaaaagtattagatacttgactatagttcagataatttttttggcttttccaatgatgtatctctcatatacaattgagcttattgtagggttccttcaaaacccaacctatgctgtatgaaccaatgaatctacaagggctgaattataggacacattactcaaagttcaacgattcctgtggaacatgtttgtttctatatcaggtggtgggttacaaatatttgctttctttaaaagatggatttgctcactgtcacaaggacagaaaatcaaacactgcatgttctcactcataggtgggaattgaacaatgagaacacatggacacagggtggggaacatcacacactggggcctgtcataggatggggggagggaggagggatagcattaggagatatacctaacgtaaatgatcagttaatgggtgcagcacaccaacatggcacatatatacatatgtaacaaacctgcacgttgtgcacatgtaccctagaacttaaagtataataaataaaggatttgctcacatttctaaaaatttttatctttccatttcttttgtctatgaataaaaaaaactctagatttttttctttatttccaaaatatgggaagtaatcataatttaagaataaatgacaatcacagaagggttaaataccatataatgaaatacctacctgtcattaaaaatcatgtgtataggtcaggcaccatggctcacacctgtaatcccagtgctttgggaggtcaaggcgggaggatcacttaagggcaggagtttgagaccagcctggtcaacatagcaaggcactatctctacaaaaaacttaaaaattagccaggtgtgatggcgcatgcctgtagtgctagctactcagaagctgaggtgggaggatcacttcagcccaagagttggaggttgcagtgagacatgattgtaccactgcactccaacctgggcaacagagagagatgctttctaaaatacaaaacaaaacaaaacaaaaaaaacagtcatgtgtgcaaagactatttaatgacacatagaaatgcttatataataactgaaaagagcaggcacaaacccatatacaatatgacttctaattatattctcacacacgaatcataacaaattattttagtggcagaattacatcttaatttttcttttttttctgtgtgtataaatatacasacattctttgcaggcaragataatttttattgaatctgcggtacttatctagaattgtgcctgacacatagtagatactcaatgaaattttggatcattgagcatataaaacccatgcaggagaatttcatttttattgtcattgtcattgcagcataatctcctgaaatttatacatctaaaaattaaatattttaaaaacaaattctaaattctaacagaatgactttcacattaaagaatgtattaaagtaatgcctatctatatggtatatattttatataagatatatatttcatatgtgatgatatgtgctatatttattttctaaattgtttctacatctatcatataatttacatattcagggaaaattttttttttaataaatagagcaagttaggcttagtgattgctttttactaaaagttaaaacagatgactatctgtctttttcttcttttagttcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgatgtgagtactgagagtcataataacgtgcagaggtgggaaattatttaacaccccttggagaaaatggcaatatatgrcacaagctcaccagcccctggaggaggcaaatagcattgcctttatcgacaggaattttaatcctttaacccttcagaccaaagaggaatattgtgtgatacctggcccgtccaccaaactaaattttgagagtgcttttacttgatctcttatccttcagatgaaaatgcattgctgatacagagataaatatttattggctatttgtgtcaacagaatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaaggtgagacttcaaaattaagaatcgaagtggggctcctaaagctgaatcaacaaaaaagaaacattaatgaggaaagaaagaacattgagtaataaaaggcatctatctatctgtctatgtatctattggcttctcatctatctattaataactgatatatatcatgtatattttgatatttagtcattgtttcatgattttgataaagtagcatattttatcaaaaaatagtctgcataaaatatgcttattctcattttccttttgttaacatacatttcagattattagaaggcatttataaatacacattcctttatgaacttattacctgaagatgtgcataaaacacataatgtgtataaaacacataaccttttctttttttttataaagtttttgtggccctaaaattcctattaactatacacagaacttttttcctgatgaatttgtgtattttttttgatagcgtttatacacagaagcctgggacaaagacaagactcagatccacataatgccagacacaccagaaattatgttggcaagaatgaacaaaatcaactacagtgaggtgagagcagattctttgacatttgcacactgctgcttatttcagttgatctactctatgatgacatgataccaaatgacagctttagaaagaatctttttcatgtttcatgtgaataacaactcttgcatttctcaatcaccatcataaatgtcaaactttatgcaatatgaattatcatttaggaaatacaaatgacatgaactaattatttaagctgtaaccatgagattatgtagaccattttcttttattatttttttgaagttaggatattagcaattgacctatacatgtatctcccctttatgctaaagcataactgtagtaaatatattttccatatattgttcctaagtgtggtttaggatccaaatttaagatttttagtatataagattaaaggcaagaactaaaatccacagtactaccaggtaacccacacacacacacacacacacacacacacagagagagagaaatatctgtcagtgtaaatattagcaagcccatttcctttcactttcagtgtgcacagggccacgtgccatcattccagaatcatagaggcttaggcagagagtcaagcctccaccctagtgcaaaggtacccctccccacaaataggtttttgacctgcctttgcttaagggttcccagtgacaaggagctgatctcataaatcagtccattcgttctggaaaatttatgagaaagcttctgatgtattgagtcacaacatttctctctgtaaactcacatagtcctctgaagctgcacagaacaaatctgtgccaacccccagagatggagagcagcaccagggtgcctcccctgccaccttcaccccaggttcaccttcaaatccaatatcccaagctgcggggcattcctcacatgacatcactagtaaaatgtgactctcagaactgagcaaaatactatgagtggggaatgactgatgtagaatacacttaactatcgtatttcctcttctggacatatgacctctattctgcatcctgtgctcccaggatacattggcagctgtcactgctggtgcacacagaacttgagaccaacttaaactctaagacatcttatgtggactaaagttaggtttcttccatcctgcatttatgcgtttggtaatttatctctgttcaaagattggcatttatctctgtaatttcttcttcttagactgagcctgtgggtataagcctgtggagatttttgtgaatctaagattctgtcagctgatgtgttagttatttcacctggctttgtgccaccagcaaggaaaatattgtttatttggcagcataaatcaacacacagagcataatttagagaatttagatggaattgccaccatcttaagtaattattttggaagtgagactgtaattttagtgcttgtatagctagcttttaattgtcaccaaaaactaaaaacatcaagtcttactcccctgtcagaaaggactgaattattagccaaacctataatataggtcctgttacaggaaaccatgcattacatgtgcaagaatttcaggaaacaaagggctccccctgtgtctagctagtcagcatttctggatttctcaactctgtctttgctgaaaaagctcagagatgtgttagtgcggctactcggctgccagtcccaggaggcccaggtgcccttccccattttgcccgcaaccccctattccacccacccagactgggacgctgccatgggcgctcccctctgatgttaaaaagaagagaactttttggctgctttcctattttctgtagaattaaacaccaacttcttagaatgaggcgttcacagtccaactctgggctattctcagccctctcctgtgaactcctccctggggcctcacccacttccttcaacacccctccgcttcccctccacagtggtgccttgattcacgtgatttcctctgcacttgatgccaccttagtctactgaaactctgctcaaagtctaactcaaaggtcaccccatcttcaagaacttccctgattctcagttcagaataaatgactccttcctggagctcttcattattagtgtggtttgacttttcagcagttgcttccacaggttatcagtctctccatcagttctcccaggaacctttaggttgagaggggtctcaacctcatctttgattcccaagtaccccgcacagtcagagacacagggtcagggcagaataaatgtgagttgaattgattgccatgatcaacagttaagcctttccctcccacccacattttaccatgctagaactatgagtttcagcttaatttttcctgtaatttttaaactggatttattgttttaactaaaattttttaaaacaacctgtaatatgtatatatacttaattcaacataatttttaaagtaaaaaataaaggtgcattgggctttatgggtatcttttttttttgttttgttttgttttttgagatggagtttcactcttgttgcccaggctggagtgcattggcacaatctcagctcactgcaacttccgcctcccaggttcaagtaattctcctgcctcagtctcccaagtaactgggattgcaggcatgcaccaccacacccagctaattttttttatatttagtagagatggggtttcaccatgttggccatgctggtctcgaactcctgacctcaggtgatccacccgcctctgcctcccaaagtgctgggattacaggtgtgagccaccacacctagcctcatttttgagtcttcacttcaacaaacatgcagaaggcttagaactctcaaaagaaagattattataggcactgtctgtggagaacttagtgaattgtcttagtcctctgtcagtttttagatataaatgtcagcatctgattttttttcccccaaatttagagtctgtacaaacttgctaatgaagaagcaaagaagaaaggctatgacttgcgaagcgacgccatccccatcgtggcggccaaggcctccagggacatcatcagtgacgtgagttgtcaattccattctgagtatgtgatcaatctaatgtggcattttcactgaactaaatcttagaaaagaacttttcctggacctttgaaaatatatcctgatatatttgtgtaggatttttcaaaacctcagttttaagggaaatgaaaatcttgatgtttataagagggatctgtaacctacaggacacagcgtcttctgtgaaaactggtcaaccaaaaatagagaaagattcattcatgtggaccctgttagagtgaagctgcaggcttggagatgcttatgtaagaattatcaccggcttatagaaaagcttatagaagatataactcataaacttaggttctgccagtgagattcagggcctggctttatgtaacatttgaatagatagtattttaaaacacatgcggtgcttgctattgaaatttgcccttatgaaaagaaggcagttgatcagtaccagaggtgactgctgacctaaggttacactctttttttttttttttttttggagacagagttttgctcttgttgcccaggctggagtgcaatggcctgatctcagctcactgcaacctctgccccctggggtcaagcgattctcctgcctcagcctcccgagtagctgggattacaggcactcaccaccacgcccataattttttgtatttttagtagagatgggttttcaccatgttggccaggctggtcccaaattcttgacctcaggtgatccacttgcctcaggctcccaaagtgctggttttacaagcgtgaggtcacactcttagcaatagctcctagccatttagcacgtctcccagagcaaaactgtcatccttttctggtgcctcagggattcttgaggaacaaatgacggctctaaaaatcaaggcccacttgctgtcctttatattggaatcttatgttagtgactcaactttatgtatgttggaccctcccagcaaatggacttatgccaataataataaataatgacataataataaccaagaagtattgagaactctttgctaagagctttatatgcattgtctcacttactcttcataattgccctaggatgtagatattatcattatccccattttgaggattgtttaagcaacttgcctcaaatcaaactcctagtgagtgggggagttgggactctgaacaatctcattcctttccactgtaccatattgtctcttgctgactcacctacactttctcggtcagttgtctttgagactagaagcatgtattttggataactggcttagattccagaatgaagtcattggacatgaataataaaaacattgttgatacatgtgaggctagaacccatgaccttattaagagcataatctaaccagttgggttgctatgtcagttttacaagtacaatcagttttcaaaatgatgccaaaagcttgccactgccattgaatgcatgaatctagtaaaataataataataataataaattctcctcggttgctactacaggtgatccttacaggaatcagtcactcattttactgtttttattttattttattttatttttttgagatggagtcttgctgtcacccaggctggagtgcagtggcgtaattttgggtcactgcaagctctgcctcctgggttcatgccattctcctgcctcagcctcccaagtagctgggactacaggcgcccgccaccacgcccggcttatttttttatttttagtagagacgaggtttcaccatattagccaggatggtcttgatctcctgacctcatgatccacctgccttagcctcccaaagtgctgggattacaggcatgagccaccgtgcccagcctcattttactgtttatcaaagacaccattctaccaagtgcaccctcttcctgacatgcttttagtgtatagaatccaattctacaggttccctggttcaaatgttctctccctgacttccacaggtgaccttttccccacatatgcacttcttgttttcagaggtatcccttagtaccaggctgtaggtgatttggggtatatactacaattacatgaattccatctatttttctacctctgtaagggcttccaggatgaaagccaggatactggcttgagttagtacttgttaacaaaagtcagttgaagtatgatgtaagcaagttgattttgcacagacttgtggcctctaaggggttacaataaaaacctgatttgtgcattttcattttagtacaaatataaagatggttaccgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacgtgagtacagcatctataaatggagctgtgcatagaaataatttaaactatgtgaaaattatcctttatatacaatccattactcaagttaagattgattggtccatgaataagatttaaatcagaatacaattttattgctttattatgaatacactaatagacttcataagaaagtaaaattaacaaagtggacttggtcttataaaaacaaaatgggaattaagtaacattagaattcagggtccactagagggagacatttattctttttttaaggaaggaagaaacgtttttactttaaaaagaaattactgtggaatttgtttttggcttctttgcaaaccaaagaattattgaattctaatgcctactgcaacactaaatattatgcttatgaaataaaagaagtctctgtgtctgtacactactggactgtttcacagacacttcctcttagcctggctgtctatggaggagccacatggtaatgacagagcctactacctattggaagcagatacactatctcaaatctggatatgagaggcacatttcctgcactaggtattttataaactttgaaggaattaaagcactagcaagttttggaaactaaaactaatttgtaataattatacattaattggttgttcctaaaaacttacagcctacctgagaaaactcccacgtctgttctgtagcttctgacatacagaaccctgtgttttgcaattctttccaaaaagaaaggctttgcctgcacagaaaagatagtttaaaagggttgatgtcacccatacaacgacaatattgacagattgcttaccatctgtctatttgttgggcaccttctctggattaccttcctcaccctgcgatatgaccttcataatgtgggaagtatttgaaagttaaaaagcattctggaggtataaactgttattgttttcattctttttttttttttttttttctgagacagagtctccctctgtcgcccaggctggagtgcagtggcgcgatctcggattactgcaaccttcgcctcccgggttcaagtgattctcatgcttcagcctccctgcagctggaattacaggctgctgcctccctgccccactaattttttgtatttttagtggagatggggtttcgccatattggccaggctggtctccaactcctgacctcaggtgatctgcccccctcagcatcccaaagtgctggaattacaggcgtggaccccaacacctgtcctgttttcattcttgctattgttatttgtggggcaataactagtcagcacaggctaattctaatagtttttttttttttgtctagactacaaaatacaagtttttttattttctacttagtttctgtgacaggtgaaatctttccaatgagccaaacaaagattcaaaactatgattgtgaagcagttatgaatatctaatgggtatataaaaaccttcagcaaaaaaaaattttttaataaagtgagaaaaatatggcaatatgattttatataggtgtctgtgcttccatcctgaggacttggtgaggaagagactggggccctgcacaatgaaattgtccatttaataaataattaaattttattgccctgaatcttggacagagttacagctgttgaagatctcagggcttcaggggttctacagcactgttatattttaactgtgtttttaaagscattacagatattttgaaatgtatagaagaatacatcgcagggaataagaatccaaaacaatccaaccactagaaaaacccactcttattcatgtaatttatctacccacattgttttatgtgctactttaaaatttcatattgtattaatgacatttctacatgtcataaatattcttcaacagtgaagcttttaatggcttcagagtgttccatttgcctcggcctaaaattgattcactaagggcctgatgttgggcacgggtgtggtttctgtctctctgggttggtattcttccctgcatagggatgttataattatgataatgttcactgaaccaactgacagaagatattacttgggatcactcctctcctaataacctgaaatgtttgataactttttattatggctaggagatatttctgggtcatttttgagcataattcttttagtttgccttatacaacgcgcttgttttctacgaatagaaaacagaattgcactttattactgattctatttgcatatttaccctaaatattgtggtcttgatgaagagtttttgacttttttcctctgctcagaatatttacaagtcagatctccagtggctgagaggcattggctgggtccccattgggtctatggatgtggtcaagtgcaagagagctaccgaaatactgagtgataacatctaccgccagctccggacaagctgaaatttaccagtgtgactgattctctagagcaggtgctggccaagaacaatgctctcaacatgaataaggtgagtcctagctgccttaagcttctccaagatgccagaagatgttattatactttaatgactaatggagtctaaattatctrtgaaggygtggggtcgcatttttaccttttaaattacatgcttgaaatcctctaaataattttgattattccaagtttcaatcttgataactagtaataagactcacacttccagtagaatactttatattcaagtctggcttatttttcctaattaggtcagtaataacagttttaaatgaactttttgtcatttctatttcaaatgatttttaatcagcatcttatcttcttttatagcgtttatacacagaggcctgggacaaagacaagactcaaattcacataatgcctgatacaccagagattatgttggcaaggcagaacaaaatcaactacagtgaggtaggagcaaaaatctgtggtgctatattgtggtggtggtgtctatacttagttttgtggagattcttgggcctcagctgtcatggtgcatgtggctctttcatttaacactccactcatccaacctttcatctctgggttaaatattacattttatgggattccactggcaaactgaagtcacaatgtcttttctgttcgtggtgatttccagtgagtcagtgggactgagtagtattttagacwcttcagaggattgtcagataaaatactggcccattatttctgccaaaatattcatgcccactaattccatccctaccaattagatacatcagtaaatcactgcacctttccagggcagagagagtaaaggggcagaaaaggcctcagttaaaataactgagctttgtctatagaaagaaaaccttaggcataaggaagaaktgttctctatcaacaacattgattactgacttttttaaaagtaaaatgcaattttatagacacgtggtttattaatatgatacaaccaaaatttagaaagttgtgattatggttgttaactatattttgttatattttaatttttcttatttgtcttttaaacattataaaatatgattgtcatacaaattgtaggtaataaaaatgaataaaaatatatttttatacgtatagatagatattaaacattgttctaccattttttttcacttagtggtatgtttggattgctgctttgctcatcaatctgtattactagattgtattgatctatgctgatatgtacatcatattgatctatgtatagcatattaatctataatgatatataataggttaatatatcactatatattaatgttcattgatatatcccatttatttctaacgctatatagtatttttggtagaatataatttatttgcttkccactattgccagaaacttgaatkgtctccagttcctatccttttttaaattttaggatataagtcacttaataatctctgaattgttgatgtcaaaccttttgctttaactctttgcctttcttttcatagactctatacaaacttgccaatgaagaagcaaaaaagaaaggctacgacttgcgaagtgacgccatccccatcgtggctgccaaggcctccagggacgttatcagtgatgtgagtagcaacaccctagatatttacatggatggatgaagtggggaggcaggattattactattataacatttgggggccagtttaagcacatttattggcttgtttttctaaatcaaattcaaattcaaagtttttcatttgaaaaaactcatgttttaagcttcggaagacttcagtatctatgtcccaggtaggaagggggtaacctaaaccagtatacttcaatgcagtataaaattggatgtgattctataatttttcatatctacaattatgagaaattcatctccatattttgagcatagagcctcacagaaaatagaaaatggcaaaagaggtgttaaaaaataacttagttacatgtattggttcaatatcagaagaagagctgatagaaccaagtctaggaaaatccacctttccccaaatctgctctgtgtttttgccaactcatttttttttggaaaattatcttaaatccttccttttgagttcttttaaaatgaaaacagaaagacaaagacgaggaaaacaagaaaatggtgaacctaatttctcctcctgccatctctgaaagaggtgggttctttggtggaaaattcagacttcttcttcttcttcttcttcttttcttttgtttttgtttgtttgtttgtttgtttgagacagagtctcagagtctcactcttgttgcccaggctagagtgcaatggtatgatcttggctctctgcaacctccgcctcccgggttcaagtgattctcctgcctcagcctcccaagtaactgggattacaggcaccagccaccacacttggctaatttttttttagtatttagtattttttgtatttttagtagagacagcgttgcaccatgttggctaggctggtctcaaactcctgacctcaggcgatccgcctccctcggcttcccaaagtgctgggattacaggcataagccactatgcccagctgaaaattcggacttctgtaaatatttgttgggattggtgtggtgtgttgtctgaaatagggagaaaatatccagtttgcccttaccaccaccaacaacaaaatgcttttttgtagatacatattccatttttcacttgaggaatcccaaacaaacctcagtcaaatttgatctccaacagagcagggcttgtagtatgggaatataatccagaccacttcagggagtcaagtgccccagcagagctggatttgggaaggagtgtgggtgtgttggatggagggataaaatggtatctgtggactcaggaatagcagtctcaaaatcatatgtaaaatttctgggttagtgatttcatgggcccaagatgaagaaatggcagtacacagtaccgaaagatcttccggaaagtgttgcttcctttattttcagaaacttaacgtctacaagccataggaccatgtagtttggcctgtcttcccactggactattcccattagactgttgctgttagactatttatgagacttcgcattagactactgcccattagattagtgctgtagagtctaataagaatttaggatgaggagataaactgatatgcagattctttcattactctgcaagaattagcaattttaaaataataaagttttaaattaatgaggcttctaagcctttctattcatttttatttttgaaatgaccacctttatttcagtacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgatgtgagtaattaagatccatggtaactgtgctcataatagtaattcatagaaatactgagacagtggtctagcattaggtagaaccttcagaagggatgacatttcttctctctgctcattttttaggcaactcttccccttactttttttggagagaaagaaagtaatacctgagactgtattcaatttggccttcatatattgaagaacgtatacatgaaatttgactatccaagctttctagtgttatttttttatttttgaaatcatgttaaaacaacttcagtaatactcgcttttgtgtttaatctctccagaacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaaggtgagcccccaatttgtaggaaaataagacagggctatatgtcattcaagatacctattgttaattaagttagtctcttttttaaatccaattaaattgctatccaatgtatagtgattcagttgaattctctattctgttagataacaatatatgggagcatttctgctttgacatctcttgtgaaatagccagagttaagaatggcacagctctttgggaggccaaggcaggcggatcatgaggtcaggagatcgagaccacggtgaaaccctgtctctactaaaaatacaaaaaattagccgggcatggtggcagacgcctgtagtcccagctactcaagaggctgaggcaggagaatggtgtgaacctgagaggcggagctcgtagtgagctgagatcgcgccactgcactccagcctgggcgacagagcaagattccgtctcaaaaaaaaaaaagaatgggacagctattatgggttcaaattgtttgaagtctataagagttagttatatatgatttggtatggtttctttcttgctgagtacttatttaggtaagcacagagcaaacaagaaagatgcaagccgggcatggtgtctcacacctgtaatctcaacacttttgggaggctgaggtgggcagatcacttgagctcagcagtttgagattagcctgggcagcatgttgaaaccctgtctctacaaaaaatacaaaagttagccgggtgtggtgacacgcacctctagtcttaggtacttgggaggctgaggtgggaggatcacctgagcctggagaggttgaggctgcagtgagctgtgactgtaccactacattccagcctgggcaagagagtgaaactctgtctcataaaaaaaaaaaaaaagaaagatgcaaatcttcataacatttatcaaaaagaaatctagagatagcacatacaggtacatttgcagctaataaactaacaacaaacagcatcaaacaaataaaatcatgggaaggatttgttaatatagtcatactacagatatggatgtgaatatatgcttgagaaatacttgctttttatttaattggggtgagagtgacctggttaccaaacacacacacgtgggtgtgtatatgtgtgtgtgtgtttgattatatgtatatatatatttttcttttcatatcttagtatacatttatattttgttacaataaatgtcttgtaaaatcaaagaggttgaaaagaatattaacatacatggaacagacagcaagaaagctggctctcaactttgtcatggtgtcttaattgaaaactcctgtttacaacaaactgtttttctaattcattaacctttttatccttcacagcgcttatacacagaagcctgggacaaagacaagacccaagtccatattatgcctgatacacctgaaatcatgttggcaagacaaaataaaataaattatagtgaggtaagatcatttgttttatttctttggtctggccacattgattgttgccgatgtaggaatgtgagaattaygaaattaatcctcatgtaagccagttagcttagttggctttttatgccatttaccctaccttgaatatacatattattgtattaaaaaataggcagatagaaaggtagatagattagacagacagatagayagacagacacaaaaatatcttcatttcaggagggaaaaaatatctcaagtcaactattaatgactaaaacataattttcattaaaaataattcttgctattcatcaaattagtacttgcttcaaaatttgtgcggcaagtttattttcttcaattacctcatctgtaaaataggattaaaatgcttaccttaaagaatttttaaagaatgactaaatgaggtaaaatatttaacatgcccagtgtgaagcctggtgcaaagtatttgtttaataaactttaatgtctctcctttatgctcaagtcaccatgaaaattagatgtatttaatgtgctcaaaataacttgagctttatttacaagaactgaaatgagaattcttaaattcacccatttcaaattgcctgagaacaataaaatacattcttttatgaactatcttcagccttgctaaacttgtcattgcatatctttgcagtccagaaatactgctgcataaatagcgtcttgctcaattgttcttgccaaagtcaaaaatgtatatggttgattcaagaaggatactaattttttaaacatgtctatgtgtcttcatttttttttagagaaaaaggaaggcagagttgtcttcagtttgagagcactgaaaaatttaagtactaatttttaagatgaccaaatttattactttacccataataattacttttgcctataataatgtagccttaaaaaatggagagggtatgatttcactttctccagcattataaaacagaccaaaggacaagcctgattatagatatttgattggccttggcttcagtcacttttgaatgggccattttctcttggccacagagcttctcagttggattatcttctcccaggaggtttattttatccaaggcagatgaagttagtttctattccagattataatgaagctcttaatcctctctcatttgtttacattaggggaactgaagtagatttttttttcagactgctgcaaggatattgggctattttttaattctaaaattttcagctggatttactttctttaaaattgcatgatcatgcattgaaggctttgacttcaccacagtgcaatatattaatgtagcaaaattgcactcatcccccatgaatacatacaaataaataaaaataaaattgcataatgatgttgattctctgaggaatctaagatcacatttcagaatggcccactagaatttcttctcaacccattgcccgtggttccttcattgcataaatgtaaaacaaaacaaacacatctgtttttttcctcttaaattctcatttacttattttagttttcttaagtaacaagctttaaaatacatccctgatgatagctaaaagtgttctctcctttgaagcactgcatcttttttaaatgctgaaagaattaaagaactctatttttttggcctgaagccatgagatgattgaagcacattttttcccacttataccatttttaaaatatgaacatttattcctaaagaaaaaatgtaataaataaagtatttgaccttccagtttcaaaagaaacattcctagaaattttgaagaaaaacagattccctctggaatttatctcaaagatattaaattgattcttatttttactttagctttttcttataaaatctcatcttgaaaagactataaactgacacatcttaataatccactttataaacataatagtgaccctgtaagagtcttaagtcattaaaaatattaaaaaatattaaatgcatctgtagcatatttaaaatccagatactagtccggtatccttaattcaatctaatttgagaatggrgtataaaaatgaagtttaattatttgtatcacactttttagggattttccttatgtttaagattttgtctttacacaggctcagcaatgaaaagtacactgaacagtataaagtagagggatgataaagctttatagaactgtaaatctttgtagtttttcccttaaagccatgcattatttctaaattcttttccagaactatctactggtactgtgtctgctttatctaactcaataaacctcttaaaagaggaaagggggaaagtgaaattaaagattaaattgttcaatcatagattgatctaaaggctgtatttggatatagatgagctgctttcaaacctcagctacctaccatccttgaggttacacaaaggctttccaaggggtaaactggcatggatcgttttaagtaaatcagttaacatagcttcaacttccatacatacactcttctaaattatctgcccaagaatgcccctacagcttgagtggcatcccacttctttcataatcactcttctctcatgttaaaacaaaaaaggcatggtttaaaggtgaagaaataaactagagaactaaatgctactcattctcttgaactgaattctggatagaaaagcaacattgctataaaggaaattattgggacatttgatgaaatttgaatattcaccgtatatttgatagtaaaagagaataatactagacaataatactgtatcaatattaaatttcctgagtctgatacatatactgtcattatataaaaatatctttattcttaggagatacatggtaaagtattcaaggatgaaggccataatgtgtacaattttctcttaatcagttcaacaattgaaaataataataataagtaaaatgaagaaatacacaaacacataaagagagagctagagaaagcaaatatggcaaaaatgttaataaattggatagttggtattcattgtagcattcttgcaacttttctgtaagtttgaagttttgcaaaakgtggaaagtatacattttaaaatattaaaacatacattaaaatatttgactaagtgtgataatataaagatttcattttttaaataaagaaaaagaaatagtcatattcatcctagtagttactatgatgcatgtctgaaagtattaaaacraaactttaccaaacatggctgggtgcagtggctcatgcctgaaatcccagcaatttgggaggctgaggcaggagggatcacttgagttcaagagtttgagatcagcaacacccatctctactaaagaatacaaaaattagctgggcatggtggcacacacctgtaatcccagctactcgggtggctgaggcacgagaatygcttgaacctgggaggcagtgagccgagattgtgccactgcactccagcctgggcgacagagtgagactgtctcaaaaaacaaaaaacaacaataaaaaagaccccacaaaactctaccagacaacttaattcattattgcccatcaaaactttgtaatcaaaccaccatgagctcctacaagtctcattaagagatccaataaatttttactttttatgtttaaaaattattatcaaactgtatatttatcttgttttgatttattgaataccgatgttggcaattacttaaaatttttcgttaagaggatacagaatcagtcaaaatttttatcactggttcacaaaaagggctaaaagccattggtatatatgatttgtttaatgcgtggttctcaaatgacacttccatggaacatttgtgttttgtcttctgtgcatgtctgtcctgccacagaaattgaacagtggtggtgctttctcaattcacagaagaagtcaaaamagttttgcagttttgactcctaaatctttggtacctgctaccctcatgtcctcgaacaacttgcagcagttgatgaaataatagggagcaaatcaacattaacagagagattcagaaagaatgacacatctttagttcagcactaaatttgattatggacacatcctcctagtggtagtattattatatgttattatatgatactgttctctgctagtaaaaatgttcccaattcaaatttggagttaaataaatcaacatttcttgattgtttcatgaaaagggcaaatggtgaacaatctaaacacattaagaggtgttcatttaatgtataacgtgtaaaagatttgtgcaaagagaggttgtgatgttaaaacttgctgaatgtgaaattttcatttaaataaatatccaaggataaacagaaagtaaaagaaagagttctttttctgatttaaggctgaacatactcatgtagttttgcatccaaaagtggtcttcctttggcagaaaatatacttttcgagtgaatgtgaattctatatttaaaagctactccttctttcctcagagcctctatcgtcaggccatggaagaagccaagaaagaaggctatgacttgagaagtgatgccattcccattgtggctgccaaggcctctcgggatattgccagtgatgtaagagctgatcaagtcctaacatttcttaccatcatgccagccacacagaatacagctggatgtctctttggtcatcatccaccttaactcccttcagtgcataggcaaatatactgagggttgagatacagataacttgcccaagatcacaagcatcacagaggcatagcctagactggaatgtggctcatttgactccttatttttgatctttgctcaataggagtgagtgcctcgattaaagctagatgtgtgtatgctgagctactcacaaaacctcaggaacttccttggaacacactcaaggcaaagatgccagaaaagaagcaggcttaactgagtttgccccatcacttgaaaatgaacatggaaagacaaagtcttctttctatgtggtgcacagaaccaatatttctttaccctaaaaatgaaaacatcagattccctggacatcttaaaaattaatccaagagtagtaaaattgttcatttttataggtttttaaatgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttgtaaaacttaaactctctacctattaaataacagaaattgtccattttaaaactatttctcccaaatcaattgtgaagaggaaattacttctcagactatgctagaaaattttaatgatccatgtaaacatacgccccaggtgtgttcttaaataggctcactcacatgatggatttctgagacaccatcatggtttattactgtaattggactcttcatttcagtattcactttttatcattttttgccaacatatgattctctagcatatataaaggaaccattgtggggttattctgtggacatgtgccaatgagcacaacagtccaatatgtggcgttacagcagcatgaccagtgaaactcctctgttgccttaaagatttcatagaaagcaccaccacagaaagaacaacagggaatagccctttgtgcttccttcttatttactggattctctctttcagtacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacgtaagtttccttgatgttagctctgcatgttaaaagcggatctgaaacgtgtctgtgagttctgactagtgccaatgaannnnnnnnnnnnnnnnnnnntgtctgtgagttctgactagtgccaatgaactgcaatttgtttgtatatttcaaacaatttacaattaaatgtctgaaaggagtttcccattggaggtactacaatttgttttcttctccaaaagttctctgtaggagaggaaacaaagtaaatattatcagttctaaacaggtataaatcttcctagggattcaggcttcctttgtttgaatcagatgaaacttagcccttaaaaatatatcactgcaaacttttggctaaggaagtaaaaaaatgtgtgtgtttgttggcagagggcagtagggagatagagggaaagcatattatgctaaattactttaatttacattttatacttactgatgggaaaattctatcattcttacgtttttcgaaaccagtcgtctaatacttatcaacattcagcatgtcctattgagagtaaaataaaatgaataattaaggaaataccaaacatatctctgtaacatcacatttcctttatacacttgaagttttgtgatttttgaagatggaaataaaagtgagaattttttgactgcagtactcacgcaccatcagtctcagtgtgtggttttatttggagctattagactacattttccaaggctaaaaaagcatgcttctctgtaaaaatcttgtaatactgtcataggcaggaccatgtcttttactttaaaagaagatcttttatcattcttgctgtactcctctgtaccaaaaaaacgctcagaaaaaaaaatacacttaggattcaataatgtgcgtgagtgagtgaatgactatgctaggaaccttaactattcatcggtatttttgtgtttctctaggataacccattttgtaactatgaatctgaaacactaattaataaatctgtttcttatctgttgatctgcagaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataaggtgagtcttcaatcctcactgttagataccgaaagttaccacagaacaatttaaaaattctgatatattattgcattttaaagataataataagcattatgataccttcttaaatgatttttccactataataccatagttacttagtgatacttcaaaatattaaaccattgttaaaagtactgtgtgctttgtttgtttgttttgtttttgagactannnnnnnnnnnnnnnnnnnnnnnnnnnnnnnnnnnnnnnnnnnnnnnnnnncactgcaacctccacctcctgggttcaagcaattctcttgcctcagcctcccaagtagctgggattacaggagcctgccaccacacccagcaaatttttgtattttcagtagagacagggtttcaccatgttgaaggctggtctcaaactcctgagctcaggtgatccacccatctcggcctcccaaagtgctgggattacaggtgtaagccaccgtgcccagcctaaagtactgtgtgcttctgattggattagtaggttgtcaaaaaaaaaaaaatactgtgtgctataactctttcctataaattattttaaatacttcaatccaattatacttttcataaccgataagtcctttaacagattattgaaagaattttaataagaaacaaaggtaaggaatttatgcagctttaataattttatttctaccttgtatacaagagagatgactggcacataatcaaaacaataatatctgtgaacaccaaaataatttttctctctctctctctctyttttttttttttttgtagcgcttatatactgaagcctgggacaatgacaagaaaactattcatgtcatgcctgatacaccagaaatcatgttagccaaactcaaccgaataaactacagtgatgtaagtaaactgttgatcttgtaatgaacagaaaggcaaaaatgaaccactgtagctgtttccttaggaaaaggttttgactaatttactacacatactacaaactaccattttcagtagaagagatagttctcacttgattcaattttgagctttgtggtgggtccacaaagtaggctaccattttattaacaggttatcaggaattgaatgattatgaataaatatttccataggaattatacttttaaaaccttcccctacaggtcactgtgggtatcaagtcattattttattcagcagctagcaagtaggcaaggactgggttggaatctgatgagttagtaagccgcatattattttgctgctccagtatgctctgataatcatttgatgttaacatttttccaggcatttctgccagaaccaacattttcaaaagggcaatgatcctgaaatcccaggtccatatatgaatcattgtccgagataatagtccacagcaaaataagaaaaaataagcacaatgcattgagtttttcataaaacagaatagagtacattttaaaatattgtccttgttttttattcttcttttgtgttaagatgctgtgtcttttatattatgatgacaataataaatactgttttgttttgttttgttacgtttgagacatagtttcactctgtcacccaggctggagtgcagtggcacaattttggttcactgcaacctccgcctcctgggttcaagcaattctcctgcctcagcctcccgagtaactgggattgcaggtgcatgctaccatgcccagttaattattgtatttttagtggagacgggatttcaccatgttggccaggctggtctcttctcaaactcatgacctcaggtgatccacccatctcagcctcccaaagtgctgggattacaggcgtgagccaccacgcccggccagtaaataatttttttttttacatctgcttgtttggcaaataaaattttgccaaccaaatgttgattttttccccacatttttttgttgaaatttacaagtcagtaaaatcccaatgtttggaacatgtgccttaaaaatcctaagcacccatgaggcaaagctatctataaacccaccctaatgattgactttgtgaattatttctgaagtttaaatgaggacaaagaaaaactaataatgaacagcttcactttttatggaaggagtaaatgagtaatgactttcttttctacagaaactctataaacttgctttggaagagtccaagaaggaaggctatgacttgcgtctggatgccattccaatccaagcagccaaggcttcaagagatattgctagtgatgtaagtggatgttttggaaaagccatttcttattcaaagatgttgacaaatagaagcttttagagtttttcttgctagaaatttagttacccctataartctcaattccctttagtgattttcccctatacaaaattgtaaatggaaaaaaagaaaagcacaaaattctagacccattatacccatcaatcaatcaaaactagagacatactattttttaaaaagtgttttacggacaccaaaaatgggttcatatttttgagcttcagaaattgaacactccgtcttcaaaaaaaataaataaataattgagcagcagttgacctagatgtttgtgaaattaaagggattaatttattccctttaaataatatgtgagaaacagccaatatacatgtaaactcttccttactacttctatttattcttgcattaaaagaaaactagatggatatgtcttagagatttgttttgtcctttgtaactcctaattggtgagatgtccctcaccggacacaagaacaagtggcaaagtaagcagagctttttctcagtacccgcttgcctcttctctactccttttcttcacatgcgaaacacctcctaagggtggccagtgtcctcattctgtaacaagcctccttaggactcaaatccagactttccctcttctggaagggcctcatgccttagacatatgtttcatttcttctgtaaactaaaaagtatctgaaacagatctcaatcaatttagaagtttattttgccaaggttaaggacacacaccgtattatcaaaacttttcttgctgttaagctggagaagcccacaccatggtagaatggaccataatgcgttattctggaatcttcaaggtagataaactgactcatagtgaaagttcagtgatgttgacaggctgataagagagccatttcctggtgacacataaactctatctaaatgtaacacatatccttgactgagaagtctattataagttctaataagggaactattctaaaatattcttaatgtcaaacagttttgggaaaataactgttattttccatcagattgttatgctccatcagattgtacaatatatttacctctacttgttaaggaatcaaatgtaaactgagcagtgtggtataataaggaggaaaaatattaggaatgagaagctcttcattctaggctcatgctgccacctgcttgtggtgtgactgcgcaaatcactcaacccctgctaggttcaggttttgacttttaaaaatagggttgatgatactcacttttctccttcatgatagtgttggggaaaagaaaaagaaacaatgtgaatgtgaacctatgaaacatgattatataagatgttcttgtcattatactcatatctctatttttttagtacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgtgagtggctctaatattcttcagtaatggtttagaaaagcattctaactcttttgtgccatggaatctttccacagtctggtgaaacctacagacacctctttaggataatgttctgaaatgcacaaaataaagtatgtatttagtttcagaagaaaccaatcatattgaaatatcattatcaaagtattaaaccaaacctgtaatgtgcttttcattaacacattaagtaaaaaattctagtggtgactgtaataactaatttcaaagaagtgatgagcataaatactttaagacatcagcaacaactctgtactagtctgttctcacagtgctataaagaactacctgagactgggtaatttatgaagaaaagaggtttaattgacttacatttccatgggctgtaccagagcatggctgggaaggcctcaggaaacttacaatcatggtggaaggtgaaggggaagcaggcacatcttcacatggtggagcaggagagagagagcaaagggggaagtgctacacacttttaagcacctggatctcatgagaattcactcactatcacaagaacagcaagggggaagtccaatcacctcccaccaggcccctcctccaacattgaggattacaattcaacatgagatctggatgaagatgcagagccaaactatatcaaactataataggacataaaaagatttgagatttctatagctgacaaagtcaggtgtagtgtcaatactgctgtaatatattgcttatacttacaatggataaaatgctatatttcagttagaggttaatgaaaatgaagatgttacatattttttctatccaagttcactgatgccaggttaagaattcctgttctaaacaagctaattttctaaatgaatcaattgcattataattttgtgtctatttaacttataggaagtatctattgtaacttttgaatggaagtttaaaaatgaattatacatatgaagacaaattttctaagaaacttgaaaacaattgttccctanaaatacgttaggcacttttgttgttggccagtagagtcctttggagactcaaatattacctcattgatatcatagctccttgttttaatcaagctctggttaaatcaagcacttttggaagaatgataaaagcagtgacagttaaaaaaagagagattccctgaaagccataaaaacaaaaagaattgttacccttccttacaagaaaaattttccttcaaccagttgtttatattcaaagaagaaaatgaaagaaagaaaaaatgtatttgtttacttgaattctaagacaagaaagaggatggaggataaaataaatatgagtaaagagagatgtactctgtgacttggaagcatgtacatagaagcatacgaaaaagacgtcgtttttatccccaaaaaaacacattaatgcaacgtgatcaaccagtaatgctcatttcttctctatataccaagaagagctatgaaggccactgcctaacaacataggagccaactgtattctcacccagtacagtttccataagaggaggtagggaccatcaaatcagagaataaacactgtttcaggaggcaggcagtaatttccttaaggtggtttttatcactgaaaatgaatagcattaaagagatttttatgagtctttaaaacagtaaatattggctaccttcaggagccaggcatttaactagccattctaaaccaaagtaaagcaatcctgtgggtcttcccagaaatttacacaaataagattcagactaacacattatctgtgtatgttaaatcaggatcaggcaccaggccgtctaggtgacatctataaatatttgacattatttcattttcaggctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaaggtgagtctccagctgttttctgttgccagaatcataccttccacagatttggctcataaagtaggaaattccctaaggattccctgagaaaggaggtgtcataggcctgattctcatgcaggcctttaacagagcatctgcttgaattcaaggtgtgctcttctcaacaccctgccccctaattctctgtgtgcatgtgggaacagagcctggaatgatttccctggagtgatgcactcacccttctgagcagtgacctggagacatcacaattgcattacccttcctcacacattctcctaggcagagcagattcaggccacttacgtgtctttagccatctggtaaggaatataagccatttacacttcattctgagggctgggatacacatagtgtttcatagcaatgctggtacacattcaaattggttgctcaggttgctcctccacattaggttatggaaatccacttttgaaagctagctgcaatctctgctttcagttttattacacaagatagatgatcatttgtttcatccaaaattttatcaatctatttttatccaatgagtcagcccttaatatgcatattttagactgatttgaacttgaattctcccacacctgcctggaagccttccaatcattaggctagtacaattgagtgctcagtacaaatatgaaagtggcttcagatagcaaactccagagtctggggtatacaactctagaaactcttttatactatatccatcaacagcaaccacaatgataacagcaataggaatcaccaaaaaatcgttgagtatctgctatgacttgggcattttatatatgttatggatcatcttcaaaaaataataaaaaagaatgattatccccctctcagaaatgaggaatgtgaggagttatgtacctttctcaagatcacacagcttggaaatagtagagttgggtttgcacttgggattgactctgaagtctagggatttctactgtctcatagttccataactgagatccatctttggatatctgaataagcttgtgattcagtggatgaaaagaattactaatagcaaccattatattgcttcatattaattatgaaaccattgtacagctatttaaatattgctatgttttactttccccatgactcttttgcttccctcacctcccaaaagcattagaaggagctattttatagttaaatgtgagttaaatttgctaacaactgtaatgatgttattggctttaacagaaggtcttatactccctccctctccccatgccccatgccgccctgccctgtagcatttatacacagaagcttgggatgctgacaaaacctccatccacgtgatgccagacaccccagatatcctgctggccaagagtaattctgccaatatcagccaagtaagagatttcctgattgttgcttaaacctaagattaattaaaatgctttttccaccgtaacaatttcctttctggaattggcctattaccttcctcaaacactcttattttctgtcgtctattatcccttccctagaaactttacaccaagggatgggatgaatcaaagatgaaggactatgatctgagagcagatgctatttccatcaaaagtgccaaggcctccagggacatcgccagtgacgtgagtaccttccatctaactctctgtgrtctccactgtgctgaacaacccagagggtggctggtgaaccacacactctatagtgatttccacatgtaccttccagtcctacttcctacctctcaagaccattccctttgttgttacagagaataaaaatacattttggcattatagttagagttgctgcagggaatgctttcaccaatgaagatatatgattacattacaattatttttaaaacagtataaaacattgcttttaaatataatagttcagagatgccaaaatgtttgtaatataaaatcttgtccatttcatgttgtctgtaattgtcagcacatgagcatggttttaaaactggatgtctccacctgtatttctggcattttagtacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgtacgtaacatgaattttgggaaagggggaaggggaagatgtagatttgttcattgcccagtcagtgcctctgaggacagtcccctgggctgtgcactgcacaaacctsggggtggggctgggggtaccattcacattgtttaatataaaatccatctttagtagtaacttctggcaatgaaaacatatttcagacaaatataaatcatctgaatgtttttaaaataattgttgctattatgctagatccaaaacactaaacagcatttccttgggtcaattgccacaggattaaaatggaatctaattcagcaaaattttcctttaaaaattttcaactataaaattttttgaaatatcaaataattatattatggaattcagctttattactatatatattattattcatggctagtataaataattatgtttttacaagtgacttctgtgatcaatattaaaaaccctcaatcatgtgagatctcaggtcttacttttttggaagtacaatctcctgcacctatcccttcaaccccatgtgctttatttttcagctaaagatttgtatgtctaacacttgaaatgttttttccttttttttttctttttttttgaaatggagtttcactctcattgcccaggctggagtgcagtctccaattgcactccatcccttaaaaaaaatttttttaaatgttagcactcacgacttcaacttatgatcacaaaagggatttccagtgtcacaatgatgtactttcatgttttatttttgctttgccgttgcatgtactcagagtttcagtgctgaaagcctgcaccttgcctctcatacaatctttgcctattttttcattaaatgttgacatttaccttttttttttttttttttttttttgtgagacggaggtttgctcttgttgcccaggctggagtgcaatggcacagtctcggctcactgcaagctctgcctcccgggttcaagcgattctcctgcctcagcctcccaagtagctgggattacaggcatgcgccaccatgcccggctaatttttgtatttttagtagagatggggtttcaccatgttggtcagaaatggtatttttgtctgacatcttctttatagagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgaggtaagaaccatcctactatcttttccaaagataccacccaaactgagcccgtagactggacttcttcaaagaattttggtgagacgagcaactctaaaaatgtcttcactagtgcagatacactgaaaatagaactctgacaaacaccaacatgcctttcttctaccacacatacacacttttgaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctccaaaaacacaacataaaacttataggatacacgtagagtaatacctagttctcaggttttagtgggccatccatcattgctttttccttgtaaaagccaagcaatatgtttttttctgatttttacatgatttattatctcctaagtttccttcttcaaaaaataattattgggagagagctttactaaatgtcattaaaaatctactggaattcaagctcaatatgaaaccagactctttcataaatcttaaggagacattaatgttcagtgtaactgtaaatatctatttttaaatacatcagtaatgctgactcagtagctccctcttcagactgactgtggcattgcactctctgtttgcagaaacgctatcagcaagcttgggaagatgtcaagatgactggttatgacctgcgagcagatgccattgggatccagcatgccaaggcttccagggatattgccagtgacgtaagagctcctccttcccaaccggaacaaacactaactagtagaaatagagggagtttaacttaatgccctttgaattatatttaaatggaattgggtcattgttattagtatatttgtaaatcctaaattcaagaacaactcttacaatrtgaggatccttttgcarctatgtttggttctgcaactcttgcgtttaagcacagattttgattttcttttcaatatcttcacaatgtcacttaatttacaagtacttaaagagatttaatttcatagtacagagaattctgttgttactcaaagtgtggcgtgtatactaccggtgtttcctataataattttatgtagtacatgcacaagtatttttttaaaatagttatatggttgttttaatgtgtgctagaaatacactgtttttttccacgtagatagggttatacatttttaaataaaattttaaaataagtttataattaaaaattatttcaggcaaggcatggtggctcatgcctgtaatcccagcattttgggaggccaaggcgggtggatcacttgaggtcaggagttcgagaccagcctggccaacacggtgaaaccctgtctctactaaaaatacaaaaattagctgggcatggtggcggatgcctgtaatcccagctactggggaggcagaggcaggagaatcacttgaacccaggaggtggagattgcaagtgagccgagatcgtgctactgcactctagcctggggagcagagcgagactctgtctcaaaaaaaaaaagaaaagaaaagtaaaataaaaaaaatttcaacaaagaattaatttgatttaaagtaataagaagtacaactggtacttgtgtgtgacaaaacatctgaaggtggccaggctatattgggagataatccagcaacacagttcttgcctaagagatgctctcaatgttttcatgcatgtagacacagaagacaaaccaatgtatcaaaacttatggcttgaatttaaataaaaacagtattccccgacccccccaaaaaaggtaaactaagggagatggagttagtttgagtaggctctctagaaaaagtgggtttggaaaaattactcttctattttctgttcacatctaccagtatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacgtaagtgtgtcccccaggaaacaagtcccccattgctttgcctgatggctccttccaatgctctgaaaacacaactctctgtacgtaggcactccactttattattattttatcagaattattaattgcctacctacagccaggtttcttcagaaagttttcattgttaaaggtgctaccagaattttcctatagatttgttaatgtgtacagtgtttccagtttcttactttttttttttttttttttttttttttgagatggagtcttgctctgtcacccaggctggagtgcagtggtgcaatctcagcccactgcaacctccgcctcccaggttcaagcgatgttcctgcatcagcctcccaagtagctgggattacaggcatgtgcaccacacccagctgatttttgtatttttattagagacaggtctttgccatcttggccaggctggttttgaactcctgaccgcaggtgatccacccgtctcagccttccaaagttctgggattacagaagtgagccaccatgcccagccttgcccgcccttccttccttccttccttcattccttccttcgttccttccttctctccttccttccttccttccctccttccttccttccttccctccttctctccttccttccttccttccctccttccctccttgtctctttccctccttccctccttcccttgccctgtggccctggctggagtctcagctcactgcaacctctgcctcccgggttcaagcgattcttctgcctcagcctcccaagtagctgggattacaagcacatgccaccacagtcggctgatttttttattttttagtagaggcagggtttcatcatgttggccaggctggtctcaaacccctgacctcaggtgatccacctgccttggcctcccaaagtgctggggcagtttcttaaacagaagaatgtccatggtccttcagctatgaatcaaagaagggcaggaccatcttcctcaaacttaatttgaaaagttagcagcacactccagaccacttgtttccttttacttgacgttcttcacaatgtggtctttcattaactcacctaaggcatttttagatttactcgtattttccgcccttcaaacttttggaaatgatggattacagaaggttatttatttcctgtatagaatggataacttaaaaattatctgaccttggttcccttaagcttccagaggtacttttttataatgaatgagttcattacaggaaagcatgctcatcacttaaaatgcattgccaagtggtatatttaagacagtttctggagaccaaaattgtggaagtagtgatcgaattcttaatcatccttttaaaaatacttattaaacacaccatgtgccaggcattgtgctaagcactaaagataccatggtgaataaagaagaagaaaaaacatgacataggctgggcgctgtggctcacacctgtaatctcagcactttggggaggctgaggtgggtggatcacaaggtccagantttcaagatcagcctgaccaacatggtgaaaccctgtctttactaaaaacacaaaaattagcctggcgtggtggcatgtgcctgtaatcccagctacacaggaggctgaggcaggagaatcgtttgaacctaggaggcagaggttgcagtgagccgagattgccactgcactccagcctgggtggcagagtgagactccgtctcaaaggcaaacaaaaaacatgacagctcctgactttagggagttcacattgataaccgagacctagatgttcattaaagaataaaaatggaatggctgagagtgatccatggtgctatgaagagagatcgagaaagttcttctgagaaggcactgattttacagagatatgaaggaagaatagaagttgggttggttaggaggacatggggcattccttcagggtgaccaacatgtgcaaagagggctgatgagactacgaattgaaagacaggctgtgtgatcaggacacacagggccaatggaagtacagatgacacgaggctggaagaataggtggggactggtgccagaccattcatcccttctagtctgtgtcagggattttgatgtttatcctatgaccgatgggaagccataggatgggggaatgttgtgacatcggatttgaattctgaattttgaaaagatcattctggctgctgtgtagagaacttactagaaagcccattattgttgctttaaagtctgcattggtaatggtatgatgataacctaaatattattcagaagtcttccatgcagtccctcaaatggagagctgcttctgcatcactttgccttttagaatgcacatgggcactaccacacagacccttgccacagaaaaccaagcaaaatgaaatgccattgtgcatttgaggaattatgtttgtcaggctagtgctctgttttaattattgtttgtggaagataaaataaaagaggcctggcgtagtggctcatgcctgtaatcccagcattttgggaggccaaggtgggtggatcacctgaggtcaggggtttgagaccagcctggctagcatggtgaaactccgtctctactaaaaaaaatacaaaaattagacaggcatcatggcacgtgcctgtagtctcaactactcgggaggctgaggcaggagaattgcttgaacttggaaaggggagtttgtagtgagctgagattgtgccattgcactccagcctgggtgacagaatgagactctgtctcaaaaaaaaaaaaaaaaaaaaaaaaaaaaaaaaatatatatatatatatatatatatatatatatgtatttatgttatatatattttatgttgtatatataatatatacacacacaacataaaaactgtccttattttaccacacacatacacaacaaaacacaaaccctgcttctacctgtgttttctttttcaggccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattgtgagttagtttttctctattaaaattgaattaatgccataaatagatgagaaagaataaacctggtcatttattttagaataataaaaactttattaataacaaaaattttattaagtaatacagtattgtcttggtttgcttattaattttaagcaaaaactctaataaaagggaataatayagattttatatcaaatttgagtaacttacgtgaaaagattccagaaatctttgccctaacatgaaagggttttggatcaaatccaaaagaaaatttaaaagttgcatagtgggactagcaacatgaaaattgtgaagtaattttattatttttgtttctttccacagccraagtacagagaggtttgggacaaggataaaacttcaatacacataatgccagatactccagaaattaatctcgctagagcaaatgctcttaatgtgagcaatgtaagtactacaacagactctctttttgtttggaaagttacccagtcagggctatactatgagcatggaagggagggaagatggactcggtccctgacttcccgcaacaggggaagactccttgtggtcaccccttgactaggagtgaggcaaggaggagatccctggtgattcactgggcaaggccagttactggtgagtcaatatctccacaacaaaagtctctttagttgtcctttttgaataaggggacaaagaaggtgaaagacgaatgaagagatgcacaaacaagaaaagagaattaacgatagactcagatagactcaaaataattatgagaagtctttgtaaaaatatatgaattaattttaaaacatggacctcggggggttttctagaaaatcataagtgaccaaaattgacccaaggagaaaaaaccaaaaaacatacagcaagaaattaagaggtttcttaattaagaaattaaggagaacatttaaacacttttcttcctactttcaagtgtcagggtccccttgattatttcaaaacttcaataaataaataaattaccaggagcctagtaaaagaaggaaatccattgcaattaccaaaacttttcaaagatagtgtcacaaattaaaaactatagaccagctgggcatggtggctcatgcctataatcccagtactttgggaggtcaaggccagaggattgcttgagcccaggagttcaagactagtctgggcaacatagggagaccccatctctgcaagaaaataaaaaataaataaattagttgggcaaagtgaggtgcacctgtggcccaagttacttgggaggctcaggtgggaggatcacttgagcccaggaggaagaggctgcagtgagccataatcatgccactgcagtccagcctgggtgacagggcaagaccctgtctcaaataaataaataaataaataaataaaatttaaactgtagaccaataatggggggaatcttaaatattaataaatcaaattcagcattacattaaaatgataagatataatcaactggggttcatgcaggaatgccaagagggccccatagtcagagacctaatagtgccatagaacaagaagaaaaggctcattttattagatttacatggcatctgacaaaatccaatacccattcttattttttaaaaataaaatcttagttaagaaagaataaatgaatattttctcaacatgactgaaaaataaatctcaaatcaaaggccaactcatcctcagtgaccaaacttctcattcatatcaggattaaaatgagggtgcccctaatatcatcattatttaacatttgctggaagtattggctaagtgagtgagattctcattgatgctaatataattactcaagagtaagaacatgcctggcgcgatggctcacgcctgtaatcccagcactttgggaggccaaggcaggcgaatcacgaggtcaggagatcgagaccatcctgcctaacacggtgaaaccctgtctctactaaaaatacaaaaaattagctgggcgtggtggtgggtgcctgtagtcccagctactcaggagactgaggcaggagaatggcgtgaaacccaggaggcggagctagcagtaagccgagatcacgccactgtactccagcgtgggcgacagagcgagactctgtcttaaaaaacaaacaaacaaacaaaaaagagtaagaacagaagataaatattggaaagaaagaggccaaattatcattatttgcagaagaagtcattttaagtcttaaaaaagagaatcaactgaggaaaaaaaaaactatttgtgagtacaagataatccagttacgtggctggctacacaattcaagaaagttcaaggaagataccattttcatggatcgcagaaattacttgtgtgtagaatagtatgacctcagaagaagaaggatactaccttagtgcaatttgccaaggcttgaaactttgcatgctttcaaaagaataatatgtctttgtgagagaaggaggctgccagcaaagattcctcaccatgtgccaaacagctctataagttctggtataatgagccacttggggactaatgttttccagtgtttaagaagaaaatataattttagggcgctgatgtattttctcttttggaccagatatcaatatcatggtgcagcgcattcttgtcaagaggctgaatcaaggggtagtcagttcttcactgcagtatagacgcctcttcccactcaatccataggcatctgtggcaggagaattctggaaagtcacatatgctctcttttgcatgataaatttctcagctgaaaacaccagaaccttaccattgatattatatgaacaagactaatattcaaaattatgctaaaagtaaaattattaactttattaagatattaatgagaatgacttccattttggaagaaatcaaacaccccatttgaatgctaaccaaactatacagcattttctttacaartgtatcaccattactgtaatcttgattaaacccacaatttaaaactgctgccgttatttagaaagcacaactttagcagaatatttgtatgtgattttatgggtaacaaagcaaattcacgttaaagtgactcatgtaatcttcatgctcactacattgagtaagatattgttattttgtttttatcagatggtaaattgagatttttaaaagttaagaaattttcccatgttctcaaagttagtagctgaaaacattgggtctcaggccccgggctttttttttttttttttagttaaaaatatatacatacttggctgggcatggtggctcatgcctgtaatcccagcactttgggaggctgaggagggtggatcacttgaggccagagttcgagaccagcctggccaacgtgatgaatgaaaccccatctctactaaaaatacaaaaaatagccaggcatagtggtggctcacctgtaatcccagctacttgggtggctgaggcmcaagaatcgtttgaacctaggaggcagaggttgcagygagctgagatcgtgccacttcactccagcttgggtgacagagcgagactctgtcaaaaaaaaaaaagtatatatatatatacttttatatatatattttatatatatatataaatattcaatatatataaatattcaatatatatattcaatctcataaaaagcattacataagaaatagtgtgaaaatgtgcataataaaatagaatgaaaacaaaaagtaaaaagataacataatacacgtttgcattaactattttgtagtttaattaattaattactttatttatttattttttgagagggagtcttgctctgtcacccaggctggagtacagtggcgtgatctcagcttgctgaaacttctgcctcccgggttcaagcgatgctcctgcctcagcatctctagtagctgggattacaggtgtgtgccaccacacccagctaatttgtgtatttttaatagagacaaggtttcaccatgttggctaggctggtctcaaactcctgacttcaagtgatccacctgcctcggcctcccaaagtgctgggattataggcgtaagccactgcacccagcccttcttgtacattttaatatggagaatattttttcttctgtacagaaaacaagtcagttgtcaaaataggcctactcaaaatttatacaaaagcttgattgaaaattcatataaaacctgtccatgcttacaaggataaaatttgagcactcatttttcagacatgcaaaagctacaaaactgtcactaattaaaatccacttctttctgtgctgtagaagatcccctactgataggtatgatttgtgaattatatgtttaaattactattatttccgagtctctctgttatttgttaatacacaatgtatccattaaaatatgaacatatatttacatacatttttaaaatacttgtaaatcagtcactactttagttaacttctctttacaaccaaaaaaatagctgtgacatccaatcatgcttcagcggaagatctaacattaccaaatgatatggatcattaatcatataagatcaaaaaagccatattgaaaaaaacccacaaatgtaacaagtttacaattctgaaggttacaaaactgaattgaattagagataaataaattgaattattgcattaaagaaattcaataacccattaatgtctaaagttatctcaatgttaccaatacaccaacacaagaaaacaaagccaaaccctttttatgaacgagattataaagcatgagcaactacttcaaggctatcattcaaatttaaaatttattgtacatttgaaaacaactgaaagaatattattggagcactttgggaggccgaggcaggtggatcacctgagggtcaggagtttgagaccagcctgaccaacatggagaaaccctgtctctactaaaaatacaaaattagctgggcctggtggcgcatgcctgtaatcccagctactcgggaggctgaggaaggagaatggcttgagcctgggaggcagagtttggggtgagccgagatggtgccattgccctccagcctgggcaacaagagcgaaactccgtctcaaaaaaaaagaaaaagagtataattggaatgtttatgacacagacatgataaatgcttgaggtggtggatacccagttatcctcatgtgactattacccattgtatgcctatattaaaatatctcatgcaccctataaatatgtatatacctactatgtacccataaaaataaaatataaaacattaaaaataataaaaacaaaagaaaggagattgtcaagcccagacctttggactccagacaccattacatgttccaggacaatggtgcatagaatgattctcayctatgctcttctttaactgctctcaagtccttgggcttcaaaactgtgcccctgtggtattaattccacctgagccattgaaggtattggcaaatttgaatctaggatgataccttatttttctccttttcagaaactttaccgtgagggctgggatgaaatgaaggcgggctgtgatgtccggctggatgccatccccatccaggctgccaaggcctccagggagattgccagtgacgtgagtggccttttttaacttctcagtttttttttttcagccgatgccctaggtgcatcaagaggacatgctgtgacccatctgctttatttttgcatctccagtataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgatgtgagtgggctgcatttggggttgaactcttwtctcagtttgccatgacttccagagagtttatgacactaaccccttctgtcatcattttacgacttcatatcaccaagaatttaatattagtgagaccttatagtatggtatcaaaatcaccaaatccaagaaggacctggactttatatcaagaaataaatggtagtatgaatacaggtcttaattgtatcagattaaagaaaactgtgaaartattctttctatagaatttagatagcaatagaggcttatatccagtaaaatattggcagcccatggacaggatgtaggcacagacatgcttttttaattgatacagtgtttagaaattttgaattaagttgccaagattttaaaatccaaaawtttttgtgtacaaatgtcggatttcccatttctcttggaaattcagaggacacagctctgaattatcccttagtaacaataaccagaatggaatcaaggataaccccctttaaataaaaatatatgctatcgtttgtcacactgcctggccgcctaattaattttcttacattacctgcgtggctgcttgagtatgtcctccttggcttatatagcatttacattgtatttcttcatgagaccaatggataggctaactaggaccacatgaccagggttgctgaactcattctggccctgttttcacagaatgtttacaaggctgacttggaatggttgcgtggaattgggtggatgccaaatgactccgtgtccgtcaatcatgccaaacatgccgcggacatcttcagtgaggtattccaagattttaccctgacattcagtacatttcccaagaaagtgacaaaatgcacaagctaaaatatagtcatctaatatcagcartcttaaccatttcaattgctgtgatttaaactgagcatatatatttttcaaaatgtactgtcgctatcacattatgggaccacatccataatataatatccagcacactcactgatgcttggcattgtataaatggaaaaatctttttgtcagcaatagcaatatacttgggaaaagtttgtttcgttggaaaaatgtgcattacagtacacataatgatacattatataactttgagagctaagcaaacttcctactttaaaatctgtgggaggcataagaagctgatgcatttgtttaaaaaataaaatgctaaaaagaaagccaaattcccaagaagacgctattcaaatacggcactgtatgtttctagtagagaaggactctaaatttagtgtatcttctcagttcacacatgtctaggaattacaactatctaaaagatgctttctttcccatagaaaaaatatcgcacaaaaatagaaactctcaactttacgcctgtggatgacagagttgattatgtgacagcgaaacaaagtggcgagatcctcgatgatgtaagtatatggctgttttaaaatctcacagtgatgcagatatcacttccaaagcttttccatctacttacactcagaatgcaatcatctgaaatacagattttaatcattgaaatgatggatgctaacaattgcttggacaacatgatgctttcttaacaagtaacttgcccccttgcctctcatttttttttttttagattaaataccggaaagactggaatgccaccaaatcaaagtacaccctcacagaaacccccctgctgcacactgcccaggaggctgctaggatactggaccaggtatgggtttcacccacatgcctggtgtttgtgtacgagtggagggccttaatggaactgtaggataattatgcacacaacttacccctcccttctgactcctcattttaaccctttatggtggctctgtctttcagtatctctacaaggaaggctgggagagacaaaaagccacaggttacattttgcctccagatgctgtgccatttgttcatgcccatcactgcaatgacgttcagagtgaggtaatacatcctgatgggagtgcattttgcaaaagtgggaccttgctcccagggattccagttatgccaaaggcagagatagcaccttccaggtgttcagtttcagtgtggcagacctggccaggcttggtgatggttggagtacctgctcacttttcggtctttcttccatgggctttgagctttcttgtttcttcacccgcccaccaccccccttggcttttttaaaagcaattgttcaaattctttactttttcttatattctctgccctccctaaaatctttaggcctttgaataaaaatattgccagaatcagagaacaagtatatattttttctctatttttattttttaaattttatttttatcatttttagggctatctcagcagaatatttttctatttttaaatgggtgtttcttcatatggatttatttcaatgctttttattatttgctctcagagttgggggtgtcaaacaaaaagctggggggctgaatttgctgatatcccttagtagatgatcaagccccctctgccttgtgtgcttgtcaaaactgatggaatttatattcctcttctcgccagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgatgtaagtgatttttgtttcttcattatctagaaaygcatggtacactctgagaatgatgagcaacatcccagatccayaagtgcttgaaatttgaggccatcgatatttaatttgttcccaaagggaattgaggctggatatgaagaaagatcaggagcagtgatggattgattggtttgcctactgactgcatttctgagtaactttcaatcaaatttttttaaaaaaaatctgctgcttttgtaccattttggccatcagcaactcctcactcacattcacatagaaaagtatcagctgatggaaaataataattggcttgggtgggaattgagaatgagttgaggttttgacaatattagatgatagcacagttaaagacctaagcatgccctattcctgctttgccaagcatctcattcctcacggcatttatgaagttgttcgcaaagcaaaagagaaacaaaatactgattaagctgcatgagggcccagtatgcctcatgcagagctttggtaaagctaggatagagaataagacataacctacctcccactgaagcctgaatcaagatctctacttgccaccagccttctgcatgtgcagaacagtaactggatgcatcaacttagttgcttaggtgcccagagaagctaatgctccctgggtcttctcatcattaacaaaagggaacctggaagtcaaagactgctgcagcatagatgttgaacttgaacatctgacctcactggttgctgcagcaaaatagctgttgtggaacttaaatcagaatagcaactcttcttattttcatgtcgagttggctgggagaatctaggttcttgaaggcgtaagggcaagaataggtttggctgggacccaggggatgcctcccctacccaatacgtgaatatttacttgtgtagtttccctcatttagtctaaatgccccacatacttctacgtgactaaatgtatcaaatccatctaaaagtacaacctccttggtaagccttttcttatgacgatagcagaaaataacagccccttcccctcaactccaatagcatttgagcactcgatctaacagcacttcttgctttataaatgacttatctcaactcctagactccttctttatacttattcatcaaaacaccaagcatagtgcctcatgcacagtaacagcctcaagaaatattgctcaggtgaaatcacaattgaatgaatgagaaaactactagagagaaatcctttaaaagcttctgaaaaaattgtaacctgccctctgtaagcctgtgtctcagtcatttattcctccattatatctctcttcctgctctcagaatgtctacagagctgacctggagtggctccgaggcattggctggatcccactggattctgtggaccatgtaagggttactaagaaccaggaaatgatgagtcaggtacgcaaagcctattctccttctaacctatgcctgtcctcctacctgccatgttggggtagataacctgtggtggtagacctgtcttaattgtctccgtttctttacagatcaaatataagaaaaatgcccttgaaaactaycctaactttasaagtgtggtggatcctccagagattgttttagccaagattaattctgtcaatcaaagtgatgtaagtttgctttgtgcatgctgaagtgcacagactggggagtaaattgtctatcattgggtggattagcttaacttnagataattgcttgtaaaaaaattgggaggtggtaaattctaagatcatctttggggggtatgtcttaaaagtcactagcaggtggtgaattgtattcacttttagatatctatattcctatccaaattattctattgttttagctaaaatgggctaaaattcaaccagttggttagttttaatctttaaacgtggactgattatgtttctaggtaatcttataaaaatttaatattcatttatagtaataaaagatttggttttctctccttaggtaaaatataaagaaacatttaataaagcaaagggcaaatatacgttttcaccagatacaccacrtatctcccactccaaagacatgggaaaactctacagtactgtaagttctcttttatgtaataaccactcaatttctaatttgaagctcttgttgcattcatattcttggctgattttgtcaactgctgaacttataagccaatctattatttattttcccattgcacttagtcttgtgtattagaagtaccatgttattcaaggcaaatagcgtttattcagctggtgcttttgagctcccgtgatgtgccgggctctttaggaggcaatgaggggctaaagctcaatgagacaagccttcaggagatcgtgcaagtgaggggaacagacttaaattgatagaataataatctaacaagtgctctgggggcacatagcattgagcacctaccaatagagaaaagggaggtaaggttggtccctctttagtaatcacgcatcagcatctctagccaacaagaggagaacttgccctccaaaatttcattcagctaatttaaaggagaccaatagtgtacatgtgtgcacccaatgggaaagaatatttgccagttctctccctgtgtgcaaatttgttgtcacttttactaggaccgcaaaaatagtcaactcttataaaatgcctagagttggctgggcatggtggctcacgcctataatcccagcactttgggagggtgaggttggtagatcacctgaggtcaggagttagaccagcttggccaacacggtgaaaccccatctctactaaaaatacaaaaattagccaggcatagtggtgcgtgcgtgtaatcccagctactctggaggctgagacaggagaatctcttgaacccaggaggtagagtttgcagtgagcttagatcacggcactgcactccagcctgggtgatggagcaagattctgtctcaaaaaacataaaaataaaataaaataaaataaaataaaaaataaaatgcctcgagtctgtaagtttaatttgcaataaaccaaataactgccctattctaggtagatgcactaatggctatagataaagatttcagccttgccttgaacatacatgtttcaccttaattagaccaattgttttagtggtatctgaaagaagttgaaagaaaacttttgttgccatgtatttctttgttctagatactgtataaaggggcgtgggagggcaccaaggcctatggctacaccctgratgagcgctacattcccattgttggagccaagcatgctgatctggtgaacagtgaggtcagtatgaccttttcctctcctaagtttgagagtctttactggggatcaaggggctggttaggaaactccagcgattctcaatgtttaacccactttacagcttaaatacaaagagacatatgagaagcagaaaggtcactacctggctggaaaagtgatcggtgaattccctgrtgtggttcactgtctggatttccaaaagatgaggagtgcggtaagtaaatgtccactttaacacgggatttgtgccccataagtgtgctgccrtgtctgcctgtttataacttgccctttggttcaggttagctgggaaatggagtagcgtagggtccttcctgagattttcctcacccctccaagtcagcctgtggactcttggtagctgtgtgcttcctccctgccactttctccctgactatttaacactgtgactgctttgtgttcagaaaaggaaaaagcatcaaggtcactatttaccctgtgttataaaaggatggaaaacttcaggccaggtgaaatggctcacacctgtaatcccagcactttggaggccaaggcaggcagatcaccagaggtcaggagttcgagactggcctggccaacatggtgaaacctcatctctactaaaaatacaaaaattagctgggcgtggtggtgcatgcctgtaattctagttactctggatgctgaggcatgagaattatttgaacccaggaggcagaggttgcagtgagtggagatcacaccattgcaatccagtctgggcaacagagtaggacaccatctcaaaaaaaaaaaaaaaaaaaaagatgggaaatttcaaaagaagaagaatatattaaagtatataaagtatatatatataaagtataaagaatataataaagtatatattaaccttagtttattctagagatactgatctatatgggaaataaggatctaaaagacattgatctgaataatttacatttaaacccctttcttatttttgtctttaaaacatattagttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgatgtatgatgtcccttctgcagcttgactcagctacagcttccatgactgtgtcttggctaccccccaaccctggctgccatgctcccgttgtccctgtattcataaatcttgctgcttctcaaaacaaagtggcatgagccactttttggtataagaatccaccctaagccataggacacatatgttaaatatttaattggtttcacaatagactcagacattgatattgctctcaagcttctttaggcttgggaattaaagaccttccagctggtgagaggcctaccctatgtcttctaagcaataagcacagccaacagctgataggaaattatcaaatgctcaattgtaaattcagaataccttccacatttcattgttctctctttcttgcagaatgtgtataaagatgacctgaattggttgaaaggcattggttgctacgtttgggatacaccccaaatcctccatgccaagaaatcatacgaccttcagagtcaggtgagccaccttcctagaaggactggttctccatgggtcatcrgaatccatggtggtgtcagtgggctgatgggcaggcaaagaaagttgctgtaacagtgtaggctctaactgaccaaagcccctcctctcccartcaaagctcttctagtgtcctgctctggggctggatcttcccagtctgagtctctcctttggtttaaggcaatgcacatttataataaaagcttatctgggaggtgtttcttagtgaactactctcaagcatctgtaccttagttgatcaagttaacttgcagagagtaggaggtagaagcatcctttgattacaggtagataagttttggaggaaaaagatcagtatctggaaaacttttcagcacgtggttcagctctgatagggcagttgtaatggaatgttaaaagtgaggggcatgtatacatatgtaactaacctgcacattgtgcacatgtaccctaaaacttaaagtataataataaaaaaaaaaaagtgttcgaaaccaaaaaaaaaaaaaagtgaggggctgctgtcagggatggagaataggcatggaaaaggcaacaaaatggccaaaatctcraccccagtctcagtcaagagaarctattcattctggcagccatacaaagtctgcaggactctagaatgacagcctgtttgttaggattaaagcagaaatccagaaataaaggcacatgtaagttggcacaagcagctacagctgatgacagacctgtatgttaccatttttgatgacttttgtttytcttcacagctacaatatacagcagcaggtaaagaaaatctacaaaactataatctggtcacagacacgcccctctatgtgactgctgttcagagtggcattaatgccagtgaggtgcgtcttcctgtactcctcttccagggacaaactatttyttgtctttatgtattttctaacaacagaggtgaataacctattgttgcttgtytacaggtaaaatataaagaaaattatcatcagattaaggacaaatacacaacagttctagaaacagtggattatgacagaaccagaaacctgaagaatctttacagcagtgtgagttgagttttttttcccccttatatatgagccacctttcccmcttctgggacagtaagagaataaatgggatggacactctttccctaaaggcttttctatggttttttcctggaccttcaatcttactttacctcataaaattctagtaggtacaattaaataagccccaccttaaagaggagtcctgggagttagtagggagtgtgtgagaaggacagacacagaaggaaaacctgctactcagaagctaaccagatgcattttcccatattcacaagaaggtctttaattcctgcagaacctgtacaaggaggcctgggatagagtgaaagccaccagctacatcctgccttccagcaccttgtccctgacacacgccaagaaccagaagcatctggccagccatgtaagtaaagcaaaaacatgacagctttcccaccctccctcycctcccctgctctccactccaagaatctttcaggctgattcatacgttgtccagaagtacccctagcactcccgtgggcatgtccaggaaataattccaaatgctcagtcattagagtctatgtgctcactgcctgtctctctctgctgcctggagagaatcacaagcacttgcaaagaggacaggatgtgacctttcagactgcctgtctgcacatgataatctctgctagagtcagaagtaaggatgggctgaagacataatacaccttacagaaatagactttttcaatagaattacatggatgtagggcaaaaataaaccagtgaatatgataaccggttattataccatccccagttaatataaattattttatagcaatgaaatagaaaacatttaaaaattgtttaattctccttttttaggtagaacttttcttagatataaacataattgtaaaacaaacaaaccctaaatctcatgagctgtttaaatatagtagaagatcatacatcctctaactctttatgcctttaaatcttatgacctctaaccattaatgttcttaagtaaaacctttttgcgtgtgtgtgttttgttttggtttattatactttaagttctggggtacacgtgcagaacgtggaggtttattacataggtatacatatgccatggtggtttgctgcacccatcaacccatcatctacattaggtatttctcctaatgctatccctcccctagccccctactccctgagaggacccagtgtgtgatgttcccctccctgtgtccatgtgttctcactgttcaacccccacttacgagtgagaacatgcagtgtttggttttctgttcttgtgttagtttgctgagaatgatggtttaaaacttcatccatgtccctgcaaaggacatgaactcatcttttttatggctgcatagtattccatggtgtatatatgccatattttctttatccagtctatcattgatgggcatttgggttggttccaagactttgctatggtgaagagtgctgcaataaacatacgtgtgcatgtgtctttatagtagaatgatttataatccattgggtatatacccagtaatgggattgctgggtcaaatggtatttctagttctagatccttgaggaatcaccacactgtcttccacaatggttgaactagtttacactcccaccaacagtgtaaaagtcttcctatttctttacatcctctccagcatctgttgtttcctgactttgtaatgatcaccattctaactggcgtgagatggtatctcattgtggttttgatttgcatttctctaatgaccagtgatgatgagcattttttcatatatttgttggccgcataaatgtcttcttttgagaagtgtctgttcatatccttcrcctactttttgatggggttgtttgtttttttcttgtaaatttgtttaagttctttgtagattctggatagtagcccattgtcagatggatagattgcagaaattttttcccattctgtaggttgccttttcactctgatagtagtttcttttgctgtgcagaagttctttagtttaattagattccaatggcctttgttgccattgcttttggtgtttcagtcatgaagtgtttgcccatgcctgtgtcctgaaaggtattgcctaggttttcttctggggtttttatggttttaggtcttatgtgtacatttttagtccatcttgagttaatttttgtatgaggtgtaaggaagggatccagtttcagctttctgcatatggctagccagttttcccagcaccattcattaaatagggagtcttctccccatcgcttgtttttgtcagatttgtcaaagatcagatgattgtagatatgtggcgttgtttctgaggcctctgttctgttccattggtctatatatctgttttggtaaaagtaccatggtgtttttattactttagccttgtagtatagtttgaagtcagatagcgtaatgcctccagctttaattttttccaattctgtgaaaaaagtcaatggtagcttgatggggatagcattgaatctatagattaccttgggcagtatggctattttcacgatattgagtcttcctatccatgagcatagaatgtttttccatttgttcgtgtcctctcttagttccttgagcagtggtttgtagttctccttgaagaggtccttcagatcccttgtaagttggattcctaggtattttattatctttgtagcagttgtgaatgggagttcactcatgatttggctctctgttttttactggtatataggaatgcttgtgatttttgcacattgattttgtattctgagactttgctgaagttgcttatcagcttaaggagattttgggctgagacggttgggttttctaaatatataatcaggccatctgcaaacagagacaatttgacttcctcttttcctaattgaataccgtttatttctttctcttgcctcattgccctggccagaacttccaatactatgttgaataggagtggtgagagagggcatccctgtcttgtgccagttttcaaagggaatgcttccagcttttgcccattcagtatgatattggctgtgggtttgttataaatagctcttactattttgagatacattccatcaatacctagtttattgagagtttttagcatgaagagctgttgaattttgtcaaatgccttttctgtatctattgagataatcatgtggtttttgtccttggttctgtttatgtgatagattacatttattgatttgcatatgttgaaccaggcttgcatcccagtgatgaagctgacttgatcaaggtagataagctttttgatgtgctgctggatttggtttgccaatattttattgagtattttcacatcgatgttcatcagggatattggtctaaaattctcttttttggttgtgtctctgcccggctttggtatcaggatgatgccggcctcataaaatgagttagggaggattctctctttttctgttgtttggaatagtttcagaaggaatggtaccagctcctccttgtacctctggtagaatccaggtgtgaatccatctggtcctggactttttttggctgggaggctattaattactgcctcaatttcagaacttgttattggcctattcagggattcgacttcttcctggtttagtcttgggagggtgtatgtgtccaggaatttatccatttcttctagattttctagtttatttgcatagaggtgtttatagtattctctgatggtagtttgtatttctgtgggaacggtggtgatatcccctttatcattttttattgtgtctatttgattcttctttcttttcttctttattagtcttgctagcagtctatctattttgttgatcttttcaaaaaaacagctcctggattcattgatttttttgaagggttttttgtgtctcaatctccttcagttctgctctgatcttaattatttcttgtcttcttctagcttttgaatttgtttgctcttgcttctctagttcttttaattgtgatgttagggtgtcagttttagatctttcctgctttctcttgtgggcatctagtgctataaatttccctctacacactgctttaaatgtgtcccagagattctgagttcaagtcctgatatccttgttaattttctgtctggttgatctgtctagtgtcgacaggaggtgttaaagtctcccactattattgtgttgcattctaagtctctctgtaggtctccaagaacttgttttatgaatatgcgtgctcctgtgttgggtgtgtatatatttaggatagttagctcttcttctttcattgatccctttcccattatgtaatgcccttctttgtctcttttgatctttgttggtttaaagtctgtgtaaaaccttttattgtaaaattccctgtaagctttattgtaattcttagcccagttctccttcagaaaaattagagactttatctcttaatcaggaacattttctgtaacactttaaatcagcatttctcaaacatgttttgaccatgactcacagtgggaaatttattttttatttcaagttcacatacacagacacacacccctgaagtttacctgagtttcttctggcacaaatgtctcacagaagagtagtgactgctagactagagacagtgcactctgataatttccattctgttctactcatttaaatgctagtgactcagtaaattgatttcactactctactgggcttacagatgcacagcttagaaataaacttcattagacagtctatggaattatttaatttttacctggaggaaacagtaacatatttgattttacccagacccacctctatttggaagattacaaaaaggagcaaacttttcattttggaagaaaagtactatagataagattttaaaagctcaaaagaggctttttccttgagtcatgaacaaaattatagaggcaagattcttggcaaattggttttggagcaaggtaaaacatagagaaattaatcctttaaaagaagtattctgaccttattttaggaaaaagttttgtgtgtgtgtatgtgttttttttttttttaacggtgcctttaaatgccatcatctttgaagctgagaaatagattagatgtaagaagctgattttctgttttggaaaaatctagtggaaattttggttggcctccagtcaatgaagagcattgctggaattctgacacaaatatatactcccatctctcttttgttacagaggtgcaaatcgctgagttttggaagaactgttattttattattgtgtgctatgagattggatcttagtctctgtcttaacctggtttatataatcatggaacactaattaacgggcaacatggcttaagaactaattgttatcccacagaagttgattgcactgtatttttgaaagccttgtagaaactgaaatccaaggattgtgttttcttagcagcagacttttcagttattaaaaacaaagatattcctaagcacagttttaatctngcactccttttagtaagaaaaacaaagccattaccacaagagaatatttttaaattacataatctttaaaatgaattgcttgtagtagcagtaaaagtactagtattgctataggaattttgaaaacagcaactaaaatttcatagcgctctgtggtttaaaagtacttttgatacagtctgatttaagccacacgataaccccatggcaggcgctactgctgtatctctctgtacaggtggggaaatgagttcagagaagtgttgtccccaacgctgggtggatctcagagtcgggtttttcccattaagtcttatgctgttttaataatataaatccattactctctaaaactgtttcttcctttctacttattctctatagatcaaatatcgggaagaatatgaaaagttcaaagctctttatacgttaccaagaagtgttgacgatgatccgaacacagcacggtgcctccgagttggcaagcttaacatcgatgtaagtacggtcatgcgccccttaatgactaggatacattctgagaaatgtgccgctcgttatgtgatttcattgttgtgctaacatcatagagtgcacttccacatacctagatgggatagcctattgctcctagactacaaacctgtacagcatgttactgtactgaatactgtaggcaacagtaacacagtggcaagtatttgtgtatctaaacatagaaaaggtacagtaaaaactcagcattataatcttttgactgaaacattgttatgcaacacatgagggtaactccaaagaccttacttcaaatttaagtcaagtaaaatagccatgtattattaataggaacatttcttttcttttctttttaagacaggtctcactctgttgccctggctggagggcagtggtgcaatcacagctcactgcaagcctctacctcttgggctccgggaatcatcccacctcagcctgctgagtaactgggcctacaggcatgcaccaccacacccagctaaggtttttttttgtagcgattggaatctcgttatgttgcccactctggtctcaaactcctgggctcaagcaattctcctgcctcagtctcccatagtgctgggattacaggtgtgagttatcatgcccagcctgaacattttctatttaccaatgcatatgacactgactgtgcacatgtaaagaagctacayattatttcagctataatgctttattttttaaaaattycccttggtgttaatctatagaaaatgtcagaaaataccagtcactgccctgcccccaactgttcgctgtgagttggttagcctgacttctcatgtatggccatgatgccttggcacaatttcctgtataactggcatgtgattttaactttacagcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatgtaagcctgtgacttaagaagtacccctccacggccccgccccacggccccacccagaaggcagcaaactcacccatttctttaccttagcctttttccactatctcttccctatatgtccatttgtccaacttgacttcagagctgtctctggaagcagggctctgtgtacacatgtttctgtggctcccctgagcctctttgcataatgcctttgctcctcattccacaaagccttctgagtctagaatgtacctctgtttttagtgttaaagttattatggtcaattttttttttctgatcctttctatcaaaaccctctagattgtatacaaggatgacctcaactggctgaaaggcattggttgctacgtctgggacactcctgaaatcctccatgccaagcatgcttatgatctacgtgatgatgtgagtttgccttgttttgttctttagtatatttccatttctccatagtctagagttaagaggaggttatgtaaaatagggacattgtcacaggccagctctkgggggtggctgagctggagaaagttgctaggagcagagcaaccatctctcaggaaggcgtatggcattcttattaaactgcagtccaggtgtgccatcgtcctctggtggagaagggaccagcatcttctctttctatgttttaggctattttggatatattaacaagcacttaattgtcattttaggaaagtgtgatttgttagtgtttgcaatgctatagacaagctctatttgtaaagagaggattttccacgcaaattaaatactgtaatgaggatttcagtaagaaagcttaaactttcctagaagagtagttatcaagtgtcctagaagactctagaagccccatataagtgttggttacactgttataaaattcaaatgcatctcngtctgttgagtagtgctgatgaatataaatctcatgagttaaaagcaaccaaaccctctgtgaaaaccagcagtttcaagcataaggaatggtccaacatgggcttgttttcttcctctyggcagatcaagtataaagctcacatgttgaaaacaaggaatgactacaagcttgtcacagatacaccagtctacgtgcaggctgtcaaaagtgggaaacagctaagtgacgtaagtgatcactggggaagttaagtggacagtaataaagcagggccaccactcaagcagaggtggcaaaaaccatagactgggcagtgccaagtcttttctaactgggaaaccagagttggtgcgtttgaaagcactgaagatgctgctggctattgtttcctgaaacctgatgcattcaagcagtttgctggggcggagttgtaggtgatgcgagtctatgaagtaactttgtgccttagcacttccaacgtgttttttgtgccctgtgtcatagcaagtttatttctatctaggccatttaataaattagaaccagctatggtagaataagaagcaagcaggctctggagttagagttgtggagtgcagtctcacctctaccacacattatctataaggcttrtgaaaagcacttaatccatctgagcctcccattctgatgcataaaatggggacgtaaggaagcacccactatgacgcctgacacaaagcaggcagggcaggcacaaagctgctctttctttattaactccacaggttggtaagtcaatatcagatcccgccagtgagtgcaaacattgagacctattattttggaacttctagtggtaaaatgcccacccttcctcttcttgtgcctgggccatctcttctgtttctcagtgtgagtgtccacacgctggctctgatcctgttggacaagccacagtaatgtgtcagatgagttctccaggcaaagggaagcaggctaccgttattttttttaaagaggaacctgggttcccattctctttgcttctaacaatgcttctttctgcaccaggctgtctaccactatgactatgtgcacagtgtcagaggcaaagtggctccaactaccaaaaccgtggatctggaccgggcccttcatgcatacaagctccagagttcggtgagcagtgagaacttgagagtgcccagcagaaatccgttccatcagcctctgtggaagcaagctgagcttgcttcctcttgacctgaccttgtataaatgctgttctattcacatgaggtgaaaaaacaaaaacacagagcataatctatctttcctcctagctgccaggatccccctatggagcaatcaaaccaacataatgggcatgttttagcaatatttacaagttacaaagaagaaagccaatatacattctctgctttcaaaaagctgaaaatcaagataacagagacaaggcctttaacctcaataaaagatgaactagaaattgttgctggaattcagaagagaaagaacctggatcccacctgcatatttaacctacctattctatgttacccaatggtgctgatttggtctcaacttttcatgttatttcccatcttgtgtattaaaaataatttttggccaggtgcggtggttcatgcctgtaatcccagcaatttgggaggctgaggcgggcagatcacctgaggtcaggagttcgagaccagcctggccaacatggtgaaaccccatctctactaaaaatacaaaaaattagccagatatggcagtgcatgcctgtaatcccagctacttgggaggctgaggcaggagaatcttttgaacccagggggcggaggttgcagtgagctgagattgcaccactgcactccagcttgggcaacaggagcaaaactccgtttcaaawaataataataataataataataataataataattttggccaggcacagtggctcatgcctgtaatcccagcactttaggaggtcatggcaggcagatggcttgagcctggagttcaagaccagcctgrgcaacatggtgaaaccctgtctgaacaaaaatacaaaaataaataaattagccaggcatagtggcatgcacctgtggtcccagctacttgggaggttgaggtgaaaagattacctcagcccagggaggtcaaggatgcartgaactgtgatggtgccactgcactacagtctgggtgacacagtgagaccctgtctcaaaaataaaataaaaataatttggtttttcatattttaaatgtaattcttaatcctaaactccaagagacagagtatttaagatcacagacagacactcctccatgtcctccctttctgccatgaacacatgcatcctgacctcttcacggcctgatgtcaacacactgtgtttggaaggggcaggagagggtaatacaaacatgtgcctggctatatcttcgtgatggcttgcatatcatcacctgaggatggagtaatggcagaggtgaaacttggttacctatcttctctgcatttcccaaattcttgctagatgccatacagccaactgggcatatgtttggaagcacagaggaattagwgkttttttttttttttttttttttggagacagggtctcctctgtctcccaggctggagtgcaacggtgcaatcacagctcactgcaatctcaaattcctgggctcaagtgatcctcccaccttagcttcttaagtagctgggactacaggtacacgccaccatgcctggctaattttaaaattttttatagaggtgggatcttgctatgttgtccaggctagtctcaacttctgaccttaagcaatcctcctgccttggcctcccaaagtgttgagattacagatgtcagctaccacacctggccaggaactactttcaataaaccatttcactcattgttctatttttccaaaacaataggtgaagagtaatctgactcattttatgactcttagaatgtatttaattctctcctgaaatcaattcagtgagcataagtgtattaagtatctagtcaaaactgtaacatgagctatatgtgatttgttaagctcagatcagttacttgatgcccgatgtcatttaacctgctcttcctcattcctgcagaatctatacaaaaccagcctgcgcaccctgcccactggatatagacttccaggtgacactcctcacttcaaacacatcaaggacacccgttacatgagcagttatgtgagtggtctcctcctcattgagatgggtctgaaggtggggtggcaggagactcatattaattaatagcctgttctaatcctccagtctcaccctcaaggttcaacctgatagaatgatgggagctggagaggagagacagcatatttttgagggktgctgtgcaattgattccttctgcaattcagcagtgcctgggtagccccatgggttagaacagaatgttcgtgggagccttggctgagggcccatggctgtcatgatgcctctacttctgctggcctcacttagcacagatgcaccctgaattatcccaagccatttattggaaatgcaycttcacacacgcactactgaggtgtggtgatagtattgtcttccttctgctatgtttcactgcagaagatataacatcaccatgtgttcctttgaaaataagacttcttgcctagctgctggctgatatttagctcactacttatcctctgtgcccagttcacagaaggctagaggggtagttaggctcttactacctgtagcttactcaaatgatgaccctcatgttgcccttctccacttttcacaagtactcaactgggacttgatgcatttaccccatggggaaggcttagggaaatcgtggccatcccagtaagtctggcctgcagaccacaatgagccgctggtggaataataagctctccctctgtgctacccttcatattcctgggaatcaaacctagtggccagaaaggacccaataacctgtggctcaataatgtacttccaaagtagacagtcacagatttaataatctaacacctaaaggatgtgttaaaatggttggttaaaatcagtccacgaagctatttgtcagtcttaaatacattctcttgtttcttctttgtattttctaattttctagccacactggggctaaaaataaagatttttctctggcattttgcataccttccgacaaacagatttcacctaggcaaggtcaaattttattcttttcttggcctggttttattttccaacacataattttcaaggcctggattaatattgaaattttgtcaatgacttttctacatacttaatccttaaaaagagcaatttttcaaataaaggtgacatctcttttctatttggagaaatgtaatgttggtccttgtttacccatcattgatctcattctgactttgcttttgcagttcaagtacaaagaagcctatgaacacaycaaggcatatgggtatacacttggccccaaagatgttccatttgtccacgtccggagagtcaacaatgttaccagcgaggtacctgaatgctgattctccaagagacatattgagtttcaatagcyatggctttgtttgaaatgcattaagaattaatcttatttcagttgtaaacttacataccagcaaaaaatgaaaaaggtccttattgtcacattttgatactgatatttcttggtagtggttttttgtatttggtaatgccttggagagactcggttccatagattatgatgcaaaacttttctaaagaaataatttcttcttttgacatttatattcaaaaatctttaataaggttgcattttagtctgactcatgatcctggttttctacaccaactattggtttgcatatctgatcctactatgcaaccatctgatagaaagtggaaggctttgtgctcagaattcttcacctaaatgaaataactctcattttctccttttttcctaatctcaatcattttctatatcctcgatatttcctcccctcttccttatgtaaaatattttattcttgattagtcagtagatgccctcgtcntcccctactaaatgcctgtaatgatatttcctccaacgtagagactgtatcgggaattgtaccacaaactgaaagwcaagatccatacaactcccgatacccctgagatccgccaagtcaagaagacacaagaggctgtcagtgaggtgggtattttcttaggaaagacagggagtagagactagggatgaatgttaatcattcggtctctaatacatatgttttggggtatttttttttctttagttgatctacaaatcagacttcttcaagatgcagggccacatgatctctctgccatacacaccccaagtgatccattgccgctatgtgggagacatcaccagtgatgtaagcatctcgtaggggtctttctggagtagtcttaccaagacgcaggcttgctttcagcagttaaaacaaccagtggtctttraacagccttttctgataagcacttctaaacaaagagtacaagttggaggtaagacagtgtgggagaaggatgccacaattctacagctatggaaacagtaataagaggaccacctggggaagacagaattgccatcattcttgatcactcagtgaccaccattctacattcaacayggaatcattccaactcctcactccctaactccctgtgtggcctccatcccaggtcatgttgagtattttcctctcactcatccctactctgacctcattagcaacttcttgctgccatttttttcattctccttgtatgttctctcctcctaaaagaccaatccattcaatctgttcttttctccaatcaatgttatagtaataaaataatagcagtgttctctcctcagctcagggttagagacttaaatgaaaaaaaacatgacttatttgggtgcaagtaaactaagagtacaaggtagatgaactggctgggcacggtggctcacgcctgtaatcccagcactttgggaggctgaggtgggcagatcacctgaggtcaggagttcgagaccagcctggccaacatggtgaaaccctgtctctactaaaaatacaaaaattagccaggcacgatgatgtacgcctgtaatcccagctactagggaggctgaggcaggagaatcgcttgaactcgggaggcggaggttgcagtcagccaagatcttggcattgcactccagcctgggcaacaagaatgaaactctgtctcaaaaaaaaaaaaaaaaaagtagatgaaccaaaatgaaagacacagtaattaagaagtgttgctactccatcttttgtgtttcctgacttacatttgcttatgaccagctatatttctgtgtttgcctctcagattaaatacaaagaggacttgcaggtcctgaagggatttggctgcttcctgtatgacactcctgacatggtccgctcccggcacctgcggaagctctgggtgagtgcacatcatcacaatgcataattaccccccgcacagctggatgcccccatcaccagcctccagggctaggcagaagggatcttagcctgcagctacttttaaggggaaatttatcattaactcacttgagcagattatcayyttaatgtgatctgtgcctcctatgaaaggtgctgagcttagttaaatracaattgtttttgctcctgcctgggaagacatccaggacacatgaaagccctgctcagcttacacatgccagacatttgaaagacaatatgacatgaatcccttaaatgattaatcaacttgtatttctgtttttttttttttttttaagtctaattacctatacactgataaggcaaggaagatgcgagacaaatacaaagtggtgcttgacactccagaatacagaaaagtgcaagaactgaagacacatctgagtgaggtaaggacgctttacttgtcattgaagtcaatcaaattgaccagtacaaactgaattactccacaaggctcttagttcctctagtgatcgctgttcaggcaactgcggcaggtaaaatatttcccctcttaactgtggaatggctactatgtctaagcaagtcaaccaactgcactttacctcagtttacttattttgcccccttttggtaagatacgcatattcatactggctcttcctatgtctagggctgatgaggggttttgcatgattttatagattagaaagacctttctttttctttttttttttgagatggagttttgctcttgttgcccagtctgaagtgcaatggcgcaatctcggctcactgcaacctctgtctcctgggttcatgcgattctcctgcctcagcctccagagtagctgggattacaggcatgtgccaccacgcctggctaattttgtatttttagtagtgatggggtttctccatgttggccaggctggtctcgaactcccaacctcaggtgatccgcccgcctcagccttccaaagtactggaattacaggcgtgagccaccacgcctggcctagaaataataattttacttattatttttgttgtctctaaacttatttcaaaattttctttctctttaattcctgctatcaggagccccgagcatggcagtgccattggagaagtcttcagtggctccytgctctgctgcccattcagtacaattcagactacttagtttcattttcatctggcattgaggctcctgatatattgcagttatttgtgaatagatctgattctctcacctagagtgttggttccttgatgattggaccccatgttatttacatgtgtcccatagtgccttggccataatagatgtgcatgtttgccaaagggcatttcacaagtgtaaatggttgctcttcttataggtcagttggccattctcattctactgtcactctggtattgtagctccattcatcagtttgtgcattcaccattctgtattgtggcttcacccagctgagcattggcttccaggccatttcatccttctcagtagctctgatggctgctgattaggaatcttaggctcttagcgatgccctgaaataccaaatgtcaccctcagtggagggatatgcagcttcctacactcagtgagccagaatcagaggatgactaactcttcagcttttgcaaatgcaacattgagccaatttgctttcctaaaagcttcactgtgttatttcagcccgcactcgcactcagactagaacgcttacgttatttttatcctgctaaagttgtgcttttccactctggctcagtatgagaatcacctgtggaatatttaaaatccacccagagagggccctgaccccttgttccacaccagactgattctccgtgtctgggcatctatacacttttagatgctccatagagattctgtttaataatatgtagcctgtgttgaaaaccaccgcaccacatctctcctccagctaccaagtaataatttaaaacaattggtaacttatagtgcttcagagtaaagataactctgaaatacctttactctttttggctttctgggctcagaattatctaaaactttagtttctcctcttcccagttcccagagggattttgggcaagttgtgcatcagcactgaggaagaagaatggatatttttcagtggagcagtttgcaccacatttgcctctccataagaatgacccaggcttgataaaatgctgatccaagccactcccctgaatttagaagggttgggagacagcctacgaatctgtttttaataaaaaccatggagagcgggggagggttaatatcaggaaagtttggaaaacattgagttagtaaaaagtgtgatggccaaaagaagttaccgacttttgagttttcaattgtatagattcttgacatatacacatttgtagtactaggaagcagggacgttgtcccaagaagcataagcaatgcatacctaagtacaggggaaatataatacacagtgaaatgtataattctagaaatggcatagaggccaagcacagtggtacatacctattgtcctagctacttgggaggctgagaccagaggatcactggagtgcaggagtttgaggccagcctgggcaatatagtgagaccccgtctctaaaaatcaatacataaataaaatttaaaaataagaaaaaaattgcttgggagaattgggttttagtcccagatttacttccaattagctatatgatcttatgtaattcacaactttagcaccctaatttcctaaactgaagagttggactaaatgatgatttgagctccttttagccataaaattctaagagttgttgatttactttactcaaaatttagcttggaagaagcattaagttttcatttagtttatctctttcaatagtaacatgaaaaaacagccccaaacacatgagttacattttgttttaacttgcagttgtatataattcagatttaaagaaattgatgtgtgtgcctgtgtttcttacgttttatctgttcaactggtatttatatccatgattagaatttatttggtatccatttgttctttctcatttgccgcattacattaaattccttcaacatttattagcaactattattttttaggccctttgtctgagctctagttgatgaaaggatcgtaccactgaactgctgtgccctagtctcggagaagaaacaggcattggtgtgataaatggctttatataggaacagtcaagacagcatggactcttggagttttccaggcaaataaaagggagaagaacattcaaggcaggaaagacagtctgtgaaagcagccataatgagttccagtaactggggactagtttacatagcacatggagggtgtggaaggatgctggtaaatgaagctattatagaaacatgggttggagccaggttataaagacttgtaggtgttatataaatgaccttggactttatgaaaaatcattgaagaattatttctatgaagaatagatttgagcattaagaaaatatgtgtctcagacttttgaaagatgggtgactcacgtggggtggtccaatagaggagttgagcaggtggttttgacatgtagaaaataagatggaaggctgaactagggcagtggtgttggcaaataatcagatttcaggaatatcacaaagtgaggagcccaggattcatgaccattttgatgtaggaataagggaggagcctaggatgactcccccaagtttctggcccgagtaactgggatatcaacaagtcatttagcaaaatagagaaaataggagaagcagcaatttgagatagagatagaggcaatataaagaattatatattgaacatggtaaatcacctaaattcagaaagttgtagaaaacttgggtctggagctcaggaaagacactggatatgtagatttggaagttatcaatctcaaagtgatgcttgagatcacaggtacagatgagatcaccccgggagaatgtactgggtgaaaggggccaatccttcaccccagttaacagcagcctttgcatgagggcagaaccagaggaaggctgatgaggaggtctaaaagacaggaagccacctagggaagaatggttgaatggaagccagagaagagagttttcaggaatgaaacactgagcagcttcagttgctacagagaagtgttcatggcaatcatgaagttcttggtagtctcaatgagtgtgacttcactgatgtgggtaggtgggagccaaactatggtcttgagaaattaatcaaaagagaggcaaagaagaaacacaggcaacttggctgagaaaagaagaatgaaggccattggctagagactggaaaaggcttaattaatgacaggaggtcttgagtctgtttgcaggtgaanagaggggattgggaaaacaggaagggtggaagatacagaggagatggagacagttgctggaatagggtactagaagggacaactgcaaatgggaccaagaacacagcaggagtcttgaattttggacaggctagagaatgtctcttgttttgacacaagggaaaaaagaaaaggagggtgcaggaggtaaataaaaggttggtttattgggaagaaactgcaatcgttgcagtgggagggctcctgccttttctatgtaaaagcagtgaaggcatctgcagagaacataacatgcccatgaaacagaaatgatggtgataacttggtttatgtctagctggtctacagagctgcaggsaagaagcagaagtcaatctttacttcagttcctgatactcctgatcttttaagagccaagcgagggcagaagcttcagagtcaggtaagctcagaggttcataagcctgccactcaggcatcacagggggtgattatatgtgcctggcctcacctggccagtggcagactcacacacttggttgtcctggctgcaacctcatgcccattaacactgcacttgaagaagcagttctcttttgggccatgataattatggttgtgttttactcaggtaagggatgccacatcttctttcctaagtgttataaaacttgtgttttggagtaatgaaaataattgcttgatcattctatagaatcttcctgttatccgcagacaaacgaagctgtatttcatgcagtcacgcaaaaatcaggggaaaatatgttgaggggtctatcagaatcttctcatacttctgttagcattctttatcacatggctttgcttggatcatactcagtggtaggcatattagataactggagtatgtgtatttgttttcaaatatgagacacagagaaacaaatgaacagaaacgcatataacaaaaaaacaagcaaacaaacatcaggacagtaagcagataccaccttcccactgaatggttagaaatgaatgaagtggactgaatgctaaatactaaatgctttatctctatgacacctcactttcttctattattcagtatctgtatgttgaacttgccaccaaagagagaccccatcatcacgctggaaaccagaccacagccttgaagcatgctaaagaygtgaaggacatggtcagtgaggtaagatgggaattcagcactgaggcactgggtaaaaagaaaaatactttgttaaaaccttcccctgctacctctgatcagagagctcattactataaatggtgctcagcatcatcaaaacacaaaaggcagagctattctcttaaagtgtgtaacacattgtgcccctccacaagacctgtaggtggcttggttggaaattgggaagacacttaagcttgtctctctcttctgcatttatttctcagaaaaagtacaagattcaatatgaaaagatgaaagacaagtacactccggttccagatacgccaatcctcatcagagccaagagggcttactggaatgccagtgatgtatgcatcccttccttttttcttctgttgtgatggggagagctgaggttgaagtacctaagaaacataacatatttcagccatatccatagttctaaaccatggcctaggaaaaaaacacacatttttttaaagagaaaaaaaaatgcccaaacaatactagtcaggcaaaatagctgagagataccagaagcctattcttctcaattctctcctgaataaaaatatgaccctttcttataattcttcagcagcattttctggggatacttgacagttaatttacttatccataaaattatggtcttgcagtcagccagacatggattcaaatcctgatgctgttacttgcctgctgtatgactctatatcatctgtctaatttttccgagtctcttttcatatatgtggaatgataatgagaattgtgataattaaataaaaccaaacaagataatgtataagtgtctagcatgctgctgggctcctagttactcagaaaatgtttgttcccttttttctcttaattgcatatagatcatgtgaatgatgcatgacacagtggttaaaattaggggggacagatgttcattttccatatcacacaatcgagggcaaggctgccttttaatggtaataatctgttaataatctgttaatgaagatgtgaagtagtgaatccaaggtaaatagccaatccttacgggttttgtgtctcagggtccaaccaggaattcactgtacccattaccagagccacacccctagaggactagacatgttgggacttaaactgagccaaaaatcaagccaacttcatgaccccctcaacttagcaacatagctctaggatttcaaggcatcttaaggtaattgcagtaagcccgaggcagaaaagagaaggcacagcaaatgtgaacaatatctcagttccataattttgttaggaatttttatttggagaagagaagagcctactagttagaaaaaggcaatgccagttagtgcttaaaatgtaagctgggaaaaaatcatatactcccctcaaaatctaccttctaggatatttttagtcttcttgtgacatccttcatcattatcacttcaaagttactgttgaatatttatttgaaccaagctgaattaatatcttacagcggtggccacacattgaaattggccctgggattcatcatgccccactggacagcaccatccctagggctttatcagtagcaattctgataactctaatctttacaatagtctaatgtaacaagggtagtatctggcatttaattcagtattaaccatggctagccccacaagtagatctaagcaatcttatgatccatctaaaaaacaaaattacaaagtcaaagaaaagacatctttcactgtgtgtttgctcagttaaccccaaaagaaaagaactgtttgacgttgaaaataggttgtgcagagaagcacccatcttgtgtagattagatgaatcatctatgatattctcaggttagaatcagagctgttttctcttgaaatatcacaaagataaagattataatgaaatgaagttttaagactgcttagtgaagaaggcattttaatactaggagttagaagctaaacctttttcccttttccatgtacattagcatatcttgggctcaacaatgttgtttgtttgggttttttttttctctcaaatgaacttttggtttatgttttatatttaaataaactttctattttaagtagtcttagatttaccgaaattgtacagagttatcacatgccccacacccaggggaacacccatatcctcctgttgctaacacctgtatcaccatcgtagatttgccatgatcagtgaaccaagattgatacattatgatcggttaaactccatagttgctttggatttcattagttttccctagtgttctttttctcttctagggtctgaaataagcttttaaatttttcctaaatgtattcatgggaaaaccagagagaagacaagagagttcatgcttaaaagagctcaattatttaacttggtagtttttttgtaattcatgtgttttttctctttctagctacgctacaaagaaacatttcaaaagaccaaagggaaataccacacggtgaaagatgccctagacattgtctatcatcgcaaagtcacagatgacatcagtaaagtatgtccctaaatatttctacttgtgttgggctctacaactcaccatatacatatacatatattttttagcaacctccctcttctgaaattctccagaaagaagccatatttacattamctttgggtaagacttacagctgtctttgtgttttttataacagataaaatacaaggagaactacatgagccagttgggtatctggaggtccattcctgatcgtccagagcatttccaccaccgagcagtcactgacacagtcagtgatgtgagtgttgacatcttctattttcacatataaattcatattcccatataagctctgaaatcatacatggcataaaaactgaagaaactcttggctagattttagattttgtgtgtggatgtttaaatcataaaactcaattgctaagtgagtgaatttcaacttgggagaaggaaatatatattcaaatttataaacctcatttttctcctaaatgtatgatatcatattacaggactggaagtgatatatatcatctaggaaatagcctattttgatccaatgaagtgacaacttcatgaagcaattaagacacataacaatgctcacttagaaagttcagctctgtgtatgaaaatatagctgccaagctaatgatatactatctaggaaagtatgcctgttaaatttgaattgctttaattagtattaaaaatggaaaacttccatatgttataaaacaatataccaaaggtcagtattactgaaaatgtcttttaaataattgttttaatactttattattttatatacctcaaggggtagtgcttctgtttgttccacttgtatagatactaacttattgctgtttggagatggcttcttagaactctttgatgttcttcttctcccaggtaaaatataaagaagacttgacttggcttaaaggcattggttgctatgcctatgatacccctgatttcactctggctgaaaagaacaagactctctacagcaaggtatatatactcaaggagaattggcctcatccattcgacatatacctgtacccagagagaattagcactgagaaatagtctttcatgtttccatccctatcatggcttctagaccttatagtctgagtacatacttacttgttcactgctaggaaactcttgggttttaatctcattgactgaaggcatttatttgaatttgatgaaaaatcaactctgttcarcccctcatgattcttctagaactctctccttattaatatgtctctgggtggtttctcctattaaagctgatatgacagccaatataaagtgggattattttaatccacaaataatgtatgacgtggggcaaaccacctagtttttatagcctcattttcctatttacaacataaagcaattcaattcacttgcatttgggttgtacaataggatccagcaaactttttcctgaaaaatgccagatagtaaataaaacatctaagaagatgttatgggccagattcattctagggcatattcttctttgtttgttacaatactgtggaatggtgaaacccattctaattcatgaagctgtttaaaaacaggtggcatgctagctgggtcataccccacacctgctcttagaagattatgattatctgattaattactggaaaactcttcaaattaatgtactaaaaaccttcaagtgcacatgaaaatactttcaaagttaaataataattataatatatagaaataaactagacattgatttaaatttttgcccaatatggaaaataaatctatttggcatccattcaatggaagtgttttcgtcgtgtccacttttgggctagttttcaagacatctaggcagttctaccctttactgtcttggaggcagaataaacaatcagtaaatatgtgttagcttggctgggttctgtggctcacacatgtaatcccagcacttgggaggccaaggcaggcggatagcctgagcccaggagtttgagaccagcctgggcaatatgacaaaaccccatctctacaaaatatacgtaaattagccaggcatggtggtgtacaacctgtagtcccacctacttgggaggctgaggtgggaagatcgatggagcctgggaggyggaggttgcagtgagctatgactgtgccttgcagtccagcctgggcaacagagtgaaaccctgtctcaaaacaaacaaacgaatatgtgttagttctatgaattaattatcacaattatatcatatgataaacagcatgtctcattcttaagataatcatagcctgctgtcaagtaaccatgttctgttttttctagtataagtataaagaagtatttgaaaggacaaagtcagatttcaagtatgttgccgactctccgatcaataggcatttcaagtatgcaactcaattgatgaatgaggtatgtatgaataaactgctccaattaagcctattcaattccctaaagaagtctcagagtttttttaaattaaagcccaatacacagaatgacaggaaagccatcctaagttttcattttaactaaagatttggaaaagactctataatgtcaccatccaacaagctctgccaaactacaaataagaacaagtgaagggaccgttcagtggtgggagagccccgcaaacatcagcacctctgcacaaacacagggcagcacagccctgcgggtgacaataccaggcaggtaaaggattttcttgactgtcagcggaactcccttatatattacacaatctatattgtgtagatttggaagacacagaagttcaaggttaatttagtatcctctactaaggcaccaaaatgtcagttgttagaagagctacgctaaaggaatagttgtgattcatgcttcaaagatattgccattgttactcccacatatattggtgcacagaagtatccatctgcacccaaattttttctttctattttatccagcctttcctgtaaccatctttgcaataatttaagttaaatttagctcaagatggctgaaataaacaagctatgaatttatttagttgggatggttttatagttaaagttgtatttaatttcctattttcagattttttacagtttctgtaagttcaaaaattccgtgagaaaattagtacaatatttctaaaaatgaaaatatagccaatggtatatttacttaaatgtatgacttttttgtttgttgtctttacatttgattcagttcactttcagtagatttccagactggacaaccctgaagaattactgccagtagcttcctatgaatacaatcttgatatattttgtttctatttttctatttcatgaagaatttccaggtctcctttataatccaataaattaatagcattagaagactattacaaatttcccgtggatgttttagcatcagttatgctttgagattctcacagcctnagttggtaaagctgtagctgatcagtaccctattttaaatataccgttagatgccataaaacctaatgttgttaatggcatcatatgcaaagatggaaaatgtttgggcacaaggaactctaattttggtgtcataaatctgacctatcccacactccagccttcttcaggtaatcttcctccacttgactctctttgcttccctgtttttattgtcttgggtatgttgggagcccgccactagagatgacatgttctggccctctggagtgtttaccttgagacatttttgtgtagccttgaagttgtactcttgctataatatgctatgatgtttgagcagaaaaaatacagagctgattatgagcagcggaaagataaataccacctggtagtcgatgagcctagacatctgctggctaagaccgcaggcgaccagatcagtcaggtactgtgatggggctggccggtggcccaggcaggactgtgctcccagtttctcatgagatgtcatcccgtctgctgcaaggatgtcataggttctgcctatgatattgggttgttctgtttcaaagtatctgtctagccacccaaaaagcccgtcagctatttgagtgtgccagtccatgctctgtgttctcacttgtgctgtggtgaagatgaaaggaaaagctgggtcctcccatcctttactcttctggagaacctgtttgaaaactgcaactgtaaactgcagattgagttgcaaaagcaaaaaataaacaaacaacaacaaaaaacaaacaaaaattaatggaaggaaagaagacataactccttactatatatctttctattccaaagatgtcttcttttctataaagctattttggtggtaacgtaagtgaaactagctgtatcattccccattcacaaggactatgaatggccaaccgcaagcattgcagtcattctgcttcacattataatgtatttgatgtcttcacccgcacatatgtgagtacataaagtgtgtatgcctacatctcttcactcagaggtgattgggatatagagccgtgttcttttctgtcttcataagtctcttttgtgcttcactgctctttgcatggacagagaaaatataaatctagtgccaagatgtttctgcaacatggatgtaatgaaattctgcgtccagatatgttgactgctctctacaattcgcatatgtggagccaggtaatgtctgatgggatgtgaagaaggaggtttagaagaagtcttggatgcattcccttgtatgctttcattgatttcctcttccactccctgcccatgctggcttcatatggtaaagctatgtaaatattcattccttgtaaatgatctctgaatgtggccaaaggtgatgggacagtggtcatccgtacatcatctgacactttcagaactcttaataaaattaactgattctttcaagtgttatttccaaagtggtataacattaatttatacttttcagtatttgcctcaaagaaatagattccttagagattgaagatagtaagtagattcaacagcatgtaaaaggtctgaatatttaatgttttcatctaatgtgtctcttgttcaattatcactacaactgttgcngggagatgaggattaccgtgcagctctatgaatattgtatatattcatggcgcctcttgactttgatgctgaattgctaggttatttccagcacatctgatcccacacacacaggttaacagtgtctctgataataatgcctttttagaaggccaactgaagcatgcactttccagcacatgctgaaaggtaaatttgatgcagcaataaacagtgataattggtaactaccagacacaatgttagtaataataccatttttcccagaccaaaaaaaaaaagttaattgagctttcctcttagcaacttgttttgtcattttagtttaccatgaaatcaatatgtgaaatgaggaggttaagctccaattaagagcttaacctcctcatttctcctcctataaatatcctgtttgcctgaacttcctcctttgtccttatatgatcctcaaatagttgtgcatgaaattttatggtgctctctgtatctgtcctgcttaaaacagcttctgtgcatgaaaataattatgacttgaaaattgcaaaaacaaatgaattttttaaaatgataaatacttcatatatactcattctttattttacatccctgtttcatctttgacatggaaaaatgcctttggagattgtacatgttcaatacaatatgttatgagtaaaacaatatttgtcagactccagagaacaggttctagtcctgctctgagatttggtctaaatgtgcccttgggtcagtctcgtaacctctgggggcctccgagtacatgtgtataaaacatattggaacttgggaggctgaggcagaagaattgcttgaayctgggaggtggaggttgcagtgagccgagatcgcaccactgcactccagcctrggtgacagagtaagactccrtctcggagggaaacaaaaaaaggaaattattagtagtagtatcatctgctcactccatttcacttttgctatcagacacaaatttatagtaaacatttccagttaggaattaaagagaaagctagataccatctcccactctggtgtttcaagaggacaattagataccttaaagcccactctacaacttcttagagctctttcttctcttccacaatttagatcaaatacaggaaaaactatgaaaaatcaaaggacaaatttacctcaattgtggatactccagaacacctgcgtactacaaaagtcaacaaacaaatcagcgatgtaagtgcaagaaacactgaataccttctcaaactcagggggcatctgcaaacatggaggggcattttaaattgtcacaaagtctgggagactactgccatttagtgggagggaggcaggggtgcgagatgtcctgttatgcacaggattctcctccccaataaagaattgttgtggccgggcgtggtggcttatgcctgtaattccagcactttgggaagccaaggcaggtggatcacttgaggccacgagtttgagaccagcctggccaatatggcaaaaccccatctctactaaaaatataaaaattagccagatgcagtggtgcatgcctgtggtcccagctactcaggaggctgaggcgtgacaattgcttgagcccaggagatggaggttgcagtgaaccaagatcatgccactgcactccagcctgggtggcaaagtgagactctgtctcaaaaaaaaaaaaaaaaaaaaaaaaaagaaagaaaaaaagagagttgttgtgaccaaactggcagacacgccagctggaaacactgaagtcttagcagagagcatgaaagcacctgtcaaattcatagaattctctttcctttatattcactcaggaaaaaactttgcatttatattttgatattatacattgagaagcatgacatgatgtctttctgctttttgatctttcagatcctttataaattggaatacaacaaggccaaacccagaggctacaccacaatccacgacacncccatgttgctgcatgtccgcaaggttaaagatgaagtcagtgatgtaagtactagaatggtttagcagtccctctcatcttggcctccttctaatgagatgtaacaaaccctggtccagttatctattcctgtgtaacaaccaccctaaaacttagtggcttaaaataatagtcatctcttttgctcatgattcggtaagttgactggacacagctgaacagtcctgctccccatgttgctggcagacacctggggctcagtcaagccaggacatccaggtggctcactcccatggctagccattggtgatggctgcgggctgggagctgggctattgtgtagacgagacaggaaccccttcatgtggcctctccacatgcctgggacttctccccagatgggtctccacgtggcttaaacatatcctgaggtactgattttttaaaaatgaatttccacgactttctcctaaagatactgataagtaaattggtaaactaggtctatggcaaagccaggaaaattgtgattcctatgatcagtttagtaaaccccactatggctccctcggaacagtttactttggccttagtcacattaaaacctaggatccttccccaacgattaatgaaaaagcccagatcgaggccctcgaccctgaaatttaagaagagcaaaagtgggtgaagctggaagtcccaggcccaggatggaaaaactgcctgttgggcctgcagatgctaagccttctctgtgcctttccctcctatccaaacccacatataccaaaacttgctaggtatgtctccagcaatgacaatatacagttctatatatttttaaaaggcagaatgattgctrtattcatcagttcattcattcatcaaatattgtctatgtgcctgacactaggaatgagatgatggatgataaacagtttttgcccttaaggggtccttaatggaaagaataggcagattaaaaaaaattataacacgatatgataatagctataactgccggagcacagaaggagagcaagactaattctgtctgggtgagctggtagggaaaggcttctcttccatcagcagttatcaagatgttctgaactcaagatttgctgatttggggaaaggaaaacctgaatgaatagggktccaactggtcctttcagcacaagcacagaaacaaaaattatatggcaggctgggcacagtggctcacacctgtaatcccagcactttgaaaggctgaggtgggcgggatcacctgaggtcacgagttcgagaccagcctggccaacgtggcgaaaccccatctctactaaaatacaaaattagccgggtgaggtggcgcaygcctgtggtcccaggtactcaggaggctgaggcaggagaattgcttgaacctgggaggcggaggttgcagtgagctgagatcacaccattgtactccagcctgggtgacagagagagaatctgttaaaaaaaaaaaaaaaattatatggcaacactgatgaccatagtcagtgtgccctgatctgagataggaaggtgcatctctgcatggctgtatccttgctccacagcagatttttaaaattccgtcttaaggagcattgtgtactatagtcatgcatggatttaatttcttgttttttaagatgctcagtatgctgctataaaaaaattaatcttgtcactgtgtttcctcccacagctgaaatacaaagaagtataccaaagaaataaatccaactgcaccattgagccagatgctgttcatatcaaagcagccaaggacgcctayaaagtcaacaccaatgtaagttccagaaacttccccaagcatggtgggggatttaccagcttctgtaggacacatggcctctttttacatctcttcaggcaattcagctctagtgattgattccaaagcaagagtcaggccccaggagcatgaacaatgatgctaaaatataaatgctgcattggtcctcacaaaggagcatagggaagagcaaaggaagcttcatcccatgccatggatgctacacccactcagcttttgcggtgggtggctgagaaatgggacgtttaattctgaaatgtaggttgcatttttggaaagtgcctgagcatttttcattctctttccctgtgctctcctcctgcctcaaactctacaatctgcttcttctgatgaagaaaacattgagccatttggtgccatcaggcattggcctagaccttcttcctgctcagatattccctgcgttgactctcttcttgggtgcagcatcttaaggcctcaactacagaaataattttgtgcatttagatgagcactgacttcttaaaaatatattaaatggttatacaatgaaaccattgtaaccgaattagtacccactagtgctagaggggacatatatttatgagggctagcaaactggaatccctgtaggagctggcaaagagcttgtacgtatcctgaggatggattgagggcagacggatagaaggacagatgtgagataaagcaaatgcagtaaaacgtaccttgcaaaatccaggttgtatgggtattctctgtaatattcttgcaacatttttgtatgtttgaaatttttcaaaataaaatgaggggaaaaaaaccttattaaatagtatacataaaagcatgtgcattgtattgtgtataaattatacctcaattttaaaaagagagaaagaatgaggaaagaaatgtgcctaatagtgcaggctcctcccaaggacactcaaattaaattacatacacttctgtggctcagatttggcccaatgcagccagttctccagccctgaagggtctaggaagcatgcaagcccctctgcagccagactgcctgggtttaaattccagctccaccaattgctaagtctcaccttgggaagtttacttaacctttctatccagttcttcagctgtctatttcatgcagttgttatgaagattaggtgaattaattttataaaattttataattcatttaattagttttgtaatttgtaaagaacttagaaaagtgcctggcagaaaataaatacctagtgtttgatcatttttggtaaaaattaaacccgaatttagtttgaaattaaaagtactcgattctgaagatgattrggctggactggcagaactagagagattgaagaatcatttcacccggaggcctttaaaaattttagcctctatttcgggaccacagggtcccaacagatgacctctgagtggatgactagctgcataaattgtacagaaatttcaattggggcttcctcttgcattaggaatcatgatttgagatgttttgaaatgcaagagcccctctgtgccatgtgtgtgtttatgaatttagcctactgaatcaagtgattcctttctctcctgttaaaaacagctggactataagaaacagtacgaagccaacaaagcccactggaagtggactcctgaccgaccggacttcctccaggctgccaagtcatccctgcagcaaagcgatgtaagacaggagagacacagacgattgtaactgcatactgcacctgagaaatacaatgaataattatttataataaccactntcatgagtgttaacccttgctcgtttgagatccgagaaggagaggaggatggttgggggagcgataggcgagctcagaacccaaacctgcccatggagcctattctcctttggctgggcctggacacaaatgactgagttctgactgaggctggggagagtctgggggaagactggggatggaggggcttggtcctggcagctaggctgaaaaggaggagtccaaaatgcagtgagggaccaagaagctcttctcctcattctggtagcaagtctttgtcctctccttaagaggactccctgtgtgtttaatcaaatgcccagcttcctcctgtgctgtcacccttcccttttcttctgcctttcttctatcacagtttgaatataagctgraccgggagttcctcaagggttgcaagctttctgtcactgatgacaaaaacacggtgctcgccctcaggaatactttaatagaaagtgatgtaagtacctagttccttccatgatgcctaacctcactcagggccatcttccatggtacagtccccagggacaccagggaaggatggagaagagctgcttccatcagggctcaggtatgggtcctgaattayggcctgtcctgtgaggggcgccagcagtcaagcagggcagcagcagtgcaagggccattagatccaggtgacagtcctcgatttatactgcaccagcagagagttcacacagcaggaattaggaccctgaaggcctggctggactctttatggaaacgccatgatttgttttctatgggatcatactttcccttcactacagtttcctcctctgtaaagacggaataataatgggctcatggagggcttatgggagggacaaatggcatatctgagcgtgctgtgaacgtaagtgtgactatataaagattcatcacgagatccattttgattgttattaaaaccacaacttgctagagataaggaaaaaacccttttgaatatttcccaaaatttgcaagtatcacatcttttattgagtttagtattgtcaacgctgctgttctactggtttgagggtgtaataaaaatatgtaggatatccagcagagctaaagaaatgccccttttcctgcccctgaagctgaaatacaaagagaarcatgtcaaggaaagaggaacctgccatgccgtacctgacacgcctcagatcctgctggcgaagactgtcagcaacctggtgtctgaggtaacccccagccgcccatgagttctgcttccctcttgggagaacgccccaggcagatgccttaatgagctctctatggattcccccagaacaagtacaaggaccatgtcaagaagcacttggcacagggctcatacacaacactaccagagacccgggacactgttcacgtcaaggaagtgaccaagcatgtcagtgatgtaagtgatcaaccaccsgtctcttggcagcaacaatgccacttgactgtagaatctggtgaaataatgtcagttgccttttgcttcctttatgtagcttcactcttaccatcaatatctacatgtgaatcttaaactctgacttttaaaatgacccagtatttattggctttccaattctggcaattatggcaaatgtgggttttgctacaggacatgtaatctagccatatcagatattactaacctattaataacagaaggaaacattgntgattaggagtggcctctcctattattaaactgctacccaattttagaaaggtaaaactacctctttgggcctcagtaatctctgcctgctctatccttatcaataatgctgtagtaaccttggtattatatgagtcccatatggttccatatatttttaaaaggtagaaatagtaaataaaagagcttaatttgcctctacccaggttctccgaagattgccaggtggttctagtgttgggttgcaggacacaaatgacagagaagaactagaatatgggtcttatctaagtcccagactgangccaaaatggggagcatggattttcctggagatttcacagttcttcaagtaaaccaactctgttcccagcttcctctactcataaaagtaattctggctctatttagacaaattacaaaaagaagtttgtcaaggagaaaggaaaatccaactactccatcatgctggagccaccagaggtgaaacatgctatggaagtggccaagaagcaaagtgatgtaagttttccctctcaacactcttgggggcccatttgaagcagkggaacccagattggtgcattctcttgttccagtgtgtggtcactctaattcctctgtggtagtttcaaaaagttagtggcgagaattggtttgggtttaaggaaaaaagctgattgtgcttaatggggacttttagaaagatagcatatctcggctgggcgtggtggctcatgcctataatcccagcactttgggagcccaagacaggcagatcacgaggtcaggagttcgagaccagcctggccaatatggtgaaaccctgtctctactaaaaacacaaaaatcagccgggcatggtggtgcacacctgcagtccccagctactcgggaggctgaggcagaagaatcacttgaatccgggagacagaagttgcagtgagctgagattgtaccactgcactcaagcctgggcaacagagtgagattccatctcaaaaaaaaaaaaaaaaaaaaaaaaaaaaagcctctctcttgagtaaacattttcttccccaataaaggtcgcttacagaaaagatgccaaagagaacctgcattacaccacagtggctgatcgaccagacatcaagaaggccacacaggcagccaaacaggccagtgaggtaagggtgtcatgaaaatgtccccagtccccaacagccattgccaaggcatgccaggcaaccatcacctgttgcccattttggttttctctgattcaggtggagtacagagccaagcaccgcaaggaaggcagccatggcttaagcatgctcggtcgcccagacatagaaatggccaagaaggcagccaagctgagcagccaggtaatgcagatgggtgcactggtggctctcatgtgaggagattataaaagaccttgcaggaagaagtgatttccagattgaaaatgcaaagggatgctgggtctgtaatagtactgcaaagcttccaagagttataaaaagtgcactgagggccttttctcgtttccctctaagctgtctagacctttcttgttctccactttaccatttatgggcatttgtctgggtgtctgtgtgcttaactatctttatgtgacaaaaacatcagttcatgagatcctactggaacctctccccaggccttaagagtttcatcctcggggtctgattcatacttgagtcacctgggatagatttaacatgaagagcaatgaaattctaacttctagaatccaaccagatgaaaatattcatttttttttcattaaacatacatatattaactgcccgggctaggaagtagggatgagcagatgtcttcagattacttgtccatggataaatcattaaaattttgtttggcaagtgtttgatcagggtatgcacagggtgctgatggagaatgccacattcttgcagatctcatattattgagaagcaaatggactcagaaatgtgttgcccaaacccagttaccacatgacttattttcccttgttaggccaattatctaaaattccccaagttatgacaggttttcagactttagctcagagatcccatcatctaccaccagacctatcagagtgcaagtttgatcctataggactttagcttaagaatatctcatttctcctccaatttacagatcctaccttctttttccttgtcctctcaggtatctgtttgaagaaataggtttgggatatacatttggttgtcgtgagtgactgactttcagcaatagcaaacatgggattccaatcttttggaagatataatgcagtaatgtcaagtgacagaacaagttagaattatgaaaacacaagagggtcagatgactgatgaaaagcaaatattattttttaaaagtttttaaacttaaaattcctatgtaacatattttattataaattaatggaattgtataagtatttgaaactaagatatgggatcaccaccaccaacaaaaaaacagtggaatctctaagagtaatgagatgtaacaagaacttattaatgcaaaaagttaatgtttttaaatgtacaaggtcatatcattataatttaaaaacaaacgactatgatgttgaaattttgaaaactttattgtttttgaaaatcaagaggctcctatttctagtactaagtgaatcctatggtatggagaatgggaccctatgggtcccatttacttcctgtgaaaggctggtctccggattgacagcttcatggtgtggccctgggcccaagggcgcttcagctgtgtgtgggctttccctgttctgactttgctgtcttgctgcgtactctaggcggaatacctcaaaggccaaaggagagggcacggcgctgcatcttatgacacccctatgatgargcatcttaagaaaattaatgtacacatcagtgatgtaagaaagactgagaccagcaagccattatttctgtcttcctctgattcttgtctactttcttggcattggtcaggagactgaccaggttgcattcttttctgttgatttttgtgttggaacgtgtagattgctgtggaaatttgttgaaggatatacttttgcatacacccttcttttcctgcatgaaactttccatctggaacataccacttggaataggaaggtagactagactcagagatggactcctaatgtatgtgtatgttaggttgctgacactgatcaagttaaatgatgaaatgaaaacaaactgagaatctcatcttcaaccaaagaaacctctgcctcttctgaagttatctgccatttttgatttttaatatactgaagattggtatttaatatagtttctcagttcaggccttctatgaatcaacagtataaacttttaatagcttttctaattctcgggactgttcttcagtctttagaagcaccagtatacatctcaattcaataaaaaggagctaaaaaattagatcttaaacttcaaatacaattaaactcctaaaaatataattaatgcaaaatcactttcctatactacatccataataggcccaatttctgagcctgatgggattataaaccccgggggctgccacttgccgagacatggcattgcagagttgcctcttagctcccatggttaatgggaaaaagcttcaccattccctaatgccaagtgtatgtagttttactacattactccctagtcaaacaccattccaagaattcctagagtcctaaacctggtacatgtccttacctttcaaactatactagttttaagaagatccagtcaaaaaggaaggccaaaagtgctgaactcagattcatattagtagttgtaaaaagctgcatttgtttagaggacttcctatggagaagggagccataactttttttcagttaaaaaggttgaagttaacttgaaattaacagaagaaaaagaaactgaagtggaatcaatgggattgctgcttgaaaaatacctcttcagaaacaagtatcttctaaaagacagaaggaggacttttagtatgcttctaaaaaaagcagattttattctcatttgagatgggcttttgcttcttttcttccctactctgactctgcatatctggtttgcttttctgtgtttcacaactcttgggaacatctcctagttttatggacttctatatctcttaggaaaagttgcctttggtccagacaccagctcacacctcagaccttccttagcaggccttccacttctttatgttgagagtgaaactttttcagagaagagccattgtagcatttgtttacgtttctttttcctttactttgtgtgtctcagtgtgcctgcatcatgctgaactgttctgcatgcttattttttctctgcatttccactgaggatttattcaaagtaaaggagtctcagcattgtgaatgcattttctctgatgtggcagatttcattgttattttgtgtctgttgtgctggatgtgtcaagttgggggaggtgaagagcagtgatgaaccatgaggggtactggtgttagtgagtctttcatcttaacaataacagaaactctaggattccctgagggttaaatattgcccttttggttggctaacatctagaaacagctcagttttcattcctcctagagtgaataactagtagaattctacttctggccttaattctgcaatactgttgacaaaagcatcagtttgtttttcaattaggagatgtttctgtcactttccattctgttgaattctcctataaataaatcctcttatttattttgtgagacagggtcttgctctgttgcccacgatggagtgcagtggtgcgatcctgactcactgcagcctccacctcccgggctcaagtgatcctcccacttcagcctcctgagtagctgagactacaggggtgcaccacaatgcccagttaatttttgtatttttagtggagatggggtttcagcacgtgcccaggctggtctcaaactcctgggctcaagtaattcacccaccttggcctcctaaagtgctgagattacaggcatgagccaccacacctggctatcatcctctttagatattttacctagacataatgactgtctcttccttccattcaatcaaatcacatttattgagcaactattagtgcaaggcattgtgcttattttttaaattggagttatttagccctctgcctacctaaacttatttttatgtatactaaaagtatatttaatcttattttttctcattattctgaagtatctcacttttttcctacttctagtctgaaatcacacttgaagccattaacccccaaactctcatatttgtttactcaggagttataccatttttggccaagtttaataatttttaaatgatatagccaaagtactattttaaaataacaataaattctcctaatttaacagattctttatttttcaaccttcttgatcatttacagcccttctttggatttcacagacttaaattgctgttggttttgctagttaggagtgctaaaatgctccaaatcaagtacattaaatcacatctctgaatttagcctgaagccttttccattttttttttttttgttttgcattagaaagaggtgattactttttataccttggaataatataaaaatgagcaaggccagtgatcatatatttgaatgcctgttgtcttgtcattcttaattattaatagtgtcttctttactctaaatgtcccagtttggataatagattatatgatcactctatgtacaatgcatattctttggcatttgtgttyctactattccccaattcccaaattgattgatgtccaggaataatttggatgtttgcatttgctgttaggttaaataccgagaaaatttcgataaagaaaagggcaagacaccaaaatacaatccaaaagacagccagctctacaaagtcatgaaagatgctaataatcttgcaagtgaggtatgtttctaaaattgtggtaaaatatataacatggtatttgccattttaactgtttttaagtgtgcaattcagtagcatttataacactcacaatattatccaactactgtcactatttccaaaatgttttcataccaacagaaactataaccattaagcaaaaactctccattccctcctcccgtcagctcctgggaacctcttatctactttttgtctctatgcatttgcctgttttagagagtgcatataaatggaatcaaacagtatctgtcctttggtgtctggcttattttacttagcataatatgttcaaggtccatccatgttgtaggatatatcagaacttcattccttttatggctaaataatattccattgtatgtatatgccacattttgtttatccattcatctgctgacagacacttgggttgtttctgccttctggctactatgaatgaggtatgatttttcatcaccatctccagcatttgtttgacgatgggctatctcactttgatttccattagtgctgttccatttcctatttacgtgatttcctttcttcccccataacacacaggttaaatacaaggctgacctgaagaaacttcacaaacccgtgactgacatgaaggagtctctgatcatgaatcatgtcctgaatacaagccaacttgccagttctgtaagctcagtcatttgctccagaaacagcttgttttacccatttggaactaaattctttctgagcccagatgcatcttcttctctgctactgataccctagatttattacaaaactgttctcatttgagtgtattcttccaaatgacaacattaatctaccaattctccattgtctgtaacacctctcagaatgtaaaaatgcttctttttaaaaaatatttaaactttgccctccaattaaccattcccttttctctaaggacatagaaataccctctggaatagtttctttcacttttaactttttacttataacacctactttgaacaagccacataacctaagtgtttacatcttaacggacaatactgaacttggatcctcatttttaaaactttttcttaacctcctgtttagtgtttgccatttttagtttgatcttgacaatggtgctgtgtaaacgtctaatctaaagaggaaaaataggaatgctgagcagcttctccatcaatgtgccttttttgccgccttcccctcagtaccagtacaagaagaagtatgagaagagtaaaggccactaccacaccatacccgataatctggagcagcttcacctaaaagaggccacagaattacagagtatagtaagtggatcaagaccgatttttcctctggygcacattcatccacagtacaatgtgaaaaaaaatttcatagattccctccattgtttgagaaaatgcacaaagatataaggggttttgaatctggtaactttttgaaacaaattcttatgttataaattacaacaacatctacatatagttgagaaatatacatgcaattatgtgctactggcaggggctggaagcataaagagtgtgttttatgaggggacaaacccctcatggtaactccaatgtgccccatgggtttgtgccccaggttagggaacactacagtagattatagggagtcaggaagatttcaaacagagaagtgatacgatcaggtctactactgaaagcagttctgggaatttacaaaattactaaatttttaagatacagtcatataccgcatgatgtttttggtcaacagcagaccacctgtatgacagtggtcccayaagattataatggagctaccctatgcaggtgtaccattttaaaacctttaataccatatttttactgtaccttttctatgcttagaggtatcaagatacacaaatactcttgtgttacaagtgcctacagatttcagtaaaataatatgctgtacaggtttctagcctaggagcaacaggccataccatatagcctaggtgtgtagtaggctataccatctaggtttgtgtaagtgtactctgtgatgttcacacaatgatgaaattgcataacaaagcctttctcataacatatcccagttgttaagcaattcatgactataattgaagattctcagaggaaagaacttactatcacatgacctcctatatcacaaattcagcattatttaggtcccctgttgggcattaaccatgaggactaactattagaaacgtcctcgtgtcttctgtagggcagtatgtgcccccaggcctttattccaacatcttgttacaacccaagagctcggagattgagcagtgccatcaaggtgctgcgtgcatgagggtcttcgcctgtttttccagaagttctctgtcacatacatttatgtggctcccctgattcttaaccacatgttatgaggatgagaaaattttatttatacaacaggcttgaggatcttttgagactgtcaggttttttaacaagtcagtcaatatgtaaactagttttcatttttataccaatttattggctgcattaaatatatggccagtcaggacccacatagagttgtttacttataaataaagctccatgtgttatccattcaatctagaccccaggtctctgataaaagttcttgtgaaagaaaaactaaggatttttatcagaaatattgattaatgctaatagcattaataattttaaagtgtttacagctacccatcaattattgaccaacctcatctacctgggtaattttccccatgcgttttcttgcatcagcatttctctcagctggctcttgtcaatgattcttttgtgtccttgaattgaatccaaatcctaattatgccttgcagacagtaatggyacccatcccctcaacacctagacaacaacaaaaatgtactggatctgaaacataacaggaaactgttttgagtggcaatgagatgccatccaattgacagaacatatcaattaaaaaatactatccttaaactgctgtctaggaattgaccagaggagagatatctaacatggctttctatcaccaggtgaaatacaaagaaaagtatgaaaaggaacgaggaaaacccatgctggactttgaaacaccaacgtacatcactgccaaagagtctcagcagatgcagagtggggtaagtcaaaaaaaccacaccacacaacaatgatccatcacactactgaacacaagctctgcccatgacatggccagtttcctgtcatccaaaagtggtagctgatgaaactttttatcatgtgatcactaaaatcttctccatctcagaaatcctatggttcagttattttttaaaaatgctctaggtagtaaatatttaccatatgtcttatttcaacagccatttctgtaaaattagaacatggaaaactattcccaacacaaattatactgaatgtaatttggattttcctttatgaatgaaaagttccctccacacagacacccctttggctttgaaatgctctactcttagtagaatgccccaagccaaacaaaagggtatttgtgatcaagatgtttatcaagaccccagataatcaaaagtgaagatgccatattcgttattttagaattgtaagcagaagcactaaattttcttttggtcatttttaaccaagagtagagaatggaatcttattttaaatcttagtctgtcttcagtgggaaatgggcttatttggaatttccatttgcctctcttcctccaactataaagaaaaattgttttaaataaaagcagcagtttgtggagctttctggtgatagaatgtcaggtcatcaaaactttaaaatggcttcaaacaattggtcaatctgagtaaaggatctataggagtttcttatactgttcttgtgactttcctgtaaatttaaaattctattaaaataacaaaattacaaaagtagagttccaacatctattccaagcccctctgtgagtcagctaagtctggagactggagaggagatggggcagggaggcagagtggacaaaaccatacaattcctctgtgcctcactgcccacctaagctattcagtgatttttaaaaaacaggtcaaaactcagtgtggtggcatacacctgtagtcccagctactcagcaggctgaggcaggaggctcacttcagctcaggagtttgagaccagcctgggcatcatagcaagaccccatattaaaaaaacaggtcatgattaggaaaaaaagcaagttagcatttggtagccttaggctctccttccactgcgatttttttccccttgcctcactgacttgtaattctgaaataaagtcttttgtcaccttaagaaaggtgtgggaaagttcagaagagacaacagaggattcagagtcctgatggtgcatccatccttccactctgtgaagggcctgccccagtcacaacattagactgatgagtgaggggcccatcaaagtgtctcagcctgaatttccttgtggccatttgctccagacaaagtatttcaagtacaatcatacatgtttcaaatgtgtgaccattagcagaactatgattaagagcccatacatagaaaatgctgttttttttttcttcctgagatggagagatatattgtaataaagatttttttttaacttgtctttccttcctacttacattagaaagaatataggaaagattatgaagagtccattaaaggcagaaacctgactggcctggaggtcacgccagctttgttacatgtcaaatatgcaactaaaatagcaagcgaggtagtgcccacttggtcttttctttccctcttaatccaaataattgcactagtgacactcattaatgtgttcctcctaccatttacatcaccacctaactgtgggtttcaaattgggttctcatgtgcttggtactaccacctaatctattacccatgttaattcttctaattttttatttgaatattaccttagcattctattaacttcaagctttcatttgatatttaatgttaactgatcatgcttataccctgcctgtattcatatttttacttactaaactgtgaaccctttaaaaattggaattgttttttattttcttctttgcctgagagaatcaatctgggctttcttgtcaatgttgttgcttttctttcatgatatagaaagagtacaggaaagatctagaggaaagcatccgtgggaagggcctcactgaaatggaagatacacctgacatgctaagagcaaagaatgccactcaaatcctcaatgaggtaggcccacagctgactgcctgcacgtaattcatacagcatcatttctttgttagccaaattacaccagaaaaagcaaaacaaaaacagagaacagagaaaaacagagcttttcattttcagattccatatcaacataattgttaaccattacataaaatatacctcaatttctgatgaatggatattgtaacagtgtgtttctgtagtggttatcataatctattatctaatattatttgatttaacttgatatatttggtgtgctcatctacacgaaaacactacactggagtggtgtgcacctaagtgtaatcttagttatgtaccaaactagatgtacaatttactttatactctaatcttctaagcagagaatgctaaaagtattcaaaaggagacctctgttgacccatactgacttgcatagaatagtttcctccagagggcttctgaagacaccacttcatcctaccacacggaagagcgaaggtgaagagtagcaagcgacactatctgtgacaactggggtggcgtgttatgtggatttacattcaccctgtatgtttattacctagtagtagcatttaggtaccttttttttttcttttaatgctactatagaaagaatataagcgagacctggaactggaagtcaaaggaagaggcctgaatgccatggccaatgaaactccggattttatgagggccaggaatgctactgatattgccagtcaggtcagtgctactattcgatgtcaatctttcaggaaagtagttgtaactttaaggacataaagtgtccctctgtcatctgatttattggtgacagtcacatgcatacaatggcattcttgaacatctgcctggaggaagccatcccaatgaaaggatggaggaccctttgccaggctcattgctgtctacctttctaagtctataggctctggggacattcagagcaaagggcagaaactgaggaattaagtagctgtttggagctggggcaaactcgacatcttggccttatttctgagtcagtccactcatttgatgccaggaattccttgcttagaatatcttgggagttcttcctctcctttcaagccctaagtttagaacagtttttaggcatcttagcttgtctaatgctcattggtatgggtcttttgcttatttgtcatcctcccagctcgtatgtaaacaatccatgccttactatctgttgatgatccctccttacccatatcccatcctgcatccaactaaatcttctctcaacagctaggacttgacctttcttactgaatctcactctttggtataaaactatgaacaaaataggaagaaatatctgttgaatgtcaaatgaatgagtccctcttggaaaagaaatatggctcacctcttaatcaaatcaagccaacaactgttgtgcacattgcaaacatttacccaactattcggtgttgttttacagattaagtataagcaatcagcagaaatggagaaagccaatttcacttctgtggttgatactccagagatcattcatgcccaacaagtcaagaatctttcaagccaggtaaggacattcgtcatgccatcactcataaaccccaatcatgaaagaatggaagtccttccattaataaataccttaagagattcttcagatcagtttttcccaataaaaaagagattcaccaggtgcggtggctcacgtctgtattcccagcactttgggaggccaaggaaagtggatcatttaagtccacgagtttgagatcagcctggacaatatggcaaaaccctgtccctacaaaaattggccaggtgtggtggtgcacgccagtcccagcttctaggaaggctgaggtgggaagatcaattgagcccaggcggttgaggctgcagtcagctgtgactgcaccactgcagtcccctgggtgacagggtgagactcttaaaaaaaaaagagagaagcccggcatggtggctcatgcctgtattcccagcactttgggaggccgaggtgggtggatcacaaggtcaggagatccagaccatcctggctaacacggtgaaactctatctctactaaaaaaaatacacaaaaattagccgggcgtggtggcaggcacctgtagtcccagctacttgggaggctgaggcaggagaatggcgtgaacccgggaggcagagcttgcagtgagccgagatcacgccactgcactccagcctgggcagcacagcaagactctgtctcaaaaaaaaaaaaaaaaaaaaaaaaaaaaagagtgagagggtaacctatgatgcaggaattttaaggtagtgaagaactcttttaaggtactgaagaacatggtacaacttgtaattaatgaatcaatattttaacatgtaaaatctcttatgatgtggctttaaaaatgtgtgcgcagatctggaagaaacaaagtagcccacatttggattaccaatctcaaacaagactgagattgagaccacacagtctaacccctgactcccctcatgatgaataactctccatcatcttcctacaaatagagagatgaagaaaagtaggccatccttcacaccctgggataggccttcacttgtatgaacgattgtcagtgatggtcaggagtctgcaatttgtttgagtggtgccagattagaatttgtgcttgtcttctgatcaatgagttccaaagccatagttaacgtgccctagctgtgctttataggcacctggggatgtagattcgctggtccaactctggaattttgatgctagtaaatctgtggtaggctctggaaatctatttttgtttgtttttaattttcacagatgatctcttaatgaccaatcaggttggggaatcaaggatttcaaccctttactggaaacatatagttgtatattgtaaaattacacatgaaaaatatagttatcactagagagtggtttgattaggaagcaggtatattcaaatggtggaaatgtttcttttctttgaagggtagggatgcayaagaataattagctttttaaaaactaccaaaatgatatgggctccaaattaccatgttgtgttcactgagggagccagggaggctgatattctttgggctgtgagagcctcaccagccttttaccttctgcttttgacactgctgatctttaacgaaagcttcagcatgtggacctatcccagtgtgggatcacgtcacttgctctgctctcctggggctctctttggctggttcctcaaggcctaaaatatagccaggcaagttagttcctccccaattcagatcagtatttacagttgaatggtaaatactggtgagatggtgcttgtgtttccacaaacttgcttctcgatttccaatggagaatctgtatttataactcttaaacctcatacttgggggttaatacaagcaatgtaagctgactcacaaatttaggatactatacagtagtctcctcttatccgagggggatatgttccaagacctctagtggatgcctgaaattacagacaatacctaaccctatatatactggtttttcctatacatatacacctatgacaaagcttaatttgtaaattagcacagtaagagattaacaacaataactaataaaatagaacaattataacaatatactgtaataaaagttatatagttacatgaatgtggtctctctctctccctcagaatatcttattgtaatgtactcttatttttgaccgaggttgactacagttaactgaaaccgtggaaagtgaaacctcagataagtggggactactgtactgaatacttaatgccagtatggcaggccaggtctcactaacaactgtttgagtactaaatgaatggttaagttagatattaaaagccagtgtccctgtacaaaggctgggatgtaacaaaagcccaccaaaagtttcggctaggcctttcctgggccttaaagcataacaaaataatgaaggaattcttaacaggacccatgtagaattaaacaagttttactgtgggtctaaaaaaaactccccaggcctccacaaacaagtttattgggggtctgaagaaactcctcaaacctccctgatttagcaggagacaacatacgagtaatcaccccagcacctgaacccatttaaattaagtaaatttactgaggctccagaggaaggtcttcagaactcagaccttagttataaattaaaagaagttaatcacttatgtctttagatgaatgaacacttacacaaagacatatagcttaaaaggtaagctctgaaaaactttgtaattttgagttggcctggtgataatttccaggccttctcccggtaaccagttacagaaataaaaactcttggtcgggcgcagtggctcgcgcctgtaatcccaggactttgggagaccgaggtgggtggatcatgaggtcaggagattgagaccatcctgaccaacatggtgaaaccccatcattagctggttgtggtggtgcacacctgtaatcccagctactcggaagcctgaggcaggagaattgcttgaaccagggagtcagaggttgcagtgagccaagatcacgtcactggactctagcctggagacactgcgaaactccgcctcaaaaaacaaaaaaccaaacaaacaaaaaaaaaacctctcttcctccccagttcatctgcatttcattattgggccacgagaaatagcagtccaaccctcaatttggtctgggaacaccagggagttcaggtccctttctcccagaatacatccaagttctgtgtgcaaatgtgattatccctctaagggattagcaccagctctgcaaaccagttgaggtagcttttgcttaatcttggaaaaaataaaagaaaaacaataaaaataaaataaaaggacgattgtttctattcttttcccaggacaatgagaactgttttccttacatctacatagctaaggagtcatccaggtgactttttcatgaacaaaacatttgttcatgatgaactaccgtttcttccgaaaaatctggctttaattcgcttccatttagatgaacaaaatctaggcctacatctctcattggctgaaactgcttgtttgttgtctctggcaagattacaaatttcaatacttataaatgtaattcctatattaacaaagtacatagagacagacagaatagttttatccccattataacagtggctagtctcattcctcagccctcagccctacaaactaaaacttccctgaagagtgggaaaaactggagctaagttaagctagagagaaaagtgaaaggacagtgacaagcgatgatgaaagaaaaataaggctctaaagtgttctgctgcagagaataaaaacaatcatcagtttggtggtgagattgactgcccactggtgtctggaagagcagcctctatatggacacgtctctccagccaaaggctggggcaggacaggggagcccaaggaatagtgatgtctggttcagagcagtccttggccagtcagctggccttagtagtgctccaggtgtgtctgtttggtagagctgccagtcctgtcaggctgctttctgcagcatcaagagccatattctggaaatgcctctgggcctgcctgtctgactgccggctcagtcctatagctgggagccctgaccgcacctgctcatggctcagtgaacatcttgtcaccagctaaggctttctagaggtcatgtctttgactcttaaccctccagcttctctccgcctgcctgttgaacagtctggctacatagcttcatccagcccagcgaggactactgccactggaggcatccccatctccctctctgggccttgctggctgtgaccttcctcctgtggaccagctagcaaggttccccctctgccagctttgccatgacaataggtcctactgaatgtctgggcttagctttcctggaaagaaaaagtatggtgctctttctttgactgagagggttcttccttgcgatgccctaacatccttggacagttaagaaaatacaaaggactttccctctgctgagcctggaagggctaaaatagcctattttasgtcccattggcctatatccctgtggtgtttaccctccttatttcttggaatctattcccagaaaaagtacaaggaagatgctgagaagtccatgtcgtattatgagactgttttggacaccccagagatacagagagtccgggagaaccaaaagaacttcagccttgtaagtttttattaaatgtaaggcacagcccacaggcacctaggggtgctgaggaagatgcctctggatatcccaggcttgcagtggggctgttgtgcagccctccacaactcccatcctgccccaggaaatgtgtgcccaattcatctctgggctcaccttgtatcttaatcccaaatcacagcatgaaagactcatctgttacttcgttggtggtattggggagaaaatatagtatcttttcctcacccatggcaaggttcatggcgaaaacccctgtaacaaaagacagattaacaagagagacacacaatttattcaataaaagcttcagaaatgactacccaaagaaacagggaaatatgtgtatttttatggatagagatgcggaagtgtgattggacaaagaggggtatgatccaatggtaataaacaggggatttagcgatggctgtttgttcagattctcctagtatctctgtgtctttggctcctttcctctgggtctagggaggacccttctggaaggagaggcttattgcctgctttaaatgaaggtcagataattattatctgcttcaggaaaaaacagagaaggccagaaaaaccctcctgcttctgctgttttttcaaatgccaaggtgccattattttggggtagtgtatcctaaaccctgtcagtggcttcctttactgaatgtgaactatcactgctttccattagtggagacatctatctttttcaaagttaaatctactaagcaagggatacttaaacaaaaacaaacccctagctttatatgttttttaaaattagtttctccacaaaattcttatcaaataatttcccttgggctaccagaccataattattgtgcatagacttttttttaaagatacaggattttaattttcttcacataatataggacaaataaagaaaacaaagcaatgttgaaatcttaacaagatgtttactctttcttcatagctccaataccagtgtgaccttaaaaacagtaaaggaaaaattayagttgttcaagacacrccagaaatactgcgtgtaaaagaaaatcagaagaatttcagctcggtatatttactatttattttgcatttaatgctaacctagtcatttcactctcctctttaaaaatatactagccttatattgatacacacaattaacatctaacctcctcagtaatactagcagtgatttgctaaaatccccaatactttgctccaaaatcatctccagagaccatttgaaataactttaaatctgctaacaacgtaacttttatttttaaattttttaatcccagggcagtaacatgtgttgtcttgctccaagaagatggatttctttttgacattgtgatttcttttgttatccctcccccaaataactgactgagtttgcatttctttaatggattttgtgttacatatggggagggttttgttgttaatcaacatttcctggctcttctcatcctgtgttagtatggtataccacaatcttagaagaaatcttaagatctggaaagatccatgttgtataactggtctgagtcactgatactgacatggaaatgtcaggtgcgatgctctggcacttgcctgggaacatcgtctagtgtcttgttttcacaaaagccatgtgtcctagtctttctccaggaactgctgggttttcttttcttctgtgttaacactgtcctgattctgaatgcccaggttttatataaagaggatgtctcaccaggaacggctatcggaaagacacctgagatgatgagagtgaaacaaacacaggaccacattagctcggtaaagacacagtgaatgcacttgcaatattttctgcctccctttgataatttacaatgacctatgagttgcactcaaagcctctgtcaccagaaacagcttatattgctaaaataggtgcctgtgtaccaccaccacacagtggctagagtcatctcatattcagtgcagtgccttggcggttttcatgagggagagattagatctgaaaaacagagaggcttgtgagaaggtagaatccggtacagtcaaagaaccaaccttcctggatatatgtatgtsaatctgtttatcctagtcaaacgacctgctgggcataaagacattggagtatacaggaaagggctgcagtctaaataggggcccccatccctgccccaaagagacgagagagagacaaagcgtccctgtccttggaattgttctcctcttacccagtatcagaatgaggtcccattcacactaagtataaagcctgcgttatttacactgttaatttttttaatttgggggctacaaaaaacatgtacatgttgggaagaataacagtccagcatgtaataatacctttcttttcccatttttaaatctgcaggtgaagtataaggaagcaataggacaaggaactccaatccctgacctgcctgaagtgaaacgtgtgaaggagacgcagaagcacattagctcggtagtggccatactctcagcttccatttgtgtgactggccatctctcaattgctaccctggtgctctctcatctttctgcttcctatcaagagcttccatgccttggggatgttgtgaattctcccttagtcttgatggggtcactacaggttgcaaaagtagataagaaaccacttttctcataatcaaggagtagaagggatttggctttcttttcctacctgtcactgacttgaagctcatggacttggcttcttaattaattatcatgccattcgtttccaaagtaaaatgttttgatggtagtaataaggttattgggatgatctcaagtaatttaactaaaagcatatacatataaacatataagtagtataacatactttggttttgtgtatatatataaaacatgtgtgtgtgtatgtatgacacatcatatgaatgataggattcccagtgtccaaaaagaccctgggtagacatgtgaagtctcttctcccctccctttcaaggtttcttctcctgtattctttgctctctccatctagtaaatgcagtggtacaggctgcgatctacctacaatggtatattatacattaagcctgttctgtcatgggaatttcaggcacctgtgcagtttattgcagggcacgtgtcccccacacctgaaatatcaggttagcacatttctcctgaccttttgtcaagcaagccctggctctgcacccaccccttttcccatccatacgcagattctaggcaggtgttggctactagcaaaagactatgtgaagtttgggaaatagtttatggccaataaaaggggaggaccttggtcttgggattcccctggtcaatggaggactgaactctcatttgattttctttaggatacttgatatttctcttgcaggttgttcatattatttagatctcattcccttctcactctctgcttatactctgtggtacagatttccttgtggtacaaatttcatttagagttttgtgtcctctaataagagttgagaaagctagcctaggctcctttgtcactttgcattacaacttcttggttttctttaattttgctttgtgctgttgtccgagatcaattctgctgctttgttgggtgaagagtaaagaaatgcaactttgttaccaagaaggtagatgttcaaaggttcctagaagcttccttgcaaaacaaagctatcacgcctagcttgtcactgattttaagaattaaaatctgggtacgttgctccccacgccatgcactaatacaccagggaatccatccatttaaaagaactcattcagtcctttaggctgaaaacttaatgttaagagttaaggaggctcagagagtggaggttccttaatgttttcattaaaatgcatagtccttagatactactantaaaaaatatggacttctcccaattcagaaaacactagtttacttgatccagcaattagcagtaaaaatttcaggtaaagatgctcttcctgaaaaataaactgattaagccatctcacatccagggactaggctcctacagattaggagccagcgaggaacattcattagaacatacaaaacaaaaagaaaattctcaataagcctgaaggaatagagtatcctatgattggaaaattttaaaccaagcaatctattcattaagtacaagtctactgcaggcctactatatttgaggcaccaaagctagatgcaacaaaatggttagatttttctcattggtaartttatttattaatgcattttaggcatgcactaagtggttacagaaaatgcataatttagtgcccagttttcaaagtagtaaaaatttttactattttggaaaagacaacataaatattcatggaattttcycccctgttccttgaatgttatatttgagagctagattgtttttatgagtttcccccaaatagcccacatgtggctgctatctaaaggatttacggtcattttacctttctgggtattctaattattttctacaggttatgtacaaagaaaacttgggaacaggcattccaaccactgtgactccagagattgagagagtcaaacgcaatcaagagaactttagctcggtatttacaaatatatcatataagaaactatttcccataaaaaatttaccacaataacccatcttttttaaagaaagtaacatcttaacagcaattctgtgtgtgtctgtgtgtgttgtgtattattacctgaccaaaattatgttaatacaaaatgactcacatttccgattatacttgaacattttcagtgacttgactagatttgaaatactataagtagaattaacaagattcctcagcgttatataacttaatgctttccattgtactttttcatttccagaattagcattgtagagttcatcattaaaactgtgaaaaaagtaaaaacattatccttactaaatattacttactaaaaaactgcctcctcacatataaccccttcccccatttccttccttccttactctctrtgcctgttttaaatgtcctctgggtactttcttgtatctcacaggttttgtacaaagaaaatttggggaaaggaatcccaacacctatcactccagagatggagagagtcaaacgcaatcaagagaactttagctcggtatttcttagggggccaaaaaaaaaaaaatcccttaattttatttaaaataataacaccttacaaatgtaaaattactaaattcatataatgaaaataatgataccaaatattacctcagttttcaacccaaatctaatttagtatttagttctggtgtgaaattttaactgtgttttctctaaaacatagatatttatcactttctttaaaaacctgtaatactctgttttcttcctccattcctcctttaataacagtaggtgtttctaactggtgtaacacagtcaaaagtaaaatctaacaccctttcaaaaggacaatgttaattagaattttatttgtatttattgtggctgtttaatgtattctttrtgtttgcagcttttaagtttttttttttttatgtttagatgtttatttatttttccataagtttgggaggtacaggtggtatttggttactaagttctttagtggtgacttgtgagattttggtgcacccatcacccaagcagtatacactgcaccatatttgtagtgttttattccctcgcctcactyccactctttcctgcaagtccccaaagttcactgtatcattcttatgcctttgcatcctcatagcttagttcccacatatcagtgagaacatacaatgtttggttttccattcctgagttacttcacttacaatactagtctccaatctcattagaggtcactggtttgcagcttttcttaaaagaatgtcattcttaaacattttcattcaaagacaacacagcaattcacagtaaatataatttacttgtcttggctattttttgtatgctatgtaagatataaattaatttttcctttggaaaactttcagtatcattgaaagctagtattatttagctttcaacatttattctttattttgttcccccaaacctacctgtctctctctctcctctttctttggttccctaatttaatgttaccaacaactcatggatattaatttcaattagtttgaatgctatttgatactctggtctttgagagaaggcctacataagtcaagccactcctgccggcagcctggcagctgtgttttactgatgtcttttagagacagacatcctgtgtgtgactaaatgtccaaaggggatctatagttaactctatttttaaaagttactgaggtacttcatcataaaaacaacaataaaaatacttcttttaggctgtttttttaggttaagtctacctaaaaaatgatgggtccaggttgatttgtttgttggttttgtgcacacagatattgtacaaagagaacttgagcaaggggactcccctacctgtcactcctgagatggagcgagtcaaactcaatcaagaaaactttagctcggtatttgggagaaagctctttaactccatattaaaaaataataatttctacaaaacagaacatctcactgttcatccctttataataatcaatttaacaaaatctttttttaatcacatcaactgaatccttctgttttccagatctcctactcaccatttgattctaacaaacattttatactttctataatagtcccttaaaactttttctttccttctcttttcatctttatgttgttgggactgttgaagttaattgatttccagaaaagaaaaaccaaacactaaagctcttatttacttggaactctttttatctgatgtttctgggttagagatgcaagaaaagatactggacttgaagccacatatagaaatggtggctcttccttaggaacagggatcatcttaacatagaccctattcagataaacaatagcaccaagaaagaaaattgctccatattgaaaccaaaagaaatcttatttggggccaggcgtggtggctcacacctgtcatctcagcactttgggaggtcgaggcaggcagatcacttgagcccaggaggtcgagaccagcctagccaacatggtgaaattccatctctgctaaaaatagaaaaaattagccaagcgtggtggcacatgcctgtagtctcagctacttgggaggctgaggtgggaggttcatctgaaccctaggaagtcaaggctgcagtgagccgtgattgtgccactgtactccagcctaggcaacaggagtgagaccctgtttcaaaaaaaaaaaaaaaaaaaaggaagaaagaaatcttattttgatacttattcaaaacaagccatttcatgaatagaaatccaggccttctgatttttttttaatatacaaatcagatcatgagcttatatttaatgttatcttttattaatattgttgctgaaaaactctaacacacaaattatttgtgtattatatacaactctgaagcttctatatcaagaccttaggttcacttatacctgtgatggagaatcaaatgtcattaggaaaatttagatggatttttttctggggagtgggaattaatccaaaatatttttaattgtcagtttaaatatattctaaaagtttgattctttgacataattagatcagtaactttctttggtcccactgtctttttgttctgttttgttttttaattactattcactaacaatccttcaattttgttaaattttcaatgttaatatgtcttttggaatgttatactcattgttttccctgtgggttgtaattattattccttttattgaaaggcttgcaacgattttcaaaattattttctaattattttcttgtatactacagtaagtatattattatttgtatctatttgaaaccttaatgatcctggactttttttaaagtaaccatttgtgttaatttttacacagattgcatttaggcaaaattgcccagtggtgcataagcctattagatactgtggaaaatagacaatgccacatattgaacctctatacytgaccatctctacaacaacttgaacttaatgacaaggaccaaattgccatattgcatagatttggcctgttaaatatttgttagaccgtaagacaaacgctttttgtagagaaaataaatacttgctaatctaacttaagcaatttttctattgtacactgagtattttagtggtcttaggaaattatttgtatttttttccttaattcctggcacaggaaataaatatattcaagttacaataaaaagatgatgaatatcaaatacactgatatttcactaaggaaatacaaaacatgttctcacccagatctgtgcctgaacagagaggttgacttgttgaatctgtcttttctgtctgacgtctgtagttttataccaggttccccacaaggtagatgaaagggctgttttgactgctcttgttttttctggatgctttcttgtgtcatacaggtgttgtataaagaaaacgttggaaaagggattccaatccccatcactccagagatggagagagtcaaacacaatcaagaaaactttagttcggtatttaaaaataaaaaatccctttaattatttaaaaaaatgtttaaaaagattaatggctagattttaaaaatctaatcaactcatcccaataaaaaatttgacctgtctttttcccaacttaatgctgccatttcctatgaatcagttttccccattttggtaaaacattaatataatcatttaacttaataaaaaaagtgttcagtattatattcctgcttttacaaatgtaacattctcagtgtctaagcatccacwtttatactgctttggcaaatttgatctgaacctaaagcttaaacaaatgtattttgcaaagatccgactattatcctcgtttcttattctaaccttttctatctctactgttatttgtacagatattttgaagtttcttttttttagcaccttatcattgctctccatttgccttaaacatcgttgttctcaatgtgttcacccaaactaaaaattaaatactctgacttcttttgaaagtgaacaaaagaagagttgtgtgtatgtgtctccatatacacaatgtttgtaaaacccaaatatccctatgtgattaacagcattttcaaatcaaaagtaacttccttggtttcttgtctgtttctacttttttccctccttgtaacaaggtgggaaaagactaattgctctttcacggttgctcagtgctgcagagattagttcaaacaatgaaaataacaacctttcttttcctatttcttagtttttgctgctctttcctgcattcctttgcttttgaagatgtctttaggctcaaacaaacaggttgagtctaaaagcttctggtatttctcttcctctaacttactctcttcctcccttcccactcccaactgctccaaagcagggggaaaatgactgattgattgctttttttgttctggatgctttctcatcatacaggtgctatacaaagaaaacctggggacaggaattccaatccccatcactcctgagatgcagagagtcaaacacaatcaagaaaaccttagctcggtattttggaaagaaaggggaaaaaatgccacttaacttcagaattaaactgatctttacatttatttatttttgtttgaagcccatttcccttctttgcttctaatacatcttatattacaaaaggatatactttcccatttctataatacagttaatgtcaattttttacttcatctgatatttacaaacaaacatgttttaaaaataatgaatgtttccatttgtgtggataacaacaccgagttctaacagtctcaaatcctcatgtgattgtttaggaggcaccgtactcacaaaaatgaaaaaaaataacatggataactctgacagcccttcctcagcagctgaagtccctgcttctctagagggtgcagattccctatcccaacaacagcttccactaaagtagtcggtggcattttgtcagcatataacttctggctccttggatgactgtgttttttcctcatccttaaaaagtcccaagaaatgaaatgttactcatggttgtttttctggatgctttcttatcgcacaggtgttatacaaagaaaacatgggcaagggaacccctttacctgtcactcccgagatggaaagagtcaaacacaatcaagaaaatattagctcggtactttggcaagaaaagaaaaaaactacttatttaatgattttgaaaactttcatgatttaaaataatacgtattaatcctactttttaaagacaacttaaattttgtgaatttctttagcaaatttatccttttttcctttgggctacttctagcctaacaccattcccatttctataatacagttaatttcaattttttatttcatctggtattttcaatcttttttttaaaataatgagtttttcagtttgtgtggataacaccactgagttctaactgtctcaaatcctcatataattgtttaggaggcatggtactcacaaaaaaggaaaaaaaaaaataacatggataactctgacagcctttccccagcagctgaggtccctgcttctctagagggtgcagattccccatcccaacaacttccactaaagtaaagtagtcggtggcattttgtcagcatataacttctggctccttggacaactgtgttttgtcttaacaaggaagctgaccttacccttaaaacctttcaacaaatgaaatgttactcatggttgtttttctggttgctttcttatcgcacaggtgttatacaaagaaaacatgggcaagggaacccctctacctgtcactcctgagatggagagagtcaaacacaatcaagaaaatattagctcggtacttgggcaagaaaagaaaaaaactacttactgattttaaaaactatttcatgatttmaaataatacatattaatcctattttctaaagacaaattttgtgaacttctttctttagcaaatttatccttttttcctttgggctacttctagcctaacaccatttccataatacagttaattttgattttttatttcatctgatattttcaatcattttttaaaaatgagtttttccgtttgtgtggataacaacactgagttctaacagtctcaaatcctcatgtgattgtttaggaggcaccgtactcacaaaaatgaaaaaaaataacatggataactctgacagcctttccccagcagctgaggtccctgcttctctagagggtgcagattccccatcccaacaacagcttccactaaagtagctggtggcattttgtcagcatataacttctggctccttggacgactgtgttttcttaacaaggaagttgaccttacccttaaaacctctcaacaaatgaaatgttactcatggttgtttttctggatgctttctcatcgcacaggtgttatacaaagaaaacatgggcaagggaactcctttasctgtcactcccgagatggagcgagtcaaacacaatcaagaaaatattagctcggtacttggcgagaaaagaaaaaaactacttactgattttaaaaactacttttatgatttaaaataatacatattaatcctactttttaaagacaacttaaattttgtgaaatttctttagcaaatttacccytttttcctttgggctayttctagcctaaccccataataacaaggttgctttaatccataaagttctamtatcaagaagtaacagattttcctataaaacatccttttgcttctctctctccaaacttactctctatccactacccccaaggtctctttgttttagatatgcttgaaatttaggacgggtacgtgtggggtggtggagtaggtccaatgcggctctttcttaaatatgattttgttgtgtttttgtgtcaatgacttcaggttctaatttaccctgtcagatttggacaaagagaccttgggaaaaataatccctgatcccctccttcaagaataatgatataaattatgatccaatagtagttttggcaattattgattatcaatttacttacttaaaaatgaaagtgtcaccagaatggctttttgttttaccagttttcgttttttgtttgttgttgttgttgttctttagttttactgtagtctttaactgcaaactttagtaaaccatttcccgtaagcttgtgctctgtgacattatatatggttgtaaattacctagggattgaggtttgcagggggacttcagctttcagtagcaaacaaccttgtggtgtccacatttccactatctgtaggtttctccagtacttgagtacagtgcttctaaaacattagcacgcatcagaataacgtgcagggtttgtgaagccagattgctgggtcctgctctagtttctcattctgtaggtctgttatagagggggccagagaatttgcatttttaacaagttctcattactgaccttgctgtccaaggaccccacgttgagaatcactatttcaacagaattcttcctcttcaatgtcatttcctaaatctcccacgtttccaagaatgacactgaggggagataccgaggttgaggatttatcatgatgtgttactatgtttctcattttccactgattcgccatgatagtgatataagagccaaaaaccttattccttaatgataagctgaatgttgtatgaaactaaagcaagaggcagagcatagaggatagcaaagaaaaagagggtaggggaaaccctttgctttgtctgagggcctacagttttactgatatgtctatgagagtttaagtgctgcaaaacagtccagtaaaaaaacagctgctgtgggccaggtgtggtggctcacgcctgtaatcccagcactttgggaggccaaggtgggcggatcacaaggtcagcagttcaagaccagcaagaccaacatagtgaaaccccgtctctactaaaaaatacaaaaattagccgggcatggtggtgcacgcctgtaatcccagctactcaggaggctgaggcagaagaatcacttgaacccgggaggcggaggttgcagtgagcagggatcgtgccattgcactccagcctgggtgacagagcaagactcctctgtctcaaaaacaaaacaaaacaaaacaaaaaaaaacaaacagctgatgtattaggarcagcctcaaccttctcagtgtgattgaagctcatgcctgtaactcctgtttggatcatctctcaggggcttgacattgagagactagcggtaaaatgatggtggtttctcatccttttgaggaacaccacaggtctctcttgcagtcctcaagggtttcagggcaggtgcctatcctggttgtgtcttgctgtaactacacttaacttccttaggaaacatactactttccatctaacctaattgcccaaatggtttggggccctaaagataatcaaaagttatctgtaccatttccttttttggtaactgttaactctttttctttttggctttttggacccattggattcccataggttttgtacaaagaaaatgtggggaaagccaccgcaacccctgtcactcctgagatgcagagagtcaaacgcaatcaagaaaacattagctcggtattgtcttgagaaacaaaagtgcttttaattttgcaaaataactcttgcagtttggcctgctcctaaccctgtcccaggttaaaaacaaacaaaatgccagttacatttgcatctgctctaaatatcacactacatttactgtagccattaactatttttaagctttcttcttgagaggtgttctcactaatagtaatagattaaacatarcatttccccccaacttgcaatataattaatagtgattattacctcgtagtgactttcgggcatgactttgtatctcacaggtgttatacaaagagaacctggggaaagcaacccccacaccctttactcctgagatggaaagagtgaaacgcaatcaagaaaactttagctcggtattttagaaaggaaaaataaatccttaaaatcttaacagccctggcaaacatggttgtaccactaatttatcttacagtttttccaaaacttttgtgtatctttaaaaattcttccttgtccacttaaaaacaacaaaccaaccccacgaggtcacagtgattttacttctttcttaaacttttgcttcctaccgtaacattttaatagctttaccttcagtgtgatataactgagccataacatgagccataacaccagctaagtgatgattttcagacctggttttctgctgtctgatgcctagatgctcttttggcttccctaggtattgtacaaagagaacatgagaaaagcaactccgacacctgttactccagagatggagagagctaagcgcaaccaagaaaacattagctcggtattttctaggactaaaaagaaatagtgcaacaacttggaaaataacattttaacatcataaaaacacgcctttctcattcaactgaaaaacacactaaaattttaaaagagaaaaatgcaacatcttggaaagtaacgttttaacaccataaaaatttgcacttattcaactgaaaatttacactaaaatagacattaactgtgcttttacattccaaaccatcatactaaacataacaagttaattgccaatgttttccttcccctatactttgaggtagttctacgtaaccaactataacaaatttacttcctaacatcctcaatcttctgctctcctttagttttaagatactttatgacatgggtaatactctgaaatggatgccttctttggatatattttggggttttagtgtctggaggactttgatttctatattagcatattggtttatgaagtctggacayaacctaaggaaaataatcacttgttttaaaggacagttctttcaaattccctacaatgtcagatttagagccaaataccatcgaatatgttgatgctgtaattcctagcaaatttcaagaggtcactctcttttcaaaattataccgtgccccttctttgaaaatgagtttcattttcgaagtcaaaacaagtcctttctcttccactggcgggcccttctggtccccagattagcctgttccaaaattggtcatgtgtctcactgggccccttcagttgacccaagcgtccctcaccagctcctatccatctctatctgctggaaaggctttgaggtttcagatttaggacagcaccactcattcayggtctctcctgcatcaggttctttattctgatagtttccggaaacaaatacaaggcaaagctgcctatgtattggatacccccgagatgagacgggtgagggagacccaacggcacatctcaacggtgagtcaggaattctttaggattggctggctgcctgtcagaatgtgtaaaaagggatwtagtcacaccatcatattttcataaagcaaattcatgacatttcaggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtaactgagcctgggttgggggaggggattaactttaagtgagggggtagaagaacaaaagtagcattacctacatcaagtcaaaacataaaggacttcaatctgtttttctagaggtgcaagaaagctcctattatctcatagtttacaaagctgatttctaccttatctttgttctcctctgaggaaaagacatgacccagaacctaagctggaataagtgtgattcaatcctttggtggttgttaaaattcatgccttggttttcaagttattggaaaactccaagaacacttgttctgatcactggtttccctttcaggttyacgtgtctggcgtactaatcctggttcggtttttgactatgatccagcagaagacaacatccagtcccgaagcttacacatgattaatggtgtgttagctraaaaaggcttacaacataaacatcaccatttagtatgctagagtcaakgactttcatttgggctctgaagttccttccctccagagttttccattttctgagctgcccatttggcataaaaataccttgttaactagtgagcaaaacttactttctagataagttcaagttagaaaaaattttgtttcactgcctcagtgcatgtctcccattattatcatttctaatttttcttccaaagaaaaaacagtagtaattctattggagaaataatgaaaatacataaaatacataggcaaagggaagagaaaggatttgacctgtaggaacttcctgagctctattgcatcaaggaagtttattcattacacaaagcaggctgcacaacttcattccttcttttcatgttaaaaagcagaatactagcctggaaaagagaatgagaccccttttctacaaacagtaaaaaaaaattagccgcgagtggtgttgtacacctgtagtaccagctgttcagggggctgaagtgggaggatagcttgagcctagaaagttgaagctgcagtgagccgtgattgtaccacygcccttcagcctgagcaacagagaccccatctcaaaaaaaaaaaaaaaggatattatgtagagacagtcctcaaaggatttatactccagttttctgatcaagacacagaagtaaatccatggttgcattctgacatgtgcaattttaaaggtctgcccatggtattttgggaacacagagaaagactctaaattgatttgcagttagggaggactttctggagaagttaaagatggagtctgaatgtgaatattactatttattcattttggtgagccaggaaaattggcagggtggaggggagatgttacaaatagactcttggatttgaaacctggctgtacaacttaactgttccatgacctttggtcatgtacgtaagctctcatctgtaaaaataagaaagacaaacctacatcagaataactgtgagggtttgacccatgggaaagtacttaaaaccatgcttggcaaagataacaataactgagattcaatcactgttaggcattactaccatagaaatttcatgtttgctacatctcccccaactgcatctctcccagtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacaggtacaagtgcctggcgctgattttggcagtcccacccggccagctcattgatggttactataagagatgctttgagtacaaaaacaaatttaaaaatttttcatcctttcctttaatgagaaaagactagaattgtggagggctgcatgaagttagatgtttcattttctttgatttctctttttggaaatcattctaagttgggggaaaaagayatcactcagctgctaaacacagattaaaggatacctagccatttttcttcttataaagaatttgccccctttttttcagcttacaaacatgcaaaaaccacagagctcccacaacaacgatcatcttcagttgctacccaacagacaacggtatcttccatcccatctcatccatckactgctggagtaagtgaataacaactcacttaaataaattattcttaatttttgatatgtgcaaacatgattataagtattaggtattacggttttttttaaccaaaccttctattttatataatgctcttttattacatgtttcatattaatgatatcagaaaactttcattatctaactcaaattaatgaaaagcattattcaataacttaaaaaaaaaacccaaacctagagcaaagcatcagttttggctcattggtctcacctactatcttaaacatttgctgggcatagtgaatcatgcctataatgccagcactttgggacgctgatgcaggaggattgcttgagctcaggagtttgagaccagcctakgcaacatagtgagacttcatctctactaaaaaccaaaaaattagccaggtgtggtggtgcatctatagccccagctactgaggaagttgaggtgggaggattgcttgagcctggaaatttgaggttgcagtgagccataactgcaccactgtactccagcctggatgacagagggagaccctgtctcaaaaatcaagaatgtatagatgtatgcaatgtgcccacatatatacatgccttatcttasatctcccctattaatatatatagaaatggtaagccaaatcatcttcacagttcaccagactacttcacaactcttagtttaaaaccctggatctcattcataatatcctcaaaagcctaatactttaggattgatatgaacaatctttgtatgaagacaactgtctttattaaatgacatacaagaaggtctaaataagtgttagacctattatatttaaggaagggaatactgtaaagttctaattttccctgaaataaaccaatgcattcaattccaatataaatcccaatagcatttaaagaaactgtgctaaccctaaaatttgaaaaagctgcaaggataatcaagtaaaatttgaaaatgataatacttaaggactcaactaaaaaagaacaaaacatactataaagctattaaaattaaatatggatttagcatggcaatagatacaaaatatcgatttagcatggcaatagatacaaaaatagatgaagtccagaaacagaccctaaaagaattataaatcagcaagaaaggggtaagttatttaattatatgatctgaggtaaccagttatctatttagtaaaataataaaattagatacccatctcaaagcataaactgtagctgtaccaaagatttagatgtaaaatacaaaattgtagaagtacaaagaataatacagaatactttttttttatttttagagacagggtctcactctatcacccaggctgcagtgtggtggcatgatcacagctcgctgcagtctcgacttcatggactcaagcaatcctccagcctcagccaccagaatagctaggactacaggtgtatatgccattctaggctaatttttttttttttttttttggtagaggctcactatgttgcccaggctggtctcaaacccctaggctcaagccctctgcctgctttggcctcctaaaatgctgggattacaggcatcagccactcagcccggccacaattattttaaaatataaaggggaaagccttcccaggcaaattccaaaatctagaagtataaaagtctggccaatttgatcataaaattttaaatgtttctataacaaataaatacaaacatgtcagactgggagaaaacatttacagcatacataacaaaaatattaatattgaaaaagaataaagaactctaaaattcactgataaattattcccctcgccctcaaaataggacttggaagactaagaatagataatttatggcaaaataaatataaatggccaacagaaaaaggtgttcaccatgactagtaaccaggaatataaaaataaaagtgctagtaaccaagaatataaaaataagataaagtacataatacaaagtatcaaattgaatcaaatatcatattgtatcatattcgaacattttaacagaaaacttaaaaaattaggtcaggaatagtggctcacacctgtaatcccagcactttaggaggtgggaggactgcttgagtccaggagtttaagaccagcctatgcaacaaggcaaaaccccatctctatttgtaaaattattttatacatatatatatatgtgtgtatgtataaaataagtttaaacacacatgccatttgacctaaaacttttaccttcaaaagctttttcttcagaaattatttgcccaaagataaacggtaggatgctcattatagtgtaagaaaaaatggtgacaactaaatgtccagaaaaatgaaaatggctgaataattcgtgatattattaaaatgtgaaattctctgcagcagtcaaaaagggtaagatacagctatatttacatggaaagacttccaagctatattaaatggaaagaacaaatcacagtattatttatagtaatgttccacttatgcaaaggggaaaggaaatctatttgtgaatttgaatatatgcatgtgattttgaatatatgcatgtgaatttcaaaatgcaagaaaaaaccatataggttacatccaaaactactaaccagtggctgctcctaggaagaaacttttgatattatcacttattatatacctccaaattattacaattttaacactgtggaggatagctttgagaaacttttactactcgtatgctcccaaattcccagagtgaaagatgacatgcaatagtgctacgggttttcaaattcttctctaaaatacaagactgacctcttcgaaaggtagaaaaaggccataaataaaattagcagcatattctgtcttttctgtcagtacacacacacgcacatgcgcacacacacacaatttcatgcatacataacttagtatgaagttcataaagtgtacaatgattttaagctttttttccaaccatctccataatctaattttagaatactttcatcaccataaaaaaaactgtattcaaaactcttctggtgaattaaaacaaacaaacaaatgctggtgcccattggcattcattctccatcccctttctgctccatccaatcctaggtatccatttcctgtcactatattatttggctacctaagacatttcatataaataaaaccatacaatatactgaccttggtgcatggcgtcctttacttttgaagttcatccatgttgtatcatgtgtcagtacttcattcttgttactaccccattcttgttactacccaataatagatctgtatggatataccagatcttgcttatgcattcatcagttggtgggcatttaagttgtttccactttttggctattatgagtaatgctgctacggacatggatgtacaaattattgtgcagacctatgtcttcattcttcttgggtatacacctaggagtggaatttgctgggccatagggtaatgctgtatttaacatgtgataactgccaaattcttttccaaggtggctgcactcttttccacttccaccagtggtttatgaaggacccaatttctccacatcctttctaatgtctgttattgtctgtcttttttatcatcaccattctggcatgtgtgaaggggtatctcattgtggttttaataatttgcattttccagatgactaattttgagcatcctttygtgtgctttttggctatttgtctatcttttttggagaaatgtctattcatatcctttgcctcttttggtgggggaaggcattragttgtaggagttcgtcatatgttctggatattaattgcctatcagatacatgacttgcaagtatttcctattttgtgggttccttttactttgttgatgcttgcacattctcttttgttcaacttaagtttgtggagtcagtcatgagagatcttacaaatagatgtgtgttaactgttgcaaatccaacayataatatttccccttttccatccccacgaatagaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaactctgtggatggaatgagcattatttatgtttaatggttttaatatctacctataaaaattcaatgaagcaaattgtacataaaattactaaaaaattatctaaatttaaaaaatgtactgttatgcctaagagtagacattctcaaaattctatctatacttgcattcagcaagcttctattacagttttaagaacatctgtggactccaatcctaacttcaagggcatctttcccatctgtatccagtaggatggcagcatgtggcaaaggcaaagggagaagaagcaaccataatggcttaatgtttaagtttacagactgttcttcctagaaggtaggtaagtccctgtaactttacagccgtagtaatgctgcctcaagcttcttaatgtgtctgagactcacagggagaaaatgctcttgtgaagagagcgcactcacttgcgaatgaccaacgtacacctctatgccaggcactgggttagaggctgaagctcaagtgaagaacaagagacagttgatgcccttagggaatttgcagacccaagaaaaggcagattatgcttaaccatccaaatggtgccaaatggtgctactctcctgctcccaagtcttccatcttgccttaaactggataaaaatgcaagtaggcaacaatcctattgtgatttccaactcccaaacttttagaatactaaagtatatgctatctccattacaatgagccatttttttgtttggagacagagtctccctctgttgcccaggctggagtgcagtggcccaatctctactcactgcaacctctccctcctgggttcaagtgattcttgtgtctcagcctcctgagtagctgggactacaggcgtgcgccaccactctgggctaatgtttgtattttcagtacagacagggttttgccatattggccagactggtcttgaactcctgacttcaggtgatccgaccacctcagcctcccaaagtgctgggattacaggcctgagccactggacctggcctggctggtttagttttaaatttcctatttactttatcggtttgccaaggcacactttgcaggtgctattgcaaagaacaacagaacctttgtctcttacagatttttctttaaagcctggaaaatgttcaacatgcagctggctttccaagatccttgagttccacatccacaaattcaaccaaccatgaatcaaaaatattcagaaaaaaaaagatggtcacatctgtactgaacagctagactttcttcttgtgattagtccttaaacaatacagtataacatatttacatacatttacattatattaggtattataatcaagagatgatttaaagcacaggtccccagcctttttggcactagggaccagttttgtggaagacaatttttccacacagtggggaacgaaactgttccacctcagatcaggtgttaggttctcataaggagcacaaacctagatccctcgcatgtgcagttcatgaagaatttactgcggccagtgagctgacaggaggcagagctcaggtggtaatgcttgctcaccggccactcgacctcctgctgtacagcctgtttcctaacaggccatggacctgtaccactccacagcccgtgggttggggaaccctgatttaaagtatatgggagaatgtgcataggttatatgctaatattaggtcattttacactagggattttaatatccataaggtaggggtggtcctgaaaccaataccccatggatattgagggatgactgtatatataaaagtagagaataatcctacatccaccaactagcctcaaaaattatcaactcatggttaaccctgtttcctctccaccaaaccaatgcactcctctcattaccttgtaacttccttatactgaatctcattatagattagtcacctttcagtgtgtatcttataaaggactcttaaaacattaatcacaagaaaattaacacaccttaaaaactggcaatcaatatccaatgttctaatcttcctgccatctgcttgtgcttgttggtccaacgatactagggaagtcctttgtatatatctccactaccacgtaggctgcaaagagccatcttcaagaaactataaaagggagaaattaggtctatgggttacatctcaatcaaatctcactcaaatgtatgaactgtattgtgtcccaccctcccacccccaaattcatgttaagtcctaacccccaaggcctcagaatgtgaccttgtaaataggatccttgcagatgctgttaattcagatgaggccctaatccaatggccttgctatccttataaaagggaaatttagacaaatacacaggcacataggtagaaagtcatatgaagatgggagattggggaaatacctctacctgtcaaaaatggccagcacaccaccaagctagctggggagaggtatgggacagataacttccacacagtccttagaaggaacaaaccctgctgataccatatctcagacctctactattcaaaactgagacaatacatttcagttgtttaacttattaggtttgtggtactgttacagcagccctaggaaactaatacagtgtctttcaacatcactgtttaccctaattgttgttgttgttgttttccttaaaactatggagcttttcttcggctgccatcaacatgcttggttctgcagaggaagttaaggtcatgttggggtgaggcatttacttcatctggtgactagcctggcagtgccacctctgccctcgcccacaccatgtggactgcctctccaagcttgcctgcatctactcagcccttatttgacgaaacctctcttctaacaagttcaatgagaaactgaactcattaacaacaacaacaacagaaaaaccaccacctctggatttagaaaccagtggaacccataaaactatgcataaatcagaaaacctctgtggttaaaaagcaggccataaaaggggaaaaagaaaaggaagggttcatgtttgtggaggaatataacatacactttgtggtatttgaattaaactattcatactcatttcagatctcacgaaaacaacaaaacaaaaaaccaaaatgtagccaacaaaaacaagtaccagagtttagtttttatagttttatttcaggtaaaagtgcatttcttaaaaaaatgtttcaatatccagtttccattggcaagtgataacagttaaccctcaatgattcatgaaaagttttactgtgaatcaaacatagaattctgccccccctcaacagtcataaagaaccagaaatagtaactgtaagtgtgcctacttcaaacactgtataaagcagtggtcccctaaccttttttcaacagggaccggtttcgtggagacaatttccacagacacaggtgttggggtagatggtttcaggatgagactgttccacctcagatcatcgggtattagattctcataatgagcgcacaacctagatctcttgcatgtgcagttcacaatagggttcacgctcctgtaagaatctaatgccacccaggggtttgagacccctagtataaagcattacacaatcaaataaaactgactgcaccattatttccattatttgcaggtaactgaggaatgaacaagtacttctgttaggcttcaacttaaatcatttttaagacttatcaaatacaaatactttgtgaatgtaaaactaagctctcttagcgtttaccaaatgatcgggacaacaatattagagggttaataaatgactgatttggcatctatcagtctttttgtaagtgctatcagtcaggtctatctacaggaggtagtgcagaaagcaactgataattcacagaccatcaaggtcccttaacatcatggcaaatacgtaactgtagtttgagagtttaagtaggaaaaagaagtgtacttataaagtagtagtgtttcctagtatctgtaatttgagcaatagtaaaacacgtaagtaaaatcaggagaagccattctggaaaacacaggggtaacagaaattaagtaatcaagaccacattctgccagctagaagcaaataactaaattgactaacatgccatgcatgagcaaaaccttcctccataaaagggattgacaaactctttaaaaggccaggcagtattttgactgttggaagccatacagactctgctatactactaaactcagccactgtaccaggaaagcagctaaagacaataagcacagctgttccaataaaactttatttctggatactgaaattttaatttaatatgttttcatgtgtcacaaaatgyccttcttttgacttttttcaccattaaaaaatgtaaaaaccagtctcagctcacagatagtacaaaaaacaggtggcatgctagtttaccaatctgtgctctgtaaaaaacttaggagttaagactgccatccttcagtttctatactcaaaaccaattttgctcttaattgttttcttttagaaacttcctattctataaaaataaaaaattctttagacacttgttagctattcaatagtgtatcaaaataattgttagactatactctattttcagttccatgacactttattttgaagatgatcttcctagttatatgttgtttatccgtttaagaaacaaagctgccttttgttggaaatacttattaacttactgcttttgtgggagtattaataatgtattttaacataatctctcagggtatttatgaacatcaattataatactgtgctatgtacagaatagctctcagagactataggctatcagctatttctgaagtatacaggagtatataggacagcttgtctctctactaaatgtactatgcattaaaattccagctcaatctgccttttccattctcttcaactcatcacttctcagtgcatcaacttctatcagcatataagcttgctgcccagtaaattcagctttatctacaattataaattggcacactgtggccaaaaatattccctctgctacaagtagagtacaaaagttagagtttttttcttacttgtgacatcaacaatggaaaatattgtcttcaattttttaggtaagatgaacggttatcttttattccaacggtatttacagcttaccataacacatttggttttaactgttctttggagaaaggaaggcttagtatgtaaagaaaaaaatgattaggaccacatcggaaaatttaacattctatttcagaactgagtaaattctcacaactgtttagactactatattaaatatttatagatcttcaaacttcaatgacttacactttaacggctacttgcaaagagcaatatgtaaagcctggcacataacatacttattaactggacatcagaaagcacgaaacccaatttgttttacagatcaaactatcaataaattttgataaatttttaaaacctattacttaactttcggctacattttccttagtgctttcagggtagttcttacagattatttaaatatgtgaggaaaatctaacaccttaacagaattccaagaaaaactcacttttcgagaatcatattattcaactccatctttcaaatttcactttacgatgaaacaggaattttcaaccacataatataacagaaaattaagtgaccagaggtccgcagtataatgacagggcatatctgctagactgacttattcattatagcactactaaatttaactgccagattaatattaggggtagtgttgattttccatgtttattaataacgatgatccataatagaaggcaagatttatttagagactaaatatattctaatacttagaaatcaacttttatattaacaaaaacataacccacaaatactcatgagaaaatactttgtctactttgccttatcaataagattctttataacttga

SEQ ID NO: 10654 - DNA, 41514 bp, Homo sapiens
  misc_feature (1)...(41514): n = A,T,C or G, or insertion/deletion polymorphism (see Tables 1-2)
ggtggacgccagaatcgcaccgctcccctggtccaagggcgcgtcctccctgaggaagagaggaggaagacggttaagcttcacctaaggaaataaggctgcattccttgttggccagcgtggtaatttctaacatgggaggaggtagaaactgttaaggggatcacgtagccaaaatacagacatattaaagggacatggggaagttcaaaacagctctaattttatcagcatgaagcctaactaaacagaaaatctcccagcatacatgccagaacccagagagctaagctggaagaaccctcaatgacacatggccctcttcctcatgggcaaggactaacccaaggctagaggcagggataaactcacattaacaatactaataacaggccaggtatggtagctcagacctataatctcagcactttggtgttgcgagaagtcagggaccccaaacggagggaccagctgaagccatggcagaagaatgtggattgtgaagatttcatggacatttattagttccccaaattaatacttttataatttcttatgcctgtctttactgcaatccctaaacataaattgtgaagatttcatagacacttatcacttccccagtcaatacccttgtgatttcctatgcctgtctttactttaatctcttaatcctgtcagccgaggaggatgtatgtcacctcgggaccctgtgataattgcgttgactgcacaaattgtagagcatgtgtgtttgaacaatatgaaatctgggcaccttgaaaaagaacaggataacagcaatgttcagggaacaagagagataaccttaaactctgaccgctggtgagccaggcggaacagagccatatttctcttccttcaaaagcaaatgggagatatatagctgaattctttttctcagcaaggaacatccctgagaaagagaatgcgcccctgagggtgggcctctgaaatggcccccttgggtgtggccatcttctggttgagactgtagggatgaaataagccccagtctcccatagcgctcccaggcttactaggatgaggagattcccgcctaataaattttggtcagaccggttactctcaaaccctgtctcctgataagatgttatcaatgacaatggtgcccgaaacttattagcaattttaattttgccccggtcctgtggtcctgcaatctcgccctgcctccatttgcctcgtgatattctattaccttgtgaagcacgtgatctctgtgacccacacctattcgtacactccctccccttctgaaaatccctaataaaaacttgctggttttacggctcaggaggcatcacggaacctaccgacatgtgatgtctcccccggacgcccagctttaaaatttctctcttttgtactctgtccctttatttctcaaaccggccgacgcttagggaaaattgaaaagaacctacgtgaaatatcgggggtgaattttgcccaatatctggctgaatttcccccaatactttgggaggacaaggcgagaggatcgcttgagctcaggagttcaagaccagcctgggtaacatggcgaaaccacgtctctacaaaaaactacaaaaattaggcagccctggcgcggtgcctcacacctgtaatcccagcactttgggaggccaaggcaggtggatcacgaggtcaggagatcgagaccatcctggccaacatggtaaaacctcgtctctactaaaaatacaaaaaaaaaattagccgggcatggtggtgcgtgcctgtagtcccagctactcaggaggctgagtcaggagaaccacttaaaccagggaggtggaggttgcagtgagccaagatagcgccactgcactccagcctggcaacagggcaagactccatctcaaaaaaaaattaggtatgttggcatgtgcctgtagtcccaggtacttagggggatgaggcgggagatcacctgaacccaggaggtcgaggctgcagggagttatgtttgtgcaactgcactccaaccggggtaacagagagaccctgtctcaaaaaataataataacgataaaacaaactgagccacaataccaatgataactaaagaaagccaccatacgaaacactcacatgctctacttttatatctcaattagctgaagttaacttcctacacccgccttcaaccattacttcaaggagccagtaagatgtgattactgacagaaactaaaagtatttagaaaagtcctaacactgtgctttttttttttttttttttgagacggagtcttgctgtgtcacccaggttggagagtgcggtggcgcaacctcggccgactgcaacctccgcctcctaggttcaagtgattctcccacctcagcctcccaagtagctgggactacaggcgcccaccagcatgcctggctatttttagtagagatggagtttcatcacattggcaaggctggctttgaacttctgacctcagtcagcaccctggcttcccaaagtgctgagattataggcatgagccaccgcacccggcactaacactgtactctttttttttttgggagacagagtcttgctctattccccaggctggagtgcaatgccgcaatctcagctctctgcaacctccgcctcccaggttcaagtgattcttgtgcctcagcctcccaagtagacgggattacaggtgcctgccaccacgcccagctaacttttttatttttagtagagacagggtttcgccatgttggccaggatggtctggaaattctgacctcaggtgatccacccaccttggcctcccaaagtgctgggattacaggcataagccaccgtgctcagccaacaatgtactcttaatgcctaacctaaaagttacttttacatgtctctcctgaggtgctacttatctgcaccactgtgtgacagaagctaagaattcagcaagtaggacaacaattgcttcttagaccctctggtcccattatcgaaccattaaagcaggccctgaaaaagcttccccacatctcaccctttattttcttgtgacttcttttctgcagcactgcagtcatagatgaagaggctgtcatcatcactaaagagaaataacaataattttaaaaggagttatcattagagagaaataacaaaatttttttttttgagacggagtttcgctctcgttgtccaggctccagtacaatggcacaatcttggctcaccgcaacctccgcctcccaggttcaaacgattctcctgcctcagcctccccagtagctgagattacaggcatgcaccagcactcccagctaatttttactttttgtagaaacggggtttctccatgttgatcagggtgatctcaaatccccaacctcaggtgatccaccaacctcagcctcccaaagtgctcacaggtgtgagccactgcgcctggcccgtgtgagccactgcgcctggccctaatttttttttttttttttttttttgagttggagtctcgctctatcactcaggctggagtgcaagggcatgatctcaggtcactgcaacctccccctcctggattcaagcaattctcccgcctcagccttcccggtagctggaattacaggtatctgccaccacgcctggctaatttttgtagttttggtagagacggggtttcgccatgttggccaggctggtctcaagctcctgacctcagatgatctgcccgcctcagcctcccaaagtgctgagattataggcagagccactgcgcccagcctaacaatgatttttaaaagagcactttgttaaaaaaaaaaaaaaaaagttgattttttttctctgtggaacaaaaaatatttgcacactcattaaattaaaagttgtatacttgacaagaaaactgtctagatacaatatttcagggaacagttaacaaactttatttgcttaatctcttattggagtacgtcatactgcatagttctgtgggaaaaaaaagttcagtaaaacaaatgagggataaatactcaacaggaattaatatgctattcttttaggcaccacaaaatctatgcgacatggttataagaaattacgggccgggcgcggtggttcacgcctgtaatcccagcactttgggaggccgagatgggcggatcacgaggtcaggagatcgagaccagcctggctaacacagtgaaacccccatctccactaaaaatataaaaaattagccaggcatggtggcaggcgcctgcagtcccaactactcgggaggctgaggcaggagaatggcgtgaacccgggaggcggagcttgcagtgagccaagatcgcgccactgcactccagcctgggcgacaaagcgagactcctcaaaaaaaaaaaaaaagaaaaaaaagaaattatgttctgatactgttgagcgttcagtgggattctgtatacaaatttcaaagagccattactatttagaaacatatctcacctacctgaaagtgttcccatgaccccaggcacttaccaacataagaatcacccattttccatactgaacctaaacttcggtttatcccatcctcaccccctggcacgtatcttgtacatatttatagcctttaaagcgagtgcaccaaaaaactttccatatggaaccgtggacttgtcttccaagtcagaaactccaccagccactagaatttcctcaaaatgcaaagactgaaggtaagcaaatcatgtctaatatatccacagctcactctggcagatattagaccgtgagtctctaaaacaaaatcatctgggatatgtgacgggtttctgagtacaatttttgtgagacctaacttaacatcgaattggctttctaaaaccaaacgaacaaaaaatatacagtatatctgacagacacgtcgtccgtttcaaatatgaaatcacaaataacctgggaaaggaaacgaggggctgaaactgacagcactactaattgctccgagagtcctgagttaggactgttccatcaacaaacatttactaagttaaaaatcccctgcgtcgtcctagcactggcgatacactaaggaaggagaataaaattacggaaagcaaaacccgagccgtgcgaagggccactagggaggtgcgcactgcgagctccacgtgcacccttgggttgggtaagtgtcggagatgacttggagccctaaggagcaattaaggccaggtgagtggatgcaggccgggaagagggaacagacaaccctgcaaaaagagggagcgcgcttggaggtcagtgagctcgcagtgagtaagcccctcccttctcaccagggagacccgagacccgcttcttcccagttctgcagagcgtgttcggccgggccttgctgactggtcagcgtcgccccacgtgctctacctacccggtccccgccggcgccgcggagaccggaagcgacccggcggcgctaaccgggcaagaacaccgcagaccagccatctagtgcaaggagcgcgccggagccggggagcggacgccgagagcggacggcgaaagcggaccctccaggcgcagagacgcggccaggccgagactgcggcggaggactcgtgggctggagcggagttccccggggtcaccccagagtgggtgcgaccaggcggtgcgggagaagcggggtcgccaggacccgacgcgcgcccgcagcctggtctccctgttccaagaccaaggccccctcacctgcttgctatggaggtggccaggaatcggctgccgccccgcaccaccaacgtctgcccgcacaacgccagtcccacagagcccgccatgtacccgcccgcctcaccgccatacacatgtgccagcccagagcctcttcctgtccgcaccggtcggtgacgccaggcgcagacgccgagagatgacgtataccccacgtaccgcgcatgctcaaggacgagcctgccttgagcatgcgtgaaaggtgctgtgaccgccctccgggttgtggctggtggccttcggtgtttcgggtttggcagttcactcaccaaggtgatctgatggagtgcacttcgcacgattccaagtacttgcctaatgttcatcctttcctctagacggggtagggctggttctggatctttttccgcggtagctggagagacgtaggacctgatgatggctactagatgcctggtaaatgatccttcaagaagtgaatgaaccgggggccgtggctcacatgaagtcagmagttcgagagcagcctgaccaatatggtgaaaccccgtttctactaaaagtacaaaaatttgttgggcgtggtggcgtgcgactgtagccccaactacttgggaggctgagacagaagaattgcctgaacccgggaggcggaggttgcagtgagtcgagatcgcccccgctgcactccagccagggcgacagagcgagactctctctcaaaaaaaaaaaaaatgtccaagatgtggtcatgggtgagggtgtctcgggtggcgtcaagtctgaggtcgctagaagtaagcctactgaatctttgcacttagacaagccacagatgccttaaaatctccgaactgtagtgatattttcaacccaaactatggttagtttccagtgttcatcccaagatccccaaaagcctcttacaatcccagcatcaggcacaaaatctaggatctcacggtctgttttagattggcttgtccggtgcagctcctcttgatccagagacttacaaactaaaaagattaattttctctcccgtgcacgcaatatatgatggtgagccgggaccagataaccacaataaatacttgcatgtgaaaatgagaagaggaggagacacagtaatcactggtccaaagcaattctgaaatcctactggaagatgttttcaggccctacaagaataagaagtcttaaccaggcccgagttctgcttcctgggagtatctccccaggctgtatctcagcacagctnttgcctctgccctcttgggtgtccctccttttccagcaccttcttggccatgttgaagaatgtgccctttgagaaactttctcaacctccttcctgtcattagcaaattgtgagcccacagaccttttttcactctaaactgttctgtccacattttggcagctggtggtgctttgttcactacaagtcccttaaaarctttatgggcttctcaagaatctgattcaggtgctctccatgcccaagaagccactcccactagtctttttttttttttttagacggagtctcgctctgtcgcccaggctgaagtgcaacctccacctcccgggttcacgccattctcctgcctcagcctcctgagtagctgggactacaggcgcccgccaccacgcctggctaattttttgtatttttcagtggagacggggtttcaccatgttagccaggatgttctggatctcctgaccttgtgatccgcctgcctcggcctcccaaagtgctgggattacaggcgtgagccaccgcgcccagccacttgttaacatttaaatcattgagatcaccttgacttcagcattattcttaaggccatattttattagcgccactctgaatttgatctttggcccaggttatgacttactttgagaacttgttaccaactattgggtctrataatactttccccagcttcaacccaaagtgtgctctaaattctgctggccagtttgtttgtttgtttgtttttaaccacactcttttctataagtgtctcaacatattcaagcaaaagaaacacaggttaatctcaacattatactgatatgatctttttcaagtcccagagttcagtagttgcctttttctctgcccatcttactgaagggcaacaattttacaaatccttcaccrtgacatagagttgttcaccatttgtccacctcccgtagttttcctcaccattgttccagtgttcactaccagtttccccactgcttttccagacttctagtccaaagctaatgccacatgttacagtagcacctactgctaggtacaaatgtctgtagcatgcatatcttccttgtagtcctagatatagatcaacaagctcataaaaactatggctttctttttttctttttttttgaggcggagtttcactcttgttgcccaggctggagtgcaatggcgtgatctccgctcaccaaaacctctgcctcccgggttcaagcgattctgcatcagcctcccaagtagctggaattacaggcatgtgccaccgtgcccagctaattttgtatttttagtagagacggggtttcaccatgttggccaggctggtctcaaactcctgacctcaattgattctcctaccttggcctcccaaagtgctgggattacaggcgtgatccatgatccatgttagtcaggctggtctcaaactcctgacctcaggtgatctgcccgcctcggcctcccaaagtgttgggattacaggcgtgagccactgcacccggcccaactatggccatttttataaatcattgattacattagcctagagtgagtgtgggctttctttttcaattaagaaacttatggattggccgggtgcagtggctcacacctgtaatcccaacactttaggaggccaaggcgagcagatcacctgaggtcaggagtttgagaccagcctggccaacacggtgaaaccccatctctactaaaaatacaaaaattagctgggcttggtggcatgcacctgtaatcccagctactcagaaggctgaggcaggagaatcactagaacccaggaggtggaggttacagtgagccaagatcacccattgcaytccagcctgggcaacaagggtgaaactccatctcagaaaaaagaaaaaaaaaacttatggattgttgtgttgtatttctagtcctgtcctgagcaaaaggtattaggaacctgagaatccttccattagcrcaatagaaaaatgggcaaaaaggccaggcacggtgactcacrcctgtaatcccagcactttgggaggccaaggtaggagaatcaattgaggtcaraagtttgagaccagcctggccaacatggggaaaccccatctctactaaaaatacaaaaatcaggctgggcgcagtggctaacgcctgtaatcccagcactttgagaggccaaggcaggtggatcatctgaggtcaggagtttgagaccagcctggccaacatagtgaaaccccgtctgtactaaaaatacaaaaattagccgggcatggtggcggacgcctgtagtcccagctacttgggaggctgaggcaggacaaccgcttgaacgtgggaggtggaggttgcaataagccgagatcatgccactgcactccagcctgggtgacggagcaagactccgtctcaaaaaaaaaaaaaaaaaaatagaaaaatcagctgggagtggtggtgcgtgcctgtagtcccagatactcaggaggctgaggtacgagaatcacttgaaccgaggaggtggagattgcagtgagccgagattgcgccactgcactccaacccgagtaacagagtgagactctgtctcaaaaaaaaaaaaaaaaagaaaaatgggcaagaagttaccctttttttttttttttttacaaactggcaagacgacataagcattgtcttatggtccttcagttaaaaaaaaaattgtgtaaaaacaaaaatggacaaagacccattaatttcatggtggttgtagtgggttgaaaggtggccccctaaaatgtatgtccacccctggaaactggggatgtgaccttttttggggaaagggtcttttctaatgtgattaagttaaggattgcaaaatgagagcatcctggatttgggtggaccctaaatcgaatgttatgtgtactgagaagagaarggagaagacagaggagaatgccagatgaagacagaaacagagattgaagttatgtggccataattcaaggattgctggcaacaccagaagccaagagaaagatgaggaagaattctcccctagacctttcagaaggagcrtggcccagccaacaccctgacttcagacttctggcctccagaactgtgagaataaattcttactgttgtaatccacctgatatgtggtaatgtgtacatttcagtgggttttagtatatatacagaattgtgcatccatcaccacaattttagaacattttcatcacccacaaaataaatcttaaacccagtagcagtcactccccctttcaccctccccataaacccctggtaaccattaatctactttgttttatggattttgctagtctggacatttcatataatctggcttctgtcactgaatattaggtttccaaggttcatggataytgtagcatgtatcagtacttcactgcttttcatggccgaataatattccactgaatgcatatatcacatatatcacattttgtttatctgctcattggttgataggcagtttgggatttcccaccttttggctataatgaataatggtgttgtgaacattccactgggaatggaattgttgagtcatatggtaacatttaaacttttcaggaactggccaggtgtggtggattgaacctgggaggtagaggttgcaatgagctgagattgcgccactgcactccagcctgggtgatggatcacacctgtaatcccagcactttgggaggccgaggtgggtggatcacaaggtcaggagttcgaaatcagcctgaccaacattgtgaaaccccacttctactaaaaatacaaaaattagctggtcgtggtgttgcgtacctgtaatcccagctactcaggaggctgaggcaggagaatcacttgaacccgggaggcagaggttgcagtgagccgagatcacgccattgcactccagcctgggcaacagagccagactccacctcaaaaaaaaaaaagtccttttcagggaccgccaagctgattcacaaagtggctacagcactttatagtcccaccagcactacattgtggttccagtttctccacatcctcaccatcacttgttattatgtcttttttgtttgtttttttccgacagagtctcactgtgtcccccagtctgaagtgcaatggtgcaatccagctcactgcaacctccctctctgagcttcaagtgattctcctgcctcagcctcccaagtagctgggattataggcacatgccaccacacccagctaatttttgtatttttgatagagacggggtttcaccatgttggccaggctggtctcgaatgcctgacttcaagtgatccgcccgccttggcttcccaaattgctgggattacaggcgtgaaccaacgcatctggacacatattatgtttctaaataggtgtgggtctctcattgaactgttatattctactgtcaaattgtctctccatgaataaataccacacagacctaatcaccctagcagcgtattaagatgtaataacttctagggcaagtcttcacccttttttcctcacattttcccccttctcctcctctcttcttcctcctccaagaaagccttgggtattcatagccctttattacttccatataaatgttataattagggcctggcacggtggctcatgcctgtaatcctagcactttgggaagccgaggcaggcagaccacctaaggtcaggagttcgagaccagcctggccaacatggtgaaaccccatctctactaaaaatacaaaattagccgggcatggtggcacgtgcctgtaatcccagctactctggaggctgaggcaggagaaccactgaacccaggaggcagaggttgcagtgagctgagatcgcaccattgcactccagcctgggcaaaaagcgcaaaactccatcaaaaaaaaatatatagatagatagatataaattaggttatcaatttcccccaaaatccctgctaggatattgattagaatgtaattgaatgtattttatatatattaaatctgtccccaggctgttccccaggctggagtacagtaatacaatcacagctcactgcagccttgacctcctcggctcaagtggattgtcccatcttggtctcctgagtggctgggactacaggtgtacatgaccatgacccattaacttttaagttttttgtagagacgggggtcttgttctgttgcccaggctagtgccaaatccccagcttcaggcaatcctcccacctcagcatagattttttttttttttttttttgagacagtcttgctctgtcacccaggctggagtacagtggcatgatctcggctcactgcaacctccacctgctgggttcaggcgattctcctgtctcagcctcccgagtagctgggactacaggcatgtgccaccaagcccagctaatttttgtatttttagtagagacagggttttgccatgttggccaggctggtctcgaactcctgacgtcaggcaatcccaccgccttggcctcccaaagtgctgggattacaggcatgagccaccgtgcccagcctagattttttttaagaacattcacgtttacaatatttaggagcaccttttcctcttgatttattaatgtcttacaataaaatattatcatcttattcagaaagcgtatgcacaaaattttaaattttatttttagcaaaaaataggcgattttgctagtgtacatgggatccttttwaaattttgtgtttgttgttggtgtctagaaatacaattgacttttgtaaattgttcacacgtccagcagttttgctgaattcttgaattcatttcaatgatgtttctagatgttccatgggctttgctagcaaacactgccagtttgcccascactttgccagcgtaaggcctgtgcccccagatatattcccagccttttggggaggagcggggagcccctgcaggctgtgcttctcagcctttgggtcattgcccgccgagctttacatttgtttacatttctttttaatgctaatggtatcatgtgtggtctgtaagtgtctatatgtgtagttttartaagtcttaactttttataaaccagcagcctcctggccggggatagccaatagccccagcccactgaaagcctggtgagcagaaagggaagagaaacaagggtgttcattcactggtaggatgtgtttcctgaacggctcctgctcctgctggacaagcccacagagggcccagcttccaacaggtgagccttcatgccccaccactactttttatttgatttgatttkatttttagacggagtttcactcttgttgcccaggctggagtgcaatggcgcaatctcgagtcactgcaacctctgccttctgagttcaagtgattctcctgcctcagcctcccgagtagctgggattacaggcaagcaccaccacgcccggctaattttgtatttttagtagagacggggtttctccgtgttggtcaggctggtctagaactcccaacctcaggtgatccgcccaccttggcctcccaaagttctgggattacaggtgtgggccacggcgcctggcctaattttttttttttttttttttattttataaagaggcagagtctcactattgcccaatctggtctcaaactccagggctcaagcaatcctcctgcctcagcctcctaaagtgcagaaattacaggcatgagccaccacatctggacccagcctctacttgttactgcaatatgcaatttggagcgacttaactgctcacraggaaatgtctcgtgtcacacggcattttaagtagatacttagagcacttgagctcaccacagtagcaacaggaggtggttgtgaaagattccagtagtgaggtatgtgctaacattagttttatgcagttgtgattgaatactgcatctttacatttacgtttctctcaactgtgaatgctgccatgtgtggtctctgtttctgtataaaagttttaataaatttaccagcctggccaacatggtgaaaccctgtctctactaaaaatacaaaacttagccgggcgtggtggcgtgtgcctgtaatccgagttactcgggaggctgaggcaggagaaytgcttgagcccgggtagcagaggttgcagtgagtgagccaagatcgtgctactgcactccagcctgagtgacaaagcaagactccgtgtcaaaaaaaaaacaaaaacaaaaacaaaaaaagtttttataaattttaatattttatcatcaatttgagtatattttaggtagtaaatgataaaattagtatctacatatattttatgcattcatgacataccattttcttaatttttcagtatttctaggctatgtggttcatcctagttttgacaaattatttcattcctacaaaaaatttttcaatatatttgttgaaaaaagctacatataagtggacccacatagctcaaacccacctatgccctacaagtgtcaactgagcgaacatagatagatacatagagagctagatatagatataagtatctatattatgaatatcagccaggcacagtggctcacccctgtaatctcagcactttgggaggccaaggccggtgtactacttgagctcaacagttccagaccagcctaggcaacatggtgaaaccctgtctctacaaaaaatacaaaaattagccaggtgtggtactgtgcacctgtagtcccagctacttgagaggctgaagtaggagaatcacctgagcctgagaaagtcaaggatgcagtgagccgagatagagccactgcactccagcctgggtgacagagtgagamcctgtctccaataaataaataaatcaataaatatcatacatatgtgtttcctattggtttttttttttctggaaaaccctatctatcacactggccaaattttgaagtatttgagctcacaataaatatacagtataaaggtttataattttttttttttttttttagagacagagtcttgctctgtcacccaggatggagtgcagtagagtgatctcagctcactgcaacctctgcctcctggattcaagcaattctcctgcctctgcctcccgagtagctgggattacaggtgcccaccaccacacccagctaatttttgttgtatttttagtagcgacagggtttcaccacgttggccaggctggtctcgaactccatacctcaggtgatctgcccgccttggcctcccaaagtgctgagactacaggcatgagccactatgcccagcctctaaatttatctttgattgcatctgatctttatttaatctagggttcaatctatatatatatagattgaaattgttcaagcaattctcctgcctcagcctcccgagtagctgagattacaggtatatgccaccatgcccagctaatttttgtatttttagtagagacggggtttcaccatgttggccaggctggtctcaaactcctgacctcagaagatccgccaacctcggcctcccaaagtgctgcgattacagacttgagccactgcgcctggccaatttttggttttttaaaacttgagatgtcctgaaacacaggaagtatatgtgttttttaacttcaaacttaagtaagaataggccttgagacatttttccccactcaaaacccaggctggctctacacatttccttgctagcagattgctttgcccagggtcacccatcactgacatgtagccctgcaagggtggcaacttcctctggcgatttccagcccactcccaagtgttctagccccaaggtctcatgttctctgaagtctgttacaccagagctctggctgctgagaccagtgcatgcttccagggtggcactgctgcctgtgatttcttgctacttctctgttttttttggatccctagagatatcctttacttgattatatggtcatttgaaattatgcctgtaaccttttacccagaattactacatgatttggagcccaagggttttccataactttttttctttttaattcgagaaggagtttcgttctgctgcccagtctggagtgcattggcaccatctcagctcactgcaacctcggcctcctgggttcacagctcccggccagttttccataatatctagtgaccaaatattgccagaaatagaacttattacttgtgttttaaaacacaattttaggcccatgtgcaatggcttgtgcctgtaacctagtgctttaggaggccgaggtgggaagattgcttgagccctggagtttgaaactgtagtgagctataaccaagccactgcactccagcctgggtgacagagtaagaacctaaaagaaaaaaatatatatattatatataccagaatacagagctgaggcatgcatgcgaatggtgtgatatttgagtatttttattttcctctttggcccaaacaccttggagttaaatgttcagagtatggatccaagtgatcctgttgtaatccagttatcctaaaaagaagttcrgccaggcacggtggctcacgactgtaaatcccagcactttaggaggccgaggtgggggatcacaaggtcaagagttcgagaccagcttgaccaacatggtgaaaccctgtctctactaaaaatacaaaaaaattagctgggcatggtggcacacgcctgtaatcccagctackcgggaggttgratcagaagaatctcttgaacccaggaggcggaggtttcagtgagccaagatcgcgccactgcactccagcctgggcagcagrgcgagactccgtctcaaaaaaaagaagtttaactgacccttgggagacacaagggggagcctctagtagttcaggtagaactttgtgtgatctacaaagaaaggaatataaacaaacatacacttttaaggttttgtgttaaaatgctgggtactacttgctagagctacaggcagagttgatggtgcccacagaaagactctgggcagagagttaactggaggaacagcctctgctgtcggaaaaatctagtctactattttctagctgattggaaaatacaataatgtatttgtctggcctctgctttttttattttaatgcagcaccttatatttgcttcttgcacttggccctgtcctttctctttggccaaacacagtttaggccacagttacctcccaaccaggctgcataggcttcccagccttcctactccctctagtcttaggcactggcctcacacatggttgccctagttacctttcgaggccctaatcacttccttcaaaaaccatcaagatggctaagcatagtggctcatggctgtaatcccagcactttgggaggccgatgcaggcagatcacttgaggtcaagagttacaaaccagcctgaccaacatggtgaaacactatctctactaaaaatacaaaaattagatgggcatggtggcggcgcctgtaatcccagctactggggaggctgaggcaagagaatcacttgaacccaggaggcggaggttgcagtaagccgagattgcccctgcgccactgcactctagcctgggcaacagagtgagattctgtctcaaaaaaaaaaaaaaaatcaagatggttcatgccccctcaaccataggtaccccacctttaccaacctggccggtgaccatgccagaggaggtcttttctttttgtttcttcttgagtgttgcaactccagcaagatgtcaacatctgccgcatgtgcccgctggtggtggtgtggaagtggggagctccaggtccatgaaggagggtgacgtggatcttccaattccagatcaggatccccaaatttgttactaagctgtgaattattaagcacacctcccaaaggcgagcatgaccttttccctggacacaacagaatgagcctagtggtgaagaaaaaaaaaatctggccgggtgtagtggctcacgcctgtaaccccagcactttgggaggccgaggcgggcgatcatttgaggtcaggagttcgagaccagtctggccaacatggtgaaaccccgtcgctactaaaaatacaaaaattagccgggcgtggtggctcatgcctgttgtcccagctactcaggaggctgagggaggagaatcgcttgaacctaggaagtggagcttgcagtgagcctagattgtgccactgtactccagcctgggcaacagagcaagactctgtctcaaaaaaaaaaatttaggccaggcacagtggctcacacctgtaatcccagggctttgggaggccgagaygggtggatcacgaggtcaggagatggagaccatcctggctaacacggtgaaaccctgtctctactaaaaattacaaaaatttagccgggcgtggtggcgggtgcctgtagtcccagctactcgggaggctgaggcaagagaatggcgtgaacccgggaggcggagcttgcaatgagccaagatggcgccactgcacgccagcctgggctacagagcaagactccgtctcaaaaaaaaaaaaaaaatttaaacaaaaaaaaaatcttttggcayttttttttctccctttagggacaaaggatcccttctcatgattatcctaagatctaaggttattctttttgcctcccagggtggatggtggcagatgcccttgcatttacttgatagcagactcctctttgataaaggcctttgataaaggcctcattccgccagtttatcttgccacctcaatgaatcrctagctgtrtcaggaatccctacacaatccatttaaatgactgtggcagggcctcttcccctgtggaagctgaaggtggcacgtccatctccgatgaaatgcgaatggggctctgggcacgcggcggaaggcagagaagaggcagagaaagaagctaataactaattacaccgactccacaattacgactaacgttggggncgaactctttgctaaataaacatttaggtgaaacaaagcttccatttccaatcggcctaactctggtattagcgttggcaggggccatgcaggaggggcagtgagcagtggtggccgcgttgccgacagagggtgagggagctgggcgcgtggtgtgggcgccgaggtccsgagctgaagagctttaaaacctctcaaaacacagaactatcaatcaagtaggaccagactgtgcccccagggaaggtcgcagatttaaggctgcgaggacaagggcaaagaagtgcgaagcgttcgggtggacatgcaagccggcccagcgcagacgcctgagaggggtgcccagcagcccccgcaggtctccgccgcgcccccgccacagcncccaggcgcccgcagggcacagggatcggcaccagccgstgacgtgtccctcacgctgctgcctgtgattggtggtcccgatccggggcgtggccccaagggaggcacttngccctactggggatgcgcgcgcagacccacggcctctgctccgcccccagctggcctgtaattggcgcagtcggcccaaggggcggctgttcaggcgcgggtgcgcgcgcagctgctgtggccctgcttggtgcgcccgctgtcaccgccatggctgccccgtgtttgctgcggcaaggacgagccggggcgctgaaggtaaaggaggagccagcctgggctggctgcgcggccccgagcctacgtaggggatggggtgagggggcgcggtgctggtcaggtccgggcctgtccgcgacctctagccgtcctagttgggccgctgaccccgctccctgggcccaggactgaccgccacggggccaggcccggatgtggccagcgagcgtcccgcggttcccccgagccggtccgccgccgccgctgcccgaggcccaggccgaggctggcgtgccccgtgccgacgggcgctcccgagggctgcatgcctgggcggcagactcgggtggacgttcccaggtgatgctgccgcgcggctggggtcagccgctgtgcggctcccgcacggcttctctgaaggacagtgacttctccatttagccaagagaggaaatgagggaactttcagggacctggttaacttggtaacttactgacagccgttgagaagccagctgacatgacctgacctgtgaaaaggagaagaagggctttcttttcggcaaataaaaagctaaggccaaggccgggcgcggacactttgggattttgcctgtaatcccagtactttggaaggccgagccaggcggatcgcttgagttcaggagttcgagactagcctggccaacatgtcgaaaccccgtctctaaaaaatacaaaaaattagtctggcgtggtggtgcattcctgtaatcccagctactcgggaggctgaggtgggaggatcccatgaacccgggacgcggaggttgcagtgagccgagatcataccactgcactccagcctgggggacagaataaataaataaataaaataaggctaagaccacttcactctcttacaaattttaaaatggctgttattacaaaagcagtaactattccctgcagaatatatatgcgtgtgtgtatatatatatataaatacatattatatatattatatataaatatatattatatatatatttatataatatgtaaatatatattatatatttatataatatataatatattatataaatatatattatataatatatataatatgtttatataaatatatattatatatttatatatttatataatatataatatatatttatatattatatataatatatatcataatataatatataatatatatatatttttttttgagacagagcctcactctgttgcccaggcccaggctggagtgcaatggcaccatctcaactccctgcaacttctgccccctgggattaagcgactctcgtgcctcagcctgcagaataatttaaaagtacagatagggaaattcattgacagtctaccattactccttcaagcatctagttcctaacgatttctatcagcttttatatgttcacataagcacatgtactcatgcttacaatcatgaacatacacgttttcatgtttatatgtgcacatacaggcacctctgttctgtatccagcatctagaacattgtactgtctagcacttaataggccttagtgagtatatgctgagtgagttggcataatataaaatatcacatttatattgtagacacttttgaagcagtttttatatacctacatcattttagtggccagatagtatttcttctactctattttctaaggataagaaaacattttacagaaagaaacatagggcctggcaggtggctcatgcctgtaatcccagtactttgggaggccaagacaggtggatcatttgaggtcaggcattcgagaccaacatggtgaaaccccatctctactaaaaatacaagaagagccaagcgcggtagctcacacctgtaatgccagtactttgagaagccaaggtgggtggataacctgaggccaggaaytcgagaccaacctgatcaacatggtgaaaccccgtctctactaaatacaaaaacttggccgggcatggtgatgcatgcctgtaatcccagctacttgggtggctgagacaggagaattgcttgaacccacgaggcggagattgtagtgagccgaggttgcgccactgtgctccagccagggtgacagagcaagactccatctcaaaaaacaaaatacaaaaacattagccaggtgcggtggtgcacacctgtaattccagctacttgggaggctgaggcaagagaatcgctggaacccaggaggcggaggttgcagtgagccaagattgagccactgcactccagcctgggagtcagagtgagaccctgtctccaaaaaaaaaaaaaagaaaagaaaaaagaagaaacgtggtattttgtaggttaataaataattggagactacaaaaaaaatgcactggagaacgtctggttgaagttttattaaaccaaatattaatagtgattgtccttgaactcgggtgttttcttcttgcagcctttttgtattttacaaaatgtccataatatacatacattatgaaaactgtaataaccattagaagtataccatgtgaatgttttgcacttacatgtagtggtaatatgtaatattcatatgcacggtacctacatgcacacaatcccagcactttggttgtttttcttttttttttttttttyctgagacagtctcactctgttgtccaggctggagtgcagtggcgtgatctcagctcactgcaacctccacctcctgagtctaagcaattctcctgcctcagcctctgcagtacctggaactacaggcatgcaccaccgtgcctggctaaatttttttttttttttttttttttgcgacagagtcttgctctgtcgcccaggctagagtgcagtggcacgatcttggctcactgcaagcttcacctcctgggtccacgccattctcctgcctcagcctcccaagtagctgggactacaggcacccgccaccatgcccggctaattttttgtatttttagtagagacggggtttcaccgtgttagccaggatagtctcgatctcctgacctcatgatccacacgcctcggcctcccaaagtgctaggattacagtcgcaccgcgcccggccttttttttgtatttttagtagagacggggttgtccaggctggtctcagaactcctgacctcaagtgatccgcccacctcagcctcccaaagtgctgggattataggtgtaagccaccgcacctggccaatcccagcacttcaggaggccggggcttcaggatcgcttgaggccaggagtttgaggaagccaggagtttgagaccaacctgggccacgtagccagatctcgtctctataaaaaataaaaaatattagccaggcatggtagtatgtgcctgtagtcctggctatgtcagagtatcgcttggacccaggagttgaaggctgcagtgagccatgattgtgccactgcactccagcctggacgactgagagagacccctgactcaaaaaatatatatatatattcatatatagtaccagctattataatggcattactctaaacatccatattcattaattcttttgtcagactatgctccaggaagcccaggtgtttcgaggacttgcttctacggtttctttgtctgcggaatcagggaagagtgaaaagggtcagccacagaattccaagaagcaaagtccaccaaaaagtaagattttgatggtagtcataagggaaagagaatgcaaaaagaaaatagattagtcagccttcraagcacgacagtgagttttactagctacgtaatttatgcttcttccttttcagcagtgtccagattatacaagacacaagatctayaacagattttagaccaaacatttcagtcatgtcgtagtctttgactgaatatttagccctgaaatggttttycctgtattttctaaatgccaaaccccaacctgaagtgagtgatgccttggtaaaggctctgtggcatttagatggccccggcacagtgagcttgccagaaagccaccttactttccatcctctgatgctgagttgtttgttttgttttgttttgttttgttttgtttcagtctctttgagacccatctgtggttttccaggctttgcttaatcccagtccaggactagctgggactacaggcatgtgccaccacgtctggctaattttttgtatttttagtagagacagggtttcacaatgttagccaggatggtctcaatctcctgaccttgttatccacccgcctcggcctcccaaagtgttgggattacaggcgtgagccactgcgcccggcctaaatctttaattcttttttttgagatggagtcctgctctgttgcccctgctggagtgcagtggcgcaatctcggctcactacaacctccgcctcctgggttcacaccattctcctgcctcggcctcctgagtagctgggactacaggcgcccaccaccatgcccagctaattttttacatttttagtagaggtggggtttcaccrtkttagccrggatggkcttgatctcctgaccttgtgatccgcccgccttggcctcccagagtgctggaattacaggcgtgagccaccgyrcccggtcctaaatctttaatcattatatggggttgtagaatagtaattgagtttggtcttattttcatcaatatactatttcctcagtttgaatgtttgaaagtatttagattcttttgttttcttcctccttggtctgtgcacagaacactggtaagtttttaaatatttgtatttatacaaagagagtgccagcccctgactgcctctcacagtgtgtggacttgaggcttggattccacgggaatgttatttagttttgtgctatgactcctgcctcgtttttcaatcattgtttttttctcttcttccttttatgttatttgttttaagagaggggctctggctctctctcccaggctggagtgcagtggcacagtcatagctcactacagcctcaaactcctgagctcaagcaatcctcccacctcagcctcctgagtagctgagactacaggcacataccaccactcctggcatatccctggcatgttttgttgatgttgttgtttattttttgaaatagagtcttgctctgtcacccaggctgtagtacagaggcacaatcataggtcactgcagcctcgaccttccaagctcaagtgatcctcccacctcagcctctggagtagccaggactacaggtgcacaccatcacaccctggctaatattttaattttccatacagacgaagtctcactgtattgcctagactggtcttgaattcctgggctcaagcaatctccctgcctcaaactcccatagtattgggattacaggtgtgagccactgtgtccagcctacctggcatgtttttgacattctctaaatgtttactgatgaacaattagttgaatttcattgctaacattatccnctcctttggtgaattttagtctgtgtctgcaatcctacatcatagacttatgaatttggattaaatggattttaaaatatcatggcagagccaaagagccccctttttagatacatgcgtctgtgtgtgagtggaaacrgagtgcttcattctgtggccatctgggttgtggtttggggaggggaacactgacctgggagcgagccttgggctctcatggagctcctgcctctgtccttgacgggccctgcaggcctctgagcctcggttcctttgtgcttaagcaggatgatcatgccagccttgctgggtggttgtgagactggctgcagtgggatacacgtagctactgcacacactgcagagagctttcaggtgggaggacagttttcagaactaagctcatcaatacacagaacagttgtatcttgtttttttttgagacagagttttgctctttatgcccaggctggagtgcaatggcgtgatctcagctcaccacaacctctccgcctccctgattcaagcaattctcctgcctcagcctcccaagtaactgggattacaggcatgcaccaccacgcctggctaattttttgtttttttgttttgtttttgcgataaagtctcactctgtcgccaggctagagtgcagtggcacgatctcggctcactgcaacctccgcctcctgggttcaagccattctcctgccccatcctcccgaatagctgggactacaggtgcccgccaccaaacccggcaaatttttctgtttttagtagagacggggtttcaccatgttggccaggttggtctccatctcttgacctcgtgatccgtccgccttggcctcccaaagtgctgggattacaggcgtgagccactgcacccagccaattttttgtattttttagtagagacagggtttctgcatgttggccaggctggttttgaactccygacctcagatgatcctcctgcctcaacctcccaaagttgctgggattacaggcatgagccaccgcacctggccatgtatctcataatttttaaaagaattcctgtacaggctgggcgtgggggttcacgcctataatcccagaactttgggaagctgaggcrggaggatcagttgagttcagcagtttgagacaagcctgagcaacatagtgaaaacctatctctagaaaaaactttaaaaagtagctgggtatggtagcgtgcacctgtggtcctagttactcaggaggctgagacgagaggatcatttgagcccaggaggtcgaggttgtagtgaattatgattgcaccactgctgcactccatcctgggtgatagagtgagaccctgtctcgacaaaaataaatactgagtctgggtatggtggctcacacctgtaatcccagcacttttgcaggccaaggcgggccgatcacttgaggtcaggagttcgagaacagcctggccaatatggtgaaacccctgtctctactaaaaatacaaaaattagctgggcatggtggcggacgcctgtaatcccagtcgctcaggaggctgaggcaggagaatcgcttggacccaggaggcagaggttgcaatgagctgagattgtgccattgcactgcttcttgggtgtcacagcgacactccatctcaaaacaaacaaacaaaaaatccctgtacaaagaaaaataaataatgcttgtaaatggatacgtgcaggcccatattttcccctgaagtgttggtagttggtaagtgtaagatacagaggaacttttcaccctccatggcacattgccagatcaaacctttctcagccagaagtggctttggaagctctaacagaagtttcctgcatgcaagtgaggtacccaaagctctcatccttggagtcacatctctagtcagagtgtctgccacaggacaagaccctggcgcgatgggacatgctgtgccttatttcatcagaggtgtccagctttccccagcacatgcgttctccctgaggaaggctgccggcacagatatcaggggctggatgttcttggaggtgcaccttggggaaccgctgggctctctagcttgctgtttccttgaatccagtacccaggcctaattttgcaacagtcagtaataaattgttgactgagtaatttctgtgtagctttttgaagagtatgtccagaagccacagttaattatccatttgaagtccttgtttcagttttaaaagtaaggaatatctggaaatagaaatttcacgtaatttctatttacacacagtgtaaatagtggctcagtaaaaaaataggcacagtggctcacttctgtaatcccagcactttgggaggctgaggtgggtggatcacctgaggtcaggagttcgagaccagcctgaccaacattgtgaaaacctgtatctactaaaaatacaaaaaaaaattagccgggcgtggtggtgcatgcttgtagtcccagctactcgggaggctgaggcaggagaatcacttgaacccaggaggtggaggttgcagtgagccaagatcacgccattgcactctagcctgacccaaaagagtgaaactccatctcaaaaaaaaattacccaggcgtggtggcacacaactgtagtaccagctactcgggaggctgaggcaggaagatcacttgagcccaggaggcrgaggtttcactgagccgagatttgcaccactgcactccagcctgggtgactgagctagactccatctcaaaaaaaaaaaaaagaaaacgaaattttacgtatcaaattataacaagcagtgccaggcactgttctaagcactcttcccatatctcatcttccccagtcctcaacaacccagggagtagatgctactgctatccccatgtcatagacaaggaagttgaggtctggagggactgacctgcctgagtcatgcagtgtccacacaggtgtcagcggagaagcctggatttgaacccaggcattctggcagtgcggtttatattttaatcactgtgctgtcttccttctgaaaattcttgattctcatgtgtttatttaaaaataaaatgccgggcacggtggctcacgcctgtaatcccagcactttgggaggccaaggcgggcagatcacctgaggtcgggagttcgagtccagcctgaccaacatggagaaaccctgtctctactaaaaatacaaaattagctgggtgtggtggcgcatgcctgtaatcccagctattcgggaggctgaggcagcagaattgcttgaacctgggaggcagaggttgcggtgactsgagatcgtgccattgcactccagcctgggcaacaagagtgaaactccatttcaaaagaagaattagataaataaataaataaaataagtaaaaataaaaaaaaactttttatagtgaaacacttgtagaggtttccattaccatataaaatttgagtaactttattctctaatgtaatgtttaaatgcacctctgtttctgaatgtgccttgtttccaaagttagttttgtgatattttgacaagatgtgcaagtattttaaggttgctaatctatgtttcacaccctaaccctttttacttttgatagggggatcactaaaaacttgaaggccatgccctcacttttcaactaagcagaaaagagattcaggaaatttgagttctattttgaggtgacagggaagcaacaaggcgaattcctgctttcactaattactagtacagtatttgtaaacctttattttacatagtttgttatggtctctgagagaagagaaacagtctctgaaagtccccatctcaggctgtgagataggcctacacagctagtcttaggtcggtagttttgtgttttattatacagtcatccttcagtatctgaggggaattggttctaggccacccctcccaccaggattccaaaatgtgcagatgctcaagtctctgatatacagtgatgcagtatttgcatatcatctaagtacatcctcctgtatactttaaatcatctctagattacttataatacctcatacaatgtaaatgccatgtaaatagttgttgtattgtttagggaataatgtcaaggaaaaaagtttgttcatgttcagtactaaagcagatgattttctgaacattttccatcctcagttggttgcttggtgggtttctatgggacctgtcttaggatgattgcattgaagatactgtcagtaataagtaatgtgtcatgaaatgtctgtaattttgactgagttttaagttgttttgttaaataacattcctctttatgccgtttcccagatgtagtggaaccaaaggagaggggcaagctcctagccacccagacagcagctgaattrtctaaaaacttatcttcacccagttcttacccgccagctgtgaataagggcaggaaggtagytagtcccagtcccagtggcagcgtgctattcacagatgaaggggttccraaatttttgtcaagaaagactttggtagagtttccacagaaagttctgtctccattcagaaaacagggctctgattcagaagctcgtcaggtgggtcggaaagtgacgtcgccttcgtcttcatcctcntccagctcctctgattctgaatctgatgatgaggctgacgtttcagaggtcactcctcgagtggtgagcaaaggcagaggggggcttcgaaaaccagaggcctctcattcctttgaaaacagagcccccygagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcrccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccragggcgaggccatggaagatgcagccgcgccagggracgaccgaggcggcacacagggtataccttgactcgygctcccaagtgcaccctgtcccttagggtagtgaggcaaaagaactaatttacatatgcttgtagagcagtgttacaattagtcaaattctgtactagaaatayggcctgtaacgctgtctcagccaggcagaaaagtatgtcttaattatggacaatccacatctttatatttagaatccctaaaatatttaacgttcttttttttttttttttttgagatggtgtcttgctctgttgcccaggtagagtgcagtggcgcgatctctgctcactacaacttccatctcaagcacttcccctgcctcagcctcccaagtagctgagattacaggcgcaggccaccacacctggctaattttttttgtatttttagtagagatggggtttcaccgtgttggccaggctggcctcgaactcctgacctcaggcaattcacccgcctcggcctcccaaagtgctgggattacaggcatgagcaaccccaccctgcttaaccttcatctttttttttttttgagacagagtcttgctccatctccaggctggagtgtaatggtgcaatcttggctcactgcaacctctgcctcccaggttcaagccattctcctgcctcagcctcctgagtagctgggattacagtcccccaccaccatgyccagctaatttttgtatttttagtagagacggggtttcaccatgttggccaggatggtctcaatctcctgacctcatgatcagcctgcctcggcctcccaaagtgctgggattacaggcctgagccaccgtgcccggcccccaaccttcatcttaaagagtatgtccttggcactcttcactatttcttaaccggtataatttttgaaaactggcagcttaacattgtcaccactgacttttgaaggtgtccaagtgttcattgatgaccttgtggggcatctcgctaagtgaaaaggggagcctccggtttaacttgcataggtgaagagcagtagctagtcgcttggcgtgagagtctttgggtaaactagatgattgctttcagcatcctgtgcacagggcagattcatagttcaggaattaaagcagtaagtgttgtacaggtcagccgctgcatacgcatyctttcccctggacagcgtttccttctctggttaactgaaaacacatgtgggctgctttactcttctagaagacattttatgaagggttttttgtttgtttgtttgtttgtttgtttttgacatgggttttgctcttgttgcccaggctggagtacaatggcgcaatcttggctcactgtaacctccgcctcctgggttcaagtgattctccagcctcagcctccaaagtagctgggattacaggcgtgtggcaccacccccggctaatttttgtatttttagtagagacagggttttaccatgtwggccaggctggtctcgaactcctgaccttaggtgatccacctgcctcggcctcccaaagtgctgggattacaggcatgagccaccgtgcctagcgtgtggaggcttttaaagggcaacagtatttattcctatgatgttaccatttttttttttttttttggagatggaatctcactctgtcacccaggctgcagtacagtggcgcaatcttggctcactgccggctccacctcccacgtacaaacgattctcctgcctcagcctcctgagtaggtgccactacaggtgcctgccaccacgcctggctaattattgtatttttagtagagacagcgttttgccatgttggtcaggttggtctcgaactcctgaccgcgggtgatccacctgcctctgcctcccaaagtgctgggatttcaggcgtgagccactgcgcccagctatgttaccattttcttgagcacgaaacttgataagatgcaatgngctttaggtgggtcgtggcaaacatgaaaaggcaagcttccgttttagaatccatggctcttcttgaagacttctctaaagtgcatgatccctaacaagcgcggctccgtcctgtgtctgctctccatcctctgtaccgccgccccttgccttatgtgccttacatgacgccttcttgttcttggttcgttgtgcgacaggatctatgtgttttcccccctctccgtctgctctttgatcagtacgccaagtgccggtgcttgccagacttcccagcccttaggaactgcatttcctgatgctgctgctttcactcctcctgctcgaaaatggagacgaataacacaactcgcaggataaaaacagaattgggagttttcagactgcaaacctttctgaagagaaagttctaatatttcacgggtgtgttgtttcttaactatcttctgtgcgcatgcgcagagcccaccttgcagagccgtgtctgtatggggccgcggtctcactaggcagtccgtgccccagtactggccttccaggtagagtggttttagatcagagttttgtaacccacgtcttggtcagttatcaccctccctatagtaactaaaatagtacgttctgctttgaaggtgtccctacaccacaccgaagatactcaccttgtggagattggaaggatgccagctctttaaatyagacatcgtttttgcttaacgtaacttaaaaatgaaaaacagagcttttgatattaattgaaatagtgagaaaataaatgtatttaggttatttttttgtggagcatgaatggaagttaagacagacctaatgacctgatttacagaaattgagtcagtacaaatcttaacccaaatatcagcctgtgttcccgtgctggttttgattttgccattatgttatattgtgtgtcctgctgcaggagaccagtacttcttttgcctcaacccctacttgtagtttcgaattaccaaatgtttaaatgctgtgttgttgttattagaatttatctaattttcttgtatcagagattcagaaggctcctttagtttaagcttttcaaaaaaaattttttatttgacagacgtgctctgtcccacaggctggagtgcagtgatgtgatctcagctcactgcaacctccacctcccagtctcaagcaatcctcccacctcagcctcctgagtagctggagactacaggtgtgccaccatgccctactaatttttttttttttttttttttgagacagagtctaactttgtcaccaggctggagtgcagtgatgcagtctcaggtcattgcaatctctgcctcctgggttcaagcaattcttgtgcctcagcctcctgacatagctgggattacaggagtatgccaccacacctgctaacttttgtaactttagtggagacagggtttcaccttgttggccaggctgctctcaaactcctggcctcaagcaatctgcccgcctcagcctctcaaagtgctaggattacaggtgtgagccactgctactggcccctgctaattttttattctttgtagagacagagtctcactattttgcccagaatgatctagaactcctgagctcaagcaatcctcccacctcggcctcccaaagtgctgggattatgggcgtaagccaccatgcccagcccagatttctaatagaggtagattttatcatgcatctctaagttacctgaaagtcctgctataattgttctaggcattttcaaacttttgagaagcctagaagtatacaaactaagatgttaagacacgttgtatggcctggcatggtggctcacgcctgtaatcccagcactttgggaggtcgaggcgggcagatcacttgagctcaggaaatcgaaaccaccctggccaacatggtgaaaccccgtctctactaaaaatacaaaaattagccaggcrtggtggcagacgcctgtaatcccagctacttgggagactgaggcaggagaatcacttgaagctgggaggtggaggtttgcagtgagctgagatcgcaccgctgcactccagcctagacaacagagtgagactccatctcaaaaaaaaaaacgcattgtaataactattccatttcttaaattggaaggctgtatgttttagaataaacttccaagtaatatctttctttttctttactgtggcttttgtaggcttttcttttttaattagacaatttgttcctcacagatagggttgatgaagaacgcttggtaggtaagcacctgtgtgtgagccgagtcattcataaagaactgttcacagataggttgatgaagaatgcttggtaggtaagcgcctgtgtgtgagccgagtcattcataaagagctgttcacagatagggttgatgaagaatgcttggtaggtaagcacctgtgtgtgagccgagtcattcataaagagctgttcacagatagggttgatgaagaatgcttggtaggtaagcgcctgtgtgtgagccaagtcattcataaagagctgttcacagatagggatgatgaagaatgcttggtaggtaagcgcctgtgtgtgagccgagtcattcataaagagctgtccttgtgttggtctcatgggcatcgtgtttcctccgcagagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgagtatcaataatgtaatagtgacttcttttattttttttgagatggagtctctgtttcccaggctggagtccagcggcacaatctaaactcactgcaacctccgcctcctgggttcaagtgattctcctgccttacttagcctcttgagtagctggtactacaggctcacgccaccatgcctggctaattttttttgtatttttagtagagatggggtttcaccatcttggccaggctggtcttaaactcctgacctcatgatctacctgcctcagcctcccaaaatgctggcattataggcgtgagccactgcacccagccagtaatagtgacttctaatcctacagccctggtttttgatcattagaaacaggagttttggccaggtgcagtggataattcctgtaatcccagcgctttgggagggcgaggcgggtggagcacctgaggtcaggagttgagaccggcctggccaacatagtgaaaccccatctctactaaaaatacaaaaatcagccaggcatgctagtgggtacctgtaatcccagctactcaggaagctgaggcaggagaatcatttgaacctgggaggcggaggttgcagtgagcaagatcgtgccattgtactccagcctgggcaacaggagtgaaactcaatcaaaaaaaaggaacaggaatgttactaattttaactactgcattgcaaacaaattgtattgcagtattttaccatcagaaaaggaagggaattgttttgtttgcctctgttagatattttatataaacttgaggacattttcattggtgagattcggaagaggtgaagtttcttgcagtacagggacgaagtaggaagaggtgaagtttcgtgcagtacagggacggagtaggaagaggtgaagtttcgtgcagtacagggacggagtaggaagaggtgaagtttcgtgcggtgcagggacggagtaggaagaggtgaagtttcgtgcggtgcagggacggagtaggaagaggtgaagtttcgtgcggtgcagggacggagtaggaagaggtgaagtttcgtgcggtgcagggacgaagttgctccccgctggccacaggcactcaatgagctattttacctatttagggtttctgggttggccaagtaacctcccatcccttgtgatagataactttaagtcacacctttgggggcaatgtggggggctcctgtgcatcacatggagcacactcccccagcactctgcagagacagacccccagtctgacttagagaaagtaaccaatgtaggtgagggccagggcacggtggcttacgcctgtaatcccagcactttgggaagccaaggcggatggatcacttgaggtcaggagtttgagaccagcctggccaacatggtgaaaccctgtgtctactaaaaatacaaaaattagccaactgtggtggtgcgtgcctgtaatcccagctattcaagaggctgaggcaggagaatcgcttgaacccgggaggcggggtttgcagtaagccgagatcatgccattgcattcagtctgggtgacagcgtgagactgcatctcaaaaaaaaatttttttttttaaatatcaaaattgaaaactagtattgtggtcatctgcctcaaattgtgttaccacacgggagacttagcaactcagccagattcttctaaacacattttttataataaaagtggtaaaactacattaccaaaaagaaaatagtaaacttacctaaaatccactatgctaacccacccttttttttttttttttttttttttttgagacagcctcactcttgcccggaggagtggtgcgatctcagctcactgcagcctcgtcctcccaggcccaagcaatcctcccatctcagcccactctgtagctgggactgtaggcactggccaccatgtccgcctaatttttgtattttttgtagagacagggttcaagagatctgcctgcctcggccccagaaagtgctgggattgcaggcgtgagcccccattcccagccattaacatcttacaggattccccagtggtggtggtaggtgtaaccattttaatgtacctacaacttttctatcctgctatttgcattttttggtttttcatttaatagttctcaagctgggatccgtggaactactgtgatgggcggtgatgctttggaaatggaaattcccttaatattaaaatgaacatgaatatattttgatttgcatatatttttaagataaagcatgagacttgtataaagttctttcctggctgggcgcggtggctcatgcctgtaatccctgcactttggaaggctgaggcagatggatcacctgaggttgggagtttgagaccagcctgactaacatggtgaaaccccctctctactaaaattacaaaattagccgggcgtgttggtgcatgcctgtaatcccagctactcaagaggctgaggcaggaaaatcacttgaacccaggaggcagaggctgcagtgagtggagattgcagcatcgcactacagcctgggcaacaacagcaaaactccgtctcaaaaaaataaagttcttcccttagaactagtcctgttgggctagtctttctgggattttggtttactctcctccacccattggaagggcttaaaaccgaatagccagcaccaagcacagctctgcattttgtagctatcactgcagatgatttcttgatagtccatctggtggcaatacagtggtcacccaaggggccattgtttgggtctatgtgatttcccacgttctgtcggaggccgggcgcagtgcctcacgcctgtaatcccagcactttgggaggctgaggtgggcagatcacgaggtcaggagatcgagaccgtcctggctaacacggtgaaaccctgtctctactaaaaatacaaaaaattggccaggtgcggtggctcacgcctgtaatcccagcactttgggaggctgaggtgggcagatctcgaggtcaggagatcgagaccatcctggataacacggtgaaaccccgtctctattaaaaatacaaaaaattagccgggcatggtagcgggcgcctgtagtcccagctacttgggaggctgaggcaggagaatggcgtgaacccaggaggcggagcttgcagtgaaccgagatagcctcactgcactccagcctgggcgaaagagcaagactccgtctcaaaaaaaaaaaacaaaaaaaaaattagccgggcgtggtggtgggcgcctgtagtcccagctactcgggaggctgagacaggagaatgatgtgaacccgggaggcagagcttgcagtgagccgagattgtgccactgcactccagcctgggcgacagagcaagactccgtctcaaaaaataaattaattaattaaattaaataagtgggtgttttaagtgctcagcttccttggttctaccaccttctctccctgaccctccttccctttccccctgaccttggcctttattctagaacggatctgaagcaataggatataaaaaattcacaactgctaaaacagtgttccttctagtgtaattttcacccttagagacctgtctgtaataaacattatttgaaatgcctactatatgctaggcactatgcctcggccacgggttcagacgtgatcgagacagcctgccttctctgagtgtatggcctgggaaagggggcagctgagagacagatgcatggcgatgtgccggataacagacgtagaaggcagaggcaggggagctgtctggggagaggcaaagatggggattcatcagagaaggctttgaaggacatgatgcctaacctggatgtcgaaagggattttgccaggagcacagggcactggtggagggagccctgcggggcagtcctcaaggcctccggatgggtgtgagaggcaccggggctgaagcagcatctgggtttgaggaagccacagccccttggctctccactgcagtctcagagcagcctcaggctgagtaagtggctgaggccaatcctttaggaaagggcaccacgcctggctaatttttgtgtttatactagagtcaggatttcaccattttggtcaggctggtctcaaattcctggcttcaagctatctctccccctcagcctcccaaagtgcagggattacagcaggagccaccgtgctggcccatatatgccatctttcaactgcctgtattcagagactctcacctcctcaagcccttcgtgggaggaaaactagacagtgaaatccagccaaacaagagatgaactaacattaaaaattcaaaaattgggccaggcacggtggctcatgtttgtaatcccagcactttgggaagccgagacaggtggatcacctgaggtcaggagtttcagaccagcctggccaacatggcgaaacctcgtctctactaaaaatacaaaaattagctgggcatgatggcgggcgcctgtaatcccagctacttgggaggctatggcagtaaaatcgcttgaacctgggaggcagaagttgcagtgagccaagaccaygcccttgcactccagcctgggcaacaagagcgaaagtcatctcaaaaaaaaaaaaaagaaaaaaatcaagaattgaaggccacagtagtactgggggagaccttagaacctatttgcctgtgaattaaggctaaacaactatggagattacaagacagaatgagagtgttataaaccctaacaagtaaacagaagataaaccaagaacctggaggacacaaataggaacttgggaggtagcccaggagaactcctcagctcatccttcagagcaaatgagtcagtactgtgcggaatagacacttggcaggatggagatgagaaatgtaaaatagaaacttggaggccggacgtggtggcttacaccagtaatcccagcactgtgggaggccgaagtgggcagatcacctgcggttagaagttcgagaccagcctggccaacatggtgaaaccccatctctactaaaaacccaaaaattagccaagcatcatagcgctggcctataatctcagttacctgggagactgcggcaggagaattgcttgaacctgggaggcggaggttgcggtgagccaagatcatgccactgtactccagcctgggcaacagagtaagactccgtctctaaataaataaataaaataaaataaaaagcaactcttggccaggcacattggctcatgcctggaatcgcagcactttgggaggctgacatgggagggtcacgagctcagatgttcgagacccgcctgggcaacatagtgagaccctgtctcaaaataaataaataaataaaaataaagaagcaactcttttagcattataagatagggcagaggaaaaaaagaaaaaagaaacaactcttcttaccaaaaaaggttgaaaatatcccttctgttgtccccgcccacaatgtctt

SEQ ID NO: 10655 - DNA, 134598 bp, Homo sapiens
  misc_feature (1)...(134598): n = A,T,C or G, or insertion/deletion polymorphism (see Tables 1-2)
aaaagacaaacttgtcacgattggctttgatagcgataaaggcgactaacaaattcattgaaatgttgtttccctccggtaacctgaatctgtccttagcctgcacagaaaggggaagtgcgagtggagttggggaaatgagacggcgaatgtcaagtgcttaccacgtagtgcagactcaggctgacagggggccacagaaatgcaaatatgtgagcagtgtgggtaactgcatcctggggaggaagtcctatgtgctggaataccacaagcacccatttctgccctgtggtactgcgcagcgttggtgtgaagcgatacataggcgtgaagtcccgagaacgcaattttcctggttaaaggacagcaacgtctacatttcttccaagaggcctactttgttggaacttcacttcacttgtgaaattagggtgttgggcagtgagtgaccactaactcagctcccttcttgtgaatcttggcaacagaaaacttttcgtttgtattactgaataaagtgtgtttcttacaaactgtttttttacaggcaagaggcagagggaaacacttgcacatcaggcctgagtttgcattctcatctctgccacctcctacaagctatggagagttagtctattgattcttagttttacctgtgaaattgcgaagatgatataacctgctcatggggcagttaagattaaacaggataaggtgggtaaaaaaccatatataacccataaagctgctgagcctttttaagcctatacagagacacgttgcaggtgataatacagatgttattattttaacaatcaagctgtttttggaatccaaattcttcctaaagctgtgggaaacaggtctaatcccctttagtgtcttggagactccctggagtagtggagaaggcccgttctttgaagctgctaaatcctgaccctgccaattagtgtgaaacctgagccaggcatttcaccacctggatctccctttcctcatttttccgaaagggatcgcagtatacctactttttaggcttgcagagggaattaaagataacattaaaaacactgctctggttattttattttgggggtgatgaagtcttgctctgtcatccaggctggaaagcaatggcacaatcatagctcactgctccagcctcagcctcccaaatagctgggactacaggctcctgccactacagcaggctaatttttaacgattttttgcagagacgggatcttgctatgttgctcaggctggtctcaaattcctggcctcaagtgatcctcctgcctcagcctccaaaagcactgggattacaggcatgagccaccacacctgagctttcttgaaaaagaaaatactagaaacccggaaattatggatttctggttacctactgttacgtaacaaaccaccccagaattccaattatattttgctctcaaatctgcaaaatgggctggttcctgctgggacggctggtttctgatccattcagcaccagtgggggcagcccaaaggctggggctgagggtcccgtaaaagcgtacatgtctggtggttgatggtggctgtcagctaggacctgggaccattagagctgtccctggaacacttacacatggcctctccctgtgtctgagcttccttgaaatatcagggctggattctaagggcaagtgttcagagagcgaacaagaaagccatatagttgctgtattgcctttcctaacctagccctggaatcagttctaccacgtgccacattctgttccttagaaaggagtcagcacggctaccctatattcaaagcaaaggaacttagactccacctctatgtgggaggaatgtcaaggaatgtgtaggcatgttttaaaccaccacaagccatacatgatatcagtgcccagggcattgtagctatcatgatttgatagctggaactaatttcctgagccctctggtctatcctacttaggacctacttttccactaggctcctttaatgtcttgtagaactttggcctcaactcatttcttacctctcaaagtctcactctgtccttatagaagaagatggttattacctaggaaaaaaggtaataatctaagggaggcttccctaaacttctttcacctgtgcctggcaaaagctagatgcttacaaattgcaaattcttgtttcattgtagtttttgagtgttactctccttggcaggataatttttatttttattttttattttttgagaaggagtctcgctgtatcgcccaggctggagtgcaatggtgtgatcttggttcactgcaacctctgcctcccaggttcaagtgattctcctgcctcagcctcctgagtagctgggattacaggcgcatgccaccacgcccagctaatttttgtatttttagtagagacaggatttcaccatgttggtcaggctggtctcaaactcctgacctcatgatccgcccacctcggcctcccaaagtgctgggattacaggcatgagctaccacgcccggcctgataatttgtaatttttttttgagacggagtctcgctctgtcgtccaggctggagtgcagtagcgtaatctcggctcactgcaagctctgccccctgggttcaggccattctgcctcagcctcccgagtagctgggactacaggcgcccgccaccacgcccggctaaattttttatttttagtagagacagggtttcaccacgttagccaggatggtctcgatctcctgacttcatgatccacccgccttggcctcccaaagtgttgtgattacaggtgtgagccaccgcgcctggcctataacttgtaattttttgagaccaagttttgctctgtcgcccaggctagagtgcagtggcacaatcggctcactcaacctctgcctcctgagttcaagcaattctcatgcctcagcctcccaagaagctgggactacaggcctgtgccaccacacctggctaacttttgtatttttagtagagatggggtttcaccatgttggccaggctggtctgaactcctgacctcacgtgatcccccaaccttgggctccgaaagtgctgggtgtgagccatcgtgccaggccaataatttgtaattctaaatgcccccttctgcaactaataaccaattttcaagtatcagcttgggaaagctctttgagagagaaattattctagttctttactaaatatgtgtaagatcttggtttaggtctaaattgttggcccaaagtttggcataaggggtctcaaaggttcagtcagtcggggaaattagcagtccaagaacagcagagaagcaaatgaaaataccagaaactggccggacatggtggctcatgcctgtgatcctagcactttgggaggctaaggtgggaggatcacttgagatcaggaattctagaccagcctggccaacgtgaccaaaccccgtctctactaaaaatacaaaattagctgggcgtggtagcatatgcctgtaatcccagctacttgggtggctgagctaggaaaattgcttgaacctgagaggcggaggttgcagtgagccgagatcgcgccactgcactccagcctgggtgacaaaagtgaaactgtctcaaaaaaaaaaaaaaaagaaaaaagaaaatactagaaacccagaaattatgagagcacctgtgagagagtttaatgccaggccatgacctttcagcagcctcatcacagaaggctggattgcacctctctaaatgggctttttcctactcagtttttcttgctccaagagtaacccttagatttttttttttttcgagacagagtctcgctctgtcacccaggctggagtgcagtggcaggatcttggcttactgcaaccgcccccaccaggttcaagcgattctcctgccccaaccccccgagtagccgggattacaggctcgtgactccacgcctggctaatttttctatttttagtagtagagatggggtttcaccgtgttggccaggctggtctcaaactcctgacctcaagtgatcacccaccttggcctctcaaagtgctgggattataggcgtgagccaccgcgcctggtcaaattttttatattttgtagagatgggcactatgttgcccaggctgttcttgaactactgggctcaggcaattctcctggctcagccttccaaaatgctcagattacaggtgtgagccaccgtgcccagcctctaagatgtccttgtcctagctattattatgtactattatcttctaatctttcccaacaggactattttcattgtaactcaaatggaaatgcctttcatccctcctaaatttgtcaaagctgaggatggtaaatgcacataacaggaagaaagcattaggaaattagctcaaatcatctagaaagaagtgcttattgacttatcctaaatatataatttatataaatttacataattacataaaagtacttaggctaaattacagtaaatatatttttgttatactgttaattacaaccttgaagcttactaaattattttaaaactacttggccacattaagttcagataaaagttgtccctaaaacattagcattgatgtccgctaaagtagaactccctttaaattattattattattattattgagacagttttgctcttgttgcccaggcaaatgcaaatacacgatctcggcccactgcaacatttgcctcctgggttcaagcgattctcctgcctcagcctccccagtagctgggattacaggtgcccactaccacccccggctaattttttaaattttatttttagtagagacgaggtttcaccatataaaacataatttagggccaggcgcggtggctcatgcctgtaatcacagcactttgggaggccgaggcgggcggatcatctgaggtcaggagttcgagacacacctggccaacatggtaaaaaccgtctctatcaaaaaaacaaaaaaaaattagccgggcgtggtggcgtgcgcctgggaggctgaggcaggagaaacacttgaacccgggaggtggaggtggaagtgagcccagatcacgccactgcactgcagcctgggctacagagggagactccttctcaaaaaataaataataaatgttttaattgcaaaaattagcatgtagaaaatagggcaaaaatacaaattgtctgtgatgctaagcccgagacacccaacaagttaattttcctgtttttagcgtaaaatctttcaaataaataactactgcttttagtctctgcaccaggaatctcacgtgctttcaaatgttttacaaagcacgtaaaaaagtatttgaaaagtcccacttacccctcccactcctatttttaagattattaggatcggcccaaatttaaaaatttaacaaaaagagtgcttattaattacattttaaaatgaagggttacaaaaagagatgagcctggcatttctaattcgggggccttgggacctctcccctccaagtgcaagttgtagcaacctgccgggtccacgcatgggcgggtcatactccacgggttccggtttccactccctgtgaaccaaaagccagagaggcccacgcacgastccggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccaggtacgaggcccggccctaacgtccccaccctcttctgggctcggcctttccggcagtgagcccggcaaggacctcagtcgggttcctccgagcccggtgaaatctgtccgagcctccgcttcctcccctgaaagtgcaggtgatgttgtctacctgcgggtctgtggtgcgggaatggaggaagtgcgacaagagggcgcaggacggggcccggagcctgccatcctctcccgccgcgtcttctcggcttcttgtcttccgccctgggggcaccgcatcctcccaggcgtctagtgcgctcctggccggtgctcgagtccacgcaatgccccttagcgtgcgcggatccaaatcaggggtttcctcctcccggctccgtggcccaggagcggaagggctggtatatgggcgaccttactcccactgagcccgcagggagtaacgcagtaaacaaacctggaagccttccccgcgtgggaggtgggtacctgtttttatgggaggctgttcaggtttcttaactgctgtgtagatgtgttgtaaatatttgttgaatgaatgatgtgagggacttgagtacagccatacctcgctttattgcacttcacagataccgtgttttttacaaattgaaagtttgtagcaagcagccctgcaccgagcaactattttttcaacagcatgtgcccacttcctgtcacttacactttggtaactatcgctatatttcaaactttttatttcaggtgcaccgttacagtgatctgtgatcagtgatctttgatgttgttattgcaattgttttaggtggccacgaacctcactggtataagacagcaaacttaagtgttgtgtctgactgctccactacctgccagttccctgtttctctcctccctctcggtcctccttgtagcctgagaggcaacaatattgaaattaggccaattaatagccccacagtggcccctaagtgttcagtgaaaggargagttccatgtctctcactttatatcaaaagctagaaatgacgaagctagaaatgcctatgctctgtaaatgcaacaacaaacccaggatgaccacacatctmtttactgaatgtctttacatcatatttacagtgtggtttactgaatattttaagcctactatcgagacctactgttcagaaaaaaggattcctttcaagatattactggtcattaacaaggcacctggtcaccaaggaactctgatgaagatgtacaaagagattaatgttactttacatgtctgctaacacagtatgcattctatagcccatggttcaaggagtaattttgactttcaagtcattatttaagaaatacattttgtgggctgggcatggtggctcatgcctgtaatcccagcactttgggaggccgaggcgggtggatcacgaggtcaggagtttgagaccagcctggccaacatagtgaaaccccgtctcaactaaaaaatacaaaatattagccggatgtggtggcgggcacccataatcccagctactggggaggctgaggcaggagaatcacttgaacccgggaggcggagcttgcagtgagccaagattgygccattgcactccagcctgggcgacagagtgatgagactccatatcaaaaaaatatatatatattttgtgacgccatagctgccataggtagtgattcctctgatggatctgggcaaagtaaattgaaaatgttctggaaaggatttctaggtgccattaagaacattcatgatttgtgggaaggggttaaaatatcaattccagcctggccaacttgaagaaaccctgtgtctactaaaaatacaaaaattagctgggtgtggtggtgggcgcctgtaatcccagttactcaggaggctgaggcatgagaattgcttgaacccaggaggcagaggttgcagtgagccaagactgcaccactgcactccagcctgggcgacagagcaagactccgtctaaaaaaaaaaaaaaatcattaaaaggagtttgaaaaagttgagtcaggccgmcatggataactgagagactcaagacccgagtggaggaagtaactgcagatatgatagaaaaatcaagcaaactggaattagaaggggagcctaaaaatgtgaccaattgctgcaacctcatgataaaacttggatggatgaggagtggtttctttttttctttttttttttttttgagatggagtttcactcttattgcccaggctggagtgcatggcacactcttgacctcctgacctcatgtgatccacctgcttcggcctcccaaagtgctgggattacagacctgagccactacatgcccggctttgtttttacttttgttttcagacagggtcttgttctgttgtccaggctggagtgcagtggtgatcatggctcattgcagacttgaacttctaggcgaaagtgatcctcctgccttagcctcctgcctcctcagtacctgggtgtgtaataccatgcctcgctaattttttttttgagatgagggtcttgttagttgagcaggctggtcttgaactcctggtctcaagcagtcctcctgccttggcctcccaaagtgctcaccacaacctccgcctcccrggttcaagtgattcttctgcctcagcctcccgagtagctgggattacaggcatgtgtcaccacgcctggctaattttttgtatttttagtagagacagggtttcactgtgttagccaggatggtctccatctctcagcctcccaaagtgctgggattacaggtgtgaatcaccgtgcctggtgaaagtggtttcttgagttgaaatctacacctggtgaagatgctgtgaacattgttgaaatgacagcaaaggatttagagtattacataaacttagttgacaaagcagtggtaggatttaagaggattgacttcaatttgaaagatgttctactgtgggtaaaatgctattaaatagcattacatgctatagagaaatctttgatgaaaggaagagagtccatcgatgtgacacacatcactattgtcttattttaagaaattgtcatagcactttgggaggctgaggcgggcggattacctgaggtcaggagttcgagaccagtctggccaacatggtgaaaccccgtctctactaaaaatacaaatattaccaggcacggtggtatgcgcctgtagtcccagctactccagaggctgaggcaggagaatcgcttgaacccaggaggcggaggttgcagtgagcattgcaaccactgtgctcyagcctgggcgacagagtgagactccatcttaaaaaaaaaaaaaaaaamaacattgaaaatgccacagttgccggatgcagtataatcctgcattacaggctcatgcctgtaatcctagcactttgggtggctgaggtgggcgatcacttgaggtcagtagttcaagaccagcctggccaacatggtgaaaccctgactctactaagaatataaaagccagttgtggtggcggrcacctgtaatccccactatttgggaggctgaggcaggagaatcgcttgaacccgggagccgagatcgcaccacagagtgagactctgtctcaaaaaaaaaaaaaaaaagaaaaaataaattgccatagccattccaaccttcagcaatcactaccctgatcagtcagcagctattaacatggaggcaagaccctctactggcaaaaatattacaactcactgaagaatcagataattgttagcattttttagcaataaggtgtttttatttatttttatttttatttttgagacagtttcatctcatcacccacggtggaatgcattggcatgatcttggctcactgcaacctctgcctcctgggttcaagcgattctcctgcctcagyctcctgagtagctggaattacaggcacctgycactacacccagctaattttgtgtttttagtagagacagggttttgccatgttggccaggctggtctcaaattcctgatctcaggtgattctcccgcctgggcctcccaaagtgctgggattacaggcgtgagccattgtgcctgcccaataaagtggtgtttttgtgtgtgtgtgtttgttttgtttttgttttttgtttttttttttgagtctgagtgttgctctgtcgcccaggctggaatgcaatggcgtgatctcggcttgctacaacctccgtctcccaggttcaagcaattctcctgcctcagcctcctgagtagctgggattacaggtgcccaccaccaccaccagctaatttttgtatttttagtagaacggggtttcaccatattggccaggctggtctcgaactcctgaccccgtgacccacccaccttggcctcccaaagtgctgagattacaggtgtgagccactgtgcccggccaaatatttttaaattaaggtatgtacattagttttttagacaatgctattgcacacttaactacaagtgtagacataacttttttttttttttgagacggagtgtwgctctgttgcccaggctggagtgcagtggcgtgatcttggctcactgcaagttctgcctcctgggttcacgccattctcctccctcagcctcccgagtagctgggactacaggcgcccgccaccacgcccggctaattttttgtatttttagtagagacggggtttcactgtgctagccaggatggtctcgatctcctgacctcatgaccgcccatctcggcctcccaaagtgctgggattacaggcgtgagtcaccgtgcccagctgacataacttttatatgaactgggaaatcaaaaaattcatgtgactggctttatttatgtggtctgcagctgaactctcagtatctctgaggtctgcctgtactagtcccagttcygccacttgttagctgggaaccttgagccctccagctgtaaaatgaagttgataaccacttgctgaggtagttatattaaagtaggtagttcatgaaaagtgcttagcactaatgcgtagcagagtaccttatctatagatgttattttgattatagtctatacatttttgattgtgtggtactctcaacattttgttaaaacataacattgataagaaaaaatygattctggatgggtccactgtctgtctgtagttggcacattcctcatgcctatgtgggtttttgccggatgctctgatttcctcccatgtccccacgataagcacattagcttcattgacatgtctaaatgatcctagtgtcagtgagtgtgtgtgtgagtgtgcaatgccatgaatggcttcctgtccagggtggcatccccccttgtgccctgagctgccaggatacactctagccaaccttgaccctgaactggaataagtgggtaaataattatcttacttgttcttatgaatcttctgtacatatatgtatagctcacatttatttcagtgtttaatattaaaagggtttggatctttatttagaagtttggtgatgttttctgaccagaaatatgttacaggaacttaaatcttgtttgtatcaactaccttttatggtaaaattggtctccttatacatcattttgcttaaagttgccgtttccaagaacctatcaatgacattaagtgaggacttactgtacttagttctagatgaggctggatgatattcaggttcaatttttttttttttttgagatggagtttcacgcttgtcacccaggctggagtgtaatggcgtgatctcggctcctgcagcctccacctcctgggttcaagcgattctcctgcctcagcctcccaagtagctgggattacaggcacctgccaccatgcccggctaatttttgtatttttattagagacggggtttcaccatgttgtccaggctggtcttgaactcctgaccttaggtgatccacctgcctcggcctcctgaagtcgtgggattacaggcgtgagccactgcgcccggccaggttcaattttttagcaagatttcatcatgggtggtagcacttcatcagtgctttgttgggtttattttggtctcttttttatttgttggaggtcttttctaaatgttttatgattctcaattgtctgtttatacttaagtgtaactgagagattatggccgagcgtggtgggtcccacctgtaatcccagcactttgggaggctgaggcgggcagatcacttgaggtcaggaattcaagaccagtctagcttagccaggtgtgatggtactcaggaggctgagacagaagaatcgcttgaacccaggaggcagagtttgcagtgagccgagattgagccactgcactgcagcctgggcaacaaagcgagactctgtctcaaaaaaaaaaaaaaaaaaaaggtgtaactgagaaattagttggaagctccttgtgtctgagcaggacttgtgagttcaggggcttcactttagggtaatctagggacaagtctgctttttcattgatggagagtaaggcacaggtctcagaatctggagatgtgttagtttttattgttttctgagaagacttttccagtctcctgcctgagaggtaccatctagctaccagaattttggaagcgggacagcagaagtggcgtgaataccctgtctgacagggttggaattctgtgtggtccactttcctttggtatccactctgaagtttttcatttcctcaaacctgttaggccacttcattttcctttcttgtaaaacctgtggaaatccctcatgtcctataatcgcttctgtcatctctttaaccttatggttcgttcctttgtattctttgctgccaccttagaaggtcaatctacatgtttaactgggagtcaacacctaataatttttgtttttcttggactgttttttttttttttttttttgagatggagtttcgctcttgttgcccaggctggagtacagtggtgcgatcttggctcactgcaacctcygcctcctaggtacaagtgattctcttgtttcagcctcccaagtagctcggattacaggcattcgccaccatgccaattttttttttttttttttaagtagagacagggtttcaccacgttagtcaggctggtggcgacctcctgacctcaggtgatccacctgcttcggcctcccaaagttctaggattacaggcatgcgccactgtcctcggccatgttttgtatttgattatcattatattcattatattccaacttataagcaagtttatattcatacatgtccttattgaaagcaaacctgtgtcctagtttttccagtatatgtgtattttatctgtgaggttacagacgttgttttagaggctggagatagaatggagagaagatcagatgtgattcctgtttccatggaatttatattttagtggggaaggcagacatgtacaaataggtagaatgctggtatagagtatataacagaagggagtccttgaccatgaaggacattccacaggatcattatgacagaaacccaaggcggtgacacattgattatagcagtatttcacgaaaaatcactatttgaatactccatttgatttatttatagaaataatcacttatgatgacctctgttacttggagtgtagtatcagaaaaactaggacatcggtttgatgtaagtaaggattattcgttttgtatggataaactggctaattccttgtctgattgtcattgaaatatgtgaccttgattataagggtgacttcattcttttagaatgaaacaacttgtaaatgcatcaccgttactcaacacaggatgtgttcaccctgttagcttgcctccaccatttacttaaatcttactcttctgtcttactacttgtattagtttcctagggctgctgtaacaaagtaccacaaaccgggtggcttaaaactaatagaagtttattctttcacagttttagaggctagaagtctgaaatcaaggtgtcatcctctccctgaaggctcaggggagaatctgttccatgcctttctcttagcttctgatgttgccagcaatctttggcaattcttgtagatacatcactctagtctctgcctctgtcatcacattgcattctcctctttatgtgtatctgtccctgtatctcttctcttttaagaaagacacaaatcgtgttggattatgggcccaccctactcccatgtgacctcatcttaacttacatcttaattacttctgcaaagaccctgttttcagataatgtcacattcgcaggtagcaggggtgaggatttcagcaaatcttttttggggaacacaattcaacccacaacactgctattcctggcactaaaagaaaaatagtaataataataataatttaaaaaactatgccataatttattcagttcctaatgaatatttttgatacaaattatcaccaattgaaaatgaaaaatgggctcaggcacagtggctcacgcctataatcccagcactttgggaggccgaggcgggcagatcatttaaggtcaggagtttaagaccagcctggccaacatggggaaaccccatctctactaaaaatacaaaaagtagccagttgtggtggtgcattcctgtaatcccagctacatgggaggctgaagcaggagaatcggttgaacccgggaagtggaggttgcagtgagcctagattgcaccactgcattscagcctgggcaacagagcgagactgtctcggaaaaaaaaaaaaagaaaaagaaaaaatgaaaactaggcaaggtgcagtggtgcctgtctgtagtcccagctacttgggaggccgagacaggagaattgcttgaggccaggagtttgagattacagtcagctatgagaacaccactgcactccagcctgagtgacagagtgagaccctatctctacacacaaaaaaaggcactttgggaggctaaggtggatagatcagttgagctcaggagtttgagaccagcctgagcaatatagcaagaccctgtctctacaaataataaaaaataagctgagcatggtggcacatacctgtggtcccagctacttgggaggctatggtgagaggactgcttsagcatgggaggttgaggctgcagtgagccgtgatggtgccgcagtacttcagcctggataataacatgagaccctggrtgacagcgtgagaaagaaaaaaggccaggcatggtggctcatgcctgtaatcgtaacactttgggaggctgaggtgggaggatcacctgagcctgaggaggtcgaggctgcagtgagctgcgattgcactgctgcattccagcctgggtgacagagggaaatcctgtcttttttttttttttttctgagacagagtcttgctctgttgcccaggctgcagtgcagtggtgtgatctcggttcactgcaacctctgcctcacgggttcaagtgattcttctgcctcagcctcctgagtagctgggattgcaggtgcccaccaccatgcctggctcatttttgtacttttagtagagatggagttttcccatgttgggcaggctggtcttgaactcctgacttcaggtgatctgcccgactcagcctcccaaagggctgggattacaggcgtgagccactgtgcctggccagaaattctgtctttaaaaaaaagaaaagaaagaaaatgaaaactacacacagtaacactgataaccataaaaattaatctgaggaaaaataagaaatcttggcctctactggtgtttttgtgaagggaagttgaaggtgctgaagcatctagacatgaagaaagaaccaggcacaacttctgagtgtggctcgctctcctctcagtttccttcattagaaaataacattttgcagatgacatgattctgtatctagaaaaccccatcgtctcagcccaaaagcttcttaagctgataaccaacctcagcaaagcctcaggatacagatcaatgtgcaaaaattgcagacattcctgtacamcaacaacaggcaagcagagaaccaaatcatgaatgaattcctattcacagttgccacaaaaataataaaatacctaggaatacagctaacaagggaagtgaaagacctcttcaagtagagctacaaaccactgctcaaagaaatcagaggtgacacaaacaaatggaaaaacattccatgctcatgtataggaaaaatcaatatcatgaaaatggccatactgcccaaagcaatttacagattcaatgctgttaccattaactaccattgacattcttcacagaattagaaaaaactactttaaaattcatatggaacaaaaaagcatgaatagccaggacaatcctaagcaaaaagaacaaagctgcaggcatcaygctacccaacttcaaactatactgcgaggttacagtaacaaaaacagaatggtactggcacaaaaacagaaacatagactaacggaacagaatagagaacccagaaataagactgcacacctacaaccatctgatctttgacaaatgtgaccaaaaccagcaatggggaaaggagtccctatttaataacaggtgctgggagaactggctagccatattcaaatattgaagctggaccccttctttacaccatatataaaaactaactcaagatgggttaaagacttaaatttaaaacccaaarctataaaaaccctggaagaaaatctaggcaataccattcaagacataggcacaggcaaagatttcatgatgaagatgccagaagcaattgcaacagaatcacaaattgacaaatttagtttaatttctaattaaactaaagcacttctgcacagcaaaagaaactatcatcagagtaaacagacaacctacagaatgggagaaaatttttgcactctgtccatctgacagaggtctaacatctagcatttacaacattatgagataaaaacagccccattaagaagtgggcaaacaacatgaacagacacttttcaaaagaagacatatatatggtgaacaaacatgaaaaaaagctcaatatcactgatcattagagaaatgcaaatcaaagccacaatgaggctgggtgtggtggctcaccactgtaattttagcactttgggaggccaaggtgggcagatcacttgaggtcaggagtttgagaccagcctggccaacatggtggaatcttgtctctactgaaaaatacaaaaattagttsggtgtggtggcaggtacctgtaatcccagctacttgagaggttgaggcaggagaatcgcttgagcccaggaggtggaggttgcagtgagctgagatcgtgccactgcactccagcctgggtgaaagagcaagacttcktctcaaaaaaattaaaaaaaaaagtaatttaaatataatattttaagtcagagacctagcccacattcatctagtgttgaattaaggagagcaggagactaggagctggcatrtagttcagaaatgtggctcctgagaggctgcaaatcattttctctcttttttattctctttttcttgtagttagaaggggaagataaaagactttgattcatgaagaatctgctcactgagaagtgtatatcaagccacaatttccatcaaaaagtgattaagcagagaatggagaagaaggttgattccaggtgagtgatgggacttgagaaaaaaatataactggaatgatggttcatataaaactaaacattttgtgtatgaaaaaattataaattatgagtgaggtagtaactgtgggtaagttttttttgtcattgatatttcaaatttttcatctataagataatacacatttcgtacattatgttacagtcaaaaaacattctgagtagtgcatggaaatatcaatcattaaaatttgattctgagcagamgtgagtattattttcctgagctttgaagttatatcatccaggttggctggctctcgtgtcttctacttttgatcatggttgctttcagacttttaccttcagttgactgtatctctccaatgaagctctcggcaccttataacgtggcagcctctgtataactctccctttctgggttttggtaattgttccctcccctcatctctttgggcctagaggtagtaccaccttagcttctactggcttcaggttcctgcactgtttcttgtagttcctctatacccacaagtttgtaaatataccatcttcaaattatcctatttttagtatgtcatctattttcttgtgacctttcataggttttatcgtgaatgttaatggattttgtcacatggtttttgtacatttattgagataatcatgtggtttttgctcttttttctattaataggtgtattacataaattgatttttgaatgttaaatcagccttgcattcctgggataaatcccacttagtcatggtgtttatatggcatatagttgtgttagtcagggtcctctagaggaacagaactaataggatatatgtgtatgtgaaagggagtttgttaaggagaattgactcacacaatcacaaggtgaagtcccgtgataggcagtctgcaagttgaggagcaaggaagccagcagtggctcagtccaagtcccaatacctcaaaaatagggaagccaacagtgcagccttcaatctgtggccaaaggcttgtgagcccctggtaaaccattggtgtaagtccaagaatccaacagccaaagaacttggagtctgatgttcgagggcaggaaacatccagcatgggagaaagatgcaggctagaagacttagctagtcagcttctcctaccttctgcctgcttttcctagtggtgctggcagccgttggatggtgcccacccacattgtgggtgggtcttcctctcctagtccactgactcaaatgttaatatcttctggcaacgcccagatacacccagaaacaatactttgcgtccttcaattcaatcaagttgacacttaacattaaccatcacaatggtttttatacgttgttggatttggtttgctactattttttgaggatttttatgtctgtagtcacgaggtctattggtcttttatttttctttttggtaatatctttgtctttgktatgatggcgatactggtctcaatgaatttggaagtgttcctctattttctggaagagtttatggagcattgttttgatatttatttatttatttatttatttttgacatggagtctcgctctgttgcccaggctggagtgcagtggtacagtctcggctcactgcaatctctgcctgcccagttcaagcgattctccatcatgttggccaggctggtctcaaattcctgaggtgatctgcccacctctgcctgccaaagtgctgggattacaggtgttgagcgatagtgctcggcctattatttctttttaaatctttggtagaattaatcactgaaactatctgtgcttttttttgtaggaaaaattatttattttagagacagggtcttgctctgttgcctgggctggagtacagtggcacgatcacagctcagtgcagtttctaactcctgggctcaggcaatcttgctgcctcagcctcccaaagtgctgggattacaggtgtgagctaccaagcctggcctctttgtaggaaaatttttaattactcatttaattttttttacttgttagagatctattaggtttctatttattgtttttgtttgttttttgagatggagtctcactcttktcacccagactggagtacggtggtgtgatctcagctcactgcaacctctgcctccctggttcaagcaattctcctgcctcagcctcccgagtagctgagattacagatgcatgccaccacgcctggctaatttttgtatttttattagagatggggttttaccatgttggcctggcttgtcttgaactcgtgacctcaaatcacccacctacctcggcctcccaaagtactgggattacaggcatgagccactgagcccagctgtgtttcttcctgagttaattttggtaatttcagtttttctagaaatttttccatttcatttatgttgtctaatttgttggcataaagttaattgtatgcccttataatacttttaatttatgaagggtcagtggtaaatgtcctctctttcatacctaattttggtgatccatgtcttctctcttttctcattggttgatctaggtaaagacttgtcagttttaatgagggacccttatggttacgctcttttttttcttaaactaatttgaattgggttcctgtagcttgcaacttagggtgctatgaatatacagaagtttcttatagaatccactgggtcttgggcaaagtgggagagagaactgtttgagacctattcagcaggtattatggacccttcttcctgagcagagccatctttgtgcttcaaaatttcatcgtgggagaatgaatttggttgatccagcaagggtcagttttttcccccagtgtaatcaactaggacttggaggaaggtcattgagttcaagcatagctgctgagatcctgcccctgttgatagacgttctcatagaaggagtcctcgtaagctgaaccagcaccctgacagtgtttactacatggtccgcagagtactctttaggcctgctttatttcatcttctcaagcaaattaacgatggccttaatatgaagctctgtggsctctaactctggcatagtttctgttttttttttttttttttttttgagatggagttctgctctgtcgctcaggttggagtgcatggcgcgatctccgctcactgcaacctctgcctcccagttcaagcaattctcctgcctcagcctggtttcttcaaataccctgctgctttaggctggggaggctaagaagggaatgtatttcctttaagttttttgtttgtttgtttgagacagagtcttgctctgttgcccaggctggagtgcaatggcgtgatcttggctcactgaagcctctgcctcccgggttcagtgattctcctgccttaatctcccgagtaactgggattacaggtacatgccaccacgcccaggtaatttttttatattagtagagaaggagcttcgccatgttggtctggctggtcttgaactcctggcctcaagtgatccgcctgtcttggcctcccaaagtgctgggattacaggtgtgagtcaccgtgccccagccttaggtgttaaatttgcagattcagaaaggtatgggaaaatgtatcatttaagatatcattttgaaacaaacaatgtaaccataacgcaggtaaagaaataggttattggccggcgcagtggctcacgcctgtaatcccagcactgtaatccccacactttgggaggccgaggcgggcagatcatctgaggccaggagtttgagaccagtctgaccaatatggtaaaaccccatctctactaaaaatacaaaattagccgggtgtggtggcacatgtctgtaatcccagctattggggaggctgaggcagaagaattgcttgaacccgggaggcggaggttgcggtaagctgagattgtgccattgcactccagccagggcaataacagcgaaactccatctcaaaaaaaaaaaaaaaattacatggtaagaatatttcagtttatctattttgctgatgggcatttggactgttttcagtttttaaattcctttttttatatattgacaaattatagttgtatgtatttataggatacaaagtgatgttattatttatttattattactatttttttttttgagacggagtctcgccctgtcgcccaggctggagttgcaatggcacaatcttggctcactgcaacctccacctcaggggttcaaacaattctcctgcctcagcctcccaagtagctgggattacaggcacccgccaccatacccagctaatatttgtattttttttttttgagacggagtctagctctgttgcccaggctggagtttagtggcgcaatctcggctcagtgcaagctctgcctcccagsttcatgccattctcctgcctcagcctcccaagtacctgggactacaggcgcctgccaccacgcccggctaattttttgtatttttagtagagagggggtttcaccatgttagccaggatggtcttgatcttctgaccttgtgatccgcctgccttggcctcccaaagtgctgggattacaggcatgagccacagcgcccagccagtttttgtatttttaatacagatagggtttcaccatgttggccaggctggtctcaagctcctgactgggattacaggcgtcagccaccatgcccggctgatgttatgattttttaatacaatgtaaaatgatgaaatcaagctgtttaacttatctgtcacctcaagtatttgacttttttttttcttttgagacagggtctcgctttgttgcccaggctggagtgcagtggtgtgatcatggctcactgcagcctcagcctcctgggatcaagcaatcttcatgcctcagacccccaagtagctgggacttcagtaatgcaccaccatgtctggtgaatttttgtattttttgtagaaatggggtttcaccacgttgcctaggctggtcttgaactcctggcctcaagcaatctgcccctcccaaagtgctcagactacaggcgttagatgctgcacccagccttgacattttttgtgatgagaagatttgagatttactctcttagggatactgaaatatatagtactcgggcgtggtgactcgtgctggcaatcccagcactttggtttttcgttttgttttgttttgttttgttttgttttattttagacagagtcttgctctgtcgcccaggctggagtgcagtggtgcgatctcagctcactgcaacctccgtctcctgggttcaagcgattctcctgcctcagcctcctgggcagctgggattacaggtgcacaccaccatgcctggctaattttttttgaatttttagtagagacagggtttcaccatgttgatcaggctggtctcaaactcctgacctcgtgatccgcccacctcagcctcccaaagtgctgggattacaggcatgagccactggcccggccaatcccagcactttcagaggctgaggcgggtggattacctgaggtcaggagttggagaccagcctggctgacatggcaagaccctgtctctgctaaaaatacaaaaattagtctggcatggtggcatgctactataattccagctactcgggaagctgaggcaggagaatcacttgaatctgggagttggaggttgcagtgagccgagattggagattgtgccactgcactccagcccgggtgacggagtgaaactccatctcaaaaaaagaaaaaaaaaaaaaaatgtagtactgaattgttagctatagtcaccatgctgttcaatagatattaaaaatcaactggccgggtgcggtggctcatgcctgtaatcccagcactttgggaggccaaggcagtcggatcatgaggtcaggagattgagaccatcctggctaacatggtgaaaccctgtctctactaaaaatacaaaaaaaaattagctgggcgtggtggcgggcgcctgtagtcccagctacttgggaggctgaggcaggagaatggcgtggacctaggaggtggagcttgcagtgagccaagattgctccactacactccagcctgggcgacagagtgagactctgtctcaaaaaaaaaaaaaaaaaaaaaaaatcaactgtatttctcctatttaactgaggctttgtgtcctttgattaccatcttcccaattctccctactcctagcctttggtaaccaccattctcctctctgtttctatgcattcaattattttagattccacatataagtgagaacaggtcatatttgtctttgtgtgtttggagtatttcacttaatataatgttctccatttccgaaattcaygttgtcgaaaacgacagaatttcttcctttttttttttttttgagacggagtctcactctgtcgccaggctggagtgcagtggcacaatctcagctcactgcaacctctacctcccggattcaagcgattcttctgcctcagcctcttgagtagttgggactacaggcgtgtgccaccatgcccagctaatttttgtatttttagtagagacagggtttcaccatgttggccaggatggtctcaatctcttgacctcatgattgcccacctcagcctctcaaagtgctgggattacaggtgtgagccactgtgccgggctaaccatctgtatttctagtaagttcccaagtgatggttatgctgttggctttggtatcacactttgataaccactgttctatggtatccacctcagaatagattgtggaccaaagattatgggaatcttcaattttgctagataatgattttctgaattgtttgaaccagtttatactcttgctggcagtgtatgaacatgttcattgacttaccaacactatactaatctggtaggtatgtctcattgttcgtgtgtgtgtgtgtgtgtgtgtttcttttttctttttcttttttttgggacaggatctcattcttttacccaggctggagtacagtggcatgatcatggctcactgcagcgtcgacctgccagctcatgcaatcctccttcctcagcctcccagctcatgcaatcctccttcctcagcctcccaagtagctgggactacaaatatgcatcactgtgcctggctckgtgtgtgtgtgtgtgtgtgtgtagacagggtcttgcttggttgcccacgctggtcttgaactccagagctcaagtgatcctcctgcctcaccctcccaaagtactgggattataggcatgagccatgtgccagcctcattgtgattcctattttcatttcctgaattcctgttgtggcttagtaccttttttttttttttctttttttgagatggcgtctccctctgttgcccaggctggagtgcagtggcgtgatctcggctcactgcaacctgcatcccctgggttcaagcaattctcctgcctcagcctcccaagtagctggaactacagtcacgcaccaccatgtctggctaatttttgtattattagtagagacggagtttcaccatgttggccaggctggtcttgaactcgtgatccacctgccttggcctcccaaagtgctggggcttagtacctttttatgtgtttattgggtatctggattttctctttttgaagtacatattcaagtcttattcctgtttttctcatgagttgtatattgagtatttgtactaattaatatataggaggttttctrtttttgaatatgaatcttttgtatgttttatgtgtgataaatatcttctccctctgctctcttcatcatttgatgaattaagatgttttaaattttaagccgggtgccgtggcttacgtctggaattctagcactttgagaggccaaggagggtggatcacttgaggtcaggagttagagacaagcctgaccaacatggcaaaaccccgtctctactaataatacaaaaattagctgggtattgtggtgtgtgcctgtagtcccagctacttggggggctgaggcaggagaattgcttgaacctgtgaggtgggggttacagtgagctgagatggcacccctgcactccagcctgggcaacagagtgaaactctcaaaaagaaagaaagaaaaaaaaaagaaagccaggcacagtggctcaacccctgtaatcccagcactttggaaggccaacgcaggcagatcatttgaggtcaggagttcaagaccagcctggccaacatggcgaaaccccatctctactaaaaattaaaaagtcaggccaggagtggtggttcatgcctgtaatcccagcacttcgggaggctgaggtgggcggatcacctgaggtcgggagttcgagaccagcctgaccaacatggagaaaccccgtctctactaaaaatacaaaatttgccgggcatggtggcacatgcctgtaatcccagctactcgggaggctgaggtgagagaatcgcttgaacctgggaggcggaggttgcagtgagccgagattgcgccattgcactccagcctgggcaacaagagcgaaactcagtctcaaataaacaaacaaataaataaaaataaaatcagccagatgtggtgtcgcatgcctataatcccagctacttgggaggctgaagcgggagaatcacttgaacccaggaggcagaggttgcagtgagccgagatggtgccactatactccagcctgggtgacagagtgagactctgtctcaaaaaaaaaagaaaaaaaaatttaacttagtaaaatttgtgtcttttcctttataattaatatgtgttctctcaggtttaaggaatctatttcttccctgatgtcatgaagatattctggtttttgttttttggagacagggtctcgcactrtcacactggctggattgcagtggcacaatcagggtcactgcagcctcaacctcccaggcttgagkagtcctcccatctcagcctcccaaatagatggcactacaggcatgtgccaccacacccagcgaatttttgtattttttgtagagatgggctttcatcgcactgcccaagctggtgtcaaactcttcggctcaagcaattcgcctgccttggcctcccaaagtgctgggattacaggtgcgggccaccatgcctggcctaagatattctgtatcatctttaagaactcattattttgctgtttacattttattgtccagacctcctgaaattgacttttgttgatcatgtgagttagggaccctatttctttttttttcacatgggtatgtaattgtcctagcacagtttattgaaaaaactgctctatagtgccattttaatcattactcaagtgtccattaaggccaagtctgtctcttggctatgtaccttgttccttcggtcaatttgtttctgctatacaaaatcgtgatgtcttgaatatgtagccttgcgataagcctgatatctaagtaagactgcttatctagtacttttaagaatgtctaagctattcttggtcttttgtaattctatgaaagcttcagaatcaacttgtgaagtcctctccctccccaaaatagaatctattgttgttggtttttttgtttgtttgttttttaagacagtcttcctctgtcgcccagcaggagtggcacaatcttggcgcactgcaatgcctgcctcccaggttcaagccattctcctgcctcagcccccagagtagctgggattacaggcacccaccaccacgcctggctgttttttgtatttttagtagagatggcatttcaccatgttggccaggctggtggtcttgaactcctgtcctcagtcaaggtgatctgcccgccttggccttccaaagtactgggtttacaagtgtaagccactgtgcccagccctctattgtggttttaattgagattactttgaatctatagatcagagtgggaaaaactgacatctgtattgtactgagttctccattttgcctataaaattattagatttactcctatrtttgatatttgtgatgccatttgaaaatagtatataaatatatataactattttttccttattgctagtttatagaaatatagagttgaccctcatttatttggttttctctcttcctggtcagtttcactggctgtcaactgtattagtctttttaaggaaccagcttttctctttgatcttctctgttatgtttgtcgtccctttgtggctgctgttcttagaaaataactgcttacaaggctgacccttggctggtgtctggaaacttagatttcagaagggttcccaccattcyctaactgatgaatagttaactggacctacactgttgtgtgttcatgcaatgttgtttatgctgaatactagcactccctctaggagtctggaattttggtatgtgttaggcagagggtacctgtctgaccagccctcagtaaaaacttgggtactgagtctctaataagcttcattgatacacaacacttctcacgtgttatcacaattcattgccggaggaattaagagtgtcctttgtgattccgctgggagaggattcttggaagcttgcgcttgatttcttccagactatgccctgtgcccctcttccctttgttgatttgctttgcatccttttgcataaagattgaagaaaaaatcgtaatggaagttagcaaatacgttgtaatgctcataaaaatactacatatcaatatatgaaatacaactacagtcatgcttagaggaatgtatgatgggtttaatgcatttaatgtatagcattaaatgcatgtattataaaggaattaagactgaaaaccagcgaactatgcatctatcattttttcttttattttccatttttttttttttttgatacagggtcttgctctgtcgctcaggctggtgtgcagtggcatgatcatagctcactgcagccttgaactcctgggttcaagtgatcttcctatgtcagtctcccatgtagctgggagtagaggcatgcatcatcacatctggctaatttttttttttttttccgagacacagtcttgctctcccgcccaggctggagtgcagtggcatgatcttggctcactgcaacatctgcctcgtgggttcaagcaattctcctgcctcagccccccgagtagctgggattacaggcgtgtgccaccacgcccagctaattttttgtatttttagtagagacagggtttcaccatgttggccaggctggtctccaactcctgacttcaggtgatccacccgccttggctttccaaagtgctgggattacagccgtgagccactgcacccggcctaattttttaattttttgtagagatggggtctctctgtgttgcccagctgatctcaactcctagccttaagcaatccacccaccttggcctcccgtagtgctgggatgataggcatgagtcactgcctggccaaaagtttttttattttaaactttyaattaattaattttgagactgggttatgacactggctaatttttgtatttttggtagagatggggtttcacctgttgcccagggtggtcttgaactcctgggctcaagtgatccacccgcctcagcctcccaaagtgctgggattacaggcatgagccaccgtgcctggccaaaaattatttactgataaatataacacaaatacagaaaacggcatgaaacaagtgggtgccctagcgaattattatatggcagacacctttgtaatcaccacctgtttaaaaaaaaaaaaaaaaagataagaccttggcagtcatttctgaacttccttccaaacccactgactgcccctcagagagtaaactactagcttgacttgaatggtaattactttctcacttttcttcacggttttattacccaactgtgtatccttaaacactgtatagtttagctttgcttgtgggttttttgagcaggattataagctactttcattgttttcattatagttaccaacatttttcagatttcctaaaatggttctatattgcttttttatttttaaaattcattgagatataattcacatactacacaattcattcatttcaagtgtgcaattcaatggcttttctaatactcacggagggttggttttttgttttttgttttagtttggggtatgacttctattgccagagggaaagtaatatatgtacaaaaccaaatgtttgttgatataacttctgcatcataattaaaatccagggagtatctaaaaaaatagtcatctcaatcaaaatccactacttccatttgggcatggtggctcaggcacttataatcccagaactttgggaggttgaggtgggaggattccttgagtccaggagttcgagaccagcctgagcaacatagtaagaccccgtctctacaaaaagtaaaaaaaaaaaaaaaatagccaggtgtggtagtgcttgcctgtagtaccagctgctcaggagtctaaagtgggaggatcacgtgagcctgggagactaaggctgtgtaatttgtgattgttccactgcattccagcctgggcaacagagccagaccctgtctcaaaaaaaaaaaaaaaaaaaaaaaagtagagttcaagaccagcctgggcaacatagtgagaccttgtctttactaaaaaaatttttaaaaattagccaggtgtcatggggcatgcctgtattcccctggaatcaccaacactgttagagctgttagattaattagagacctgagataataagaaatacaggcatcctttacatagtcttctgttgttctttcttcccaatcagagacttgcgaatgtgtggaatgacaccatcaccagcaattgtagccttgatgagagagtccaattcttcttcttcactaatagcaggttgcaaatgatgaggggtaatagctttacctttaaatcttttggtgcctttgatgtcacttcaagtatctctgcagtgaggtatccaaggatggctgcactgttcacrgtggcagtcacgcccctacacatccatgactggtcgtcctacatttgaggtgtctgtctatgaatatggcccacccggaactgtaaggaggctctctgtgagcgggaaacaaccacctttgttctggcctttccagtgtcctgctcagccttaacgccacccttgcaaattctgtcaaagctcaaacaaggcagagaaagggctagtcagacacacagtgagatcctaccacctactgcttcatggcacggtgattgaaactgcccagagagtttatgttttgtgtgtgtgtggtaacgtatacataacaaaaaacttactattttattttaacctttttttttctttttttttgagacagtctcactgtgttgcccaggctggagggcagtggcgtgatcttggctcactgtaacctccacctcctaggttcaagtgctgcttgtgcttcagcctcccaagtagctgggtctgcaggcatgcgtcaccatgcttggctaactttttgtatttttagtagagacggggtttcatcatgttggccagactggtcttgacctcctggcctcgagggatccacctgccttggcctcccaaagtgctaggattacaagtgtgagccactacacctggcctttttttttttttttttttttgagatggacttttgctctgtcgcccaggctcgagtgcagtggcacaatctctgctcactgcaacctccacctcacgggttcaagctgttctcccgcctcagcctcccaggtagctgggattacaggcgcgtgccaccatgcccagataatttttgtatttttggtagagacagtgtttcaccatgttggccaggctgctctcgaactcctgatccacctgcctcagcctcccaaagtggtaggattacatgcgtgagccaccacgcctggcctattttaactgtttttaagtgtacaatttagtaccattaagtacattgacaatgtgtaaccatcaccactatccatacccaaaacttttcatcatcccatgtggaaattctgtattcattaaatggtatctcctcattcctcctaccctaaccctttataacctttattatacttttctgtttctaagaatttgcttgttctaggtacctcatgtaagtggaatcatacgacatttttccatttgtgtctggcttatttcagttagcatagtgttttcaaggtttctgtatcagaattttattcctttttttcttttgagatggagtctcgctctgtcaccaggctggagtgcagtggtgtgatgtcagctcactgcaacctctgcctcccgtgtttaagcgattctcttgcctcagcctcccaagtagctaggactacaggcgtgtgccaccatgcccagctaatttttgtatttttagtagagacggggtttcaccatgttggccaggatggtcttgatcttttgaccttgtgatccacccgcctgggactcccaaagtgctgggattacaggtgtgagccacagcacccggccttattcctttttatagctctataatattccattgtgaactgtacgccattttttaaatccattatcagtttatgaacatctgggttgtttccaccttttggctattgtgaattatgctgctgtgaacattgtgtacaagtttttctgtggacatatgctgtattgcttttataataagaaaataaatatttttaaagcagaaaattcaggccataggatacatatctcattgtagtaatagataattattttctccttcacattccttctactgccagtaaatacaatgatattttctttttataatgtaatttcctgtacagattgtcttgttaaggagggccatttacaaatgaccagtatttggccagagtctcacccaccttcagtgtaaatgtataaactgatgatgttatgttttagaaattagaaaccactttcccaaatcaggaggaaaaaatccagttttaatttccaagttaacacaattaaatatatgtattgtggttccataaatttattttatgaagttgagcctgaagaataagccagtctatcatcacaccttagaaattcaggtatctgaatagtaaacagtttgtctttagagtgtgaagtccgttatctcttttgattcccacaaccccaagcaatgttatttccatttacaggggaggatactgagggtaggaaaaatcaagtgatttgccataaacttcaaatctgtgaagtccattatctcctttgattcccacaaccccaaacaatattatctccatctacaggggaggatactgagggtaggaaaaaatcaagtgatttgccataaacttcaaatctgtggaatcagggtgtttttttttactccaaatcttgatatatttctactattctactctttaattggcaattataagtgttccttgtagattaagcaagtgatttttgtattaaacctaagttgcaacaatagcacaccatggcaaggactactttttttttttttttttttgagattgtgccattgcactccaggtcagggattcgagactagcctggccaatatggtgaaaccctgtgtctactaataatacaaaaattagccgggcttggtggcgtgcacctgtagtcccacctacttgggagactgaggcagaagaattgcttgaacccaggaggcggaggttgcagtgagccgagatggcgccattgcactccagcctgggcgacagagtgagattccatctcaaaaaaaataaaaataaaaagtgttcccttttctctgcttccttgccagcatttgttatgttttttggtctttttgacaacagtcacctaacaagtaagatgacacctcattgtggttttcatttgcattttcctgatagtgatgttgagcatttcttcgtatatgtgttagccatttgtatgtcttcttttgagaaatgtctattcagagaatttgctcccctcacttttttttttttgagacagggtctcactctgtcacccaggctggagtacagtggtgggatctcagctcactgcaacctctgcctcccaggctcaagctatcctctcagatcagcctccggagtagctgggactacaagcacacaccaccatgcttggccaattttttgtagagacaggattttgccgtgttgcccaggctggtgttaaattcctggaccgaagccatctgcctgtctcagcttcccaaagttgccccttttttaattggatttttttttttttttttgctgttgagatgtttgagttctttgtatattctgcatattaatcctctgtcagatagtttgcacatattttttataatatttgtaatcccatttttttttatggagtcttactctgtcacccagtcaggagtgcagtggtacaaatttggctcactgcaaccaccacctcccaggttcaagcgattctcctgcctcagcctcccgagtaactgggattacaggtgcatgccaccacgcccagctaattttgtatttttagtagagatggggtttcaccatgttggccaggctggtcttgaactcctgacctcaagtgatctgactgccttggcctccgaaactgctgggattacaggcatgagccaccacgcccagcctgtaatctcattctataggttgtctttttactctgttgattgtttcctttgctgagcagaagtttttgagattatcccattttgtttacttttgcttttgttgcctgtgcttttgatgttttattcataaaatcttttcctagacgtttgaagtatttcttctcgtagctttctagttttggatcttacatttaggtctttgatccattttgagttgatatttgtatagggtgagaggtggggagtctagtttcatttttctgcatgtagatactcacttttcccagcaccatttattaaggagggtgtcctttccccaatgttcttggagcctttgtcaaaaataaattggcactgggtgcgatgggtcacacctgtagtctcagcactttgggacaccaggacaggcggatcacttgagcctgggagttcaagaccatcctgcgcatgtggcaaaaccccatctctacaaaaaattagccaggtggtagcatgtacttgtagttgcagctcctcaggaggctgaggtgggaagatcacctgaatctgggaggtcaaggatgcagtgagccgtgattgcatcactgtattccagtggggcaacagaatgagactctgtcattcatagatagatagatagatagatagatagatagatagatagataaagtagcttaataacttgatactctctgttctgttccattggcctatgtgtctgtttttatgccagtaccatgctgttttggttactacagctttgtggtttattttgaagtctggtggtgtgatgcctccagctttgttctttttgctgaggatcactttggctatttgggatcttttgtggtcctatacaatttttaagatgtttttcctatttatgtgaagaatgtcactggtatttttatagggcctgtgtgcattttagcatgttcttctgtcctctgttctcaacctttttctgcaaattggtaactggatttagagacttaattagatttaagttttattttttgggagtagtactagataatcttatagaagcaaagcactgaacagtaccatactcaaatatgatacctgtattagagcattctcatgctgctatgaagaaatatctgagataagtaatttataaaggaaggaggtttaattgactcatagttctgcatttctagagaggcctcaagaaacttacaatcatggtggaaggggaagcaaacacgtcctttttcacatggcggcaggaaagaaagtgcagggtgaagtgggggaaagccccatataaaaccatcagatctcgtggaaacttactcactatcatgagaacagcatgggggaactaccaccataatctaatcaccttccatgaggtccctcccatgacacgtggggattatgggagctacaattgcagatgcgatttgggtgggggcacagctaaaccatatcaatacctatgttttgttgttgttgttgagacaagagtgtcactttgtcgcccaggctggagtgcattcagttcactgcagcctctgccccctgggttcaagtgattctcgtgccccagcctcctgagtagctgggactacaggcgtgtgccaccacacccggctaatttttgtattttgtatttttagtagagacggggtttcaccatgttgtccaagctggtctcaaattcctaacctcaggtgatccgcctgcctcagcctctcaaaatgctggaattacaggcttgagctaccgtgcctggccatcaatacctacgttggaactatcagggaattttatttttttctttcttcctgtcctgtcttgtcctgtcctgtcgcccaggctggatggagtgcaatggcatggctcaccgcaacctccgcctcccgggttcaagcgattctcctgcctcagcctcccaagtagctgagattacaggcacccgccaccacatccggctgacttttgtatttttaatagagacgggatttcgccatgttggccaggctggtctcaaactcctgacctcaggtgaccctcccgcctcggcctctcaaagtgctgggattacaggcatgagccactgtacctggctgagaacctgtctttaaaaaaaaaattagattgcttctaccttttggctgttgtgattaatgcttctaccttactttttatagttaccccgtgccctgcaaatatgttcactcttgactttcatttctttaaacatattcattttagcatatacagctgtgtgtgtgtaaagaaaaaggggtatgtgggaacagtctgttcgttcttcacaattttgcagtaaacttcgaattgttcttaaaaaacaaaatctaagagactgattgtggtagctcacacctgtaatgccagcattttggaaggcttagttgggaggattgcttaatcccaggagttcaagaccagcctaggcaacatagcaagaccctatttcaagaaaacaatacaataaaattttttaaaaagtatattaaactttgtgtgtgtgtttgtgtgtacatacgtgtgctttaccctcagtgcagatattctgaagcaagagatcaagaatgagatcaggccgggtacagtggtacatgtctgtaatgccacccctttggggggttgaggcaagaggattacttgagcccaggaatttgagactagcctgggcaatatagtgagaccctgtctctaaaaaaataaaaataaaaaattggccgggaacagtggctcaagcctgtaatcccagcactttgggaggccgaggtgggtggataacctgaggtcaggagttcaagaccagcctggccaacatggtgaaaccccgtctctaataaaaatacaaaacttagctgggcacggtagtgggtgcctgtagtcccagctactagggaggctgaggcaggagaattgcttgaacccgggaggcggaggttaaacgagctgagatcgcgccactgcactccagcctgggcaacagagtaagaccttatctcaaaaaaataataaaaataaaaagttagctggtcatggtggtgcatgcctgtagtgtcagctactcaggaggatgtggtaggaggattccttgagcccaggagttcaagaccagcctgggcaacacagtgagacctcatctcttaaaaaaaaaaattatcaggacacagtggcgagcacctgtggtcctagttgcctagttgcttgggaggctgagatgggaggatcacttgagcctgggaggtcgaggctgcagtgagctgtggtcatgccacagcaatccagcctgggcaacggagtaagaacctgtctcaaacaaaagaaaactgtgttaggcctaatgactccagggggtgccctccagctctgtagttcctgcctagagctgacccagcagtacccacctctagtggttggccaatatttctgtcagattgggctgcttattatccttgcagcataggtattgtcagtctcaatgagcttatctgtttaattttgcttgtatattaaaagtatttgcatcacatgcagagataactttattctctccttgcctctttcgtcctcaaatttaaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcaggtgagcttatgagtggccaccagtctatgggtactttgcttttgttctcctttcttggttaaaatgggggaatgattcttattcttccaccgcaattagtgggagatcttgatgcctgttcttggtagtagaatgttcagatgaaaaggatattcaggaacctgcagacataaaatctgtcattgagtgttttcatttctccacttgtgcctcacaatatgacrctatcaagattcttccagaaaaagtctaaacgtggtccaagaaagaaggaactactcttttttgctattctttttttccccccagattttctggtgaattctagaagagctgtaacacttctgctactctcgattagatatattagagacatctgtttcttcattcaaaaatttatcaggtcaggtacggtggctcacacctgtaatcccagcactttgggaggccgaggcaggtggatcacctgaggtcaggagtttgagaccccgtctccactaaaaatacaaaaaattagctgggtgtggtggcacatgcctgtaatcccagctacttgggaggctaaggcacgagaatcgcttgaacctgggaggccgaggttgcagtgagctgaaattgctccactgccctccagcctgggcgagagtgagactctgtctcagaacaacaacaacagatttatctggtgcttacccatgccaggtgttacgctagatgctgagcatataaagtgagtaagatcatcttggtttatgacttaatgagagtttaaaatcaggtaggcttgatagactcttaagccacaacaataaagtgagattagtgcaatgagaggagaaggatgtggtaccacaggcaaatacggcgagaacagccacactagtatagccagcagttactctctggaggaagtggagtttaagctcagccctgaaggataatgtaagaataagccagataaagggcaggagaaggtgtgttttaagttgagctcaaggtttaactctataagacaagccacctttggccgggtatggtggctcacgcctgtaatcccagcactttgggaggccgaggcgggtggatcacgaggtcaggagatcgagaccatcctggctaacacagtgaaaccccgtctctactaaaaatacaaaaaattaactgggcgtggtggcaggtgcctgtagtcgcagatactctctggaagctgaggcaggagaatggcgtgaacccaggaggtggaggttgcagtgagccgagatcacaccactgcactccagcctgggcgacagagtgagactccatctcaaaaaaaaaaaaaaaaaaaaaaaaaaaaaaaagacaaggccgggcgcggtggctcacacctgtaatcccagcactttgggaggccgaggcgggtggatcatgaggtcaggagatcgagaccatcctggctaacatggtgaaacctggtctctactaaaaatgcaaaaaattagccaggtgcagtggcgggtgcctgtggtcccagctactcgggaggctgaggcaggagaatggtgtgaacccaggaggcggagcttgcagtgagcagacattgggccactgtactctaacctgggcgacagagcaaaactctgtctcaaaaaaaaaaaaaaaaaaaaaaaagacaagccacctttgtgtgtataccagacactgtgctaggtactggaggtactataaagcaccaatttctgctttcaggggctcacagtgcagagggaatgacagacaccctgtgagctgatctctgtgatatggtgtcataacattacaggaggggtttgaacagagtgctgagagtacacagctactcactctgtttacattggagaaggttcaggcatttgcyggccattttaggcaggaagaataatatgaacaaaagaattattatgtacttcctgtacctcatttttgaagtttttaatctcttcactgacaatttatgttgaaaatattttttaaaaataatctgcttgattttagctttataaatctgccccatcctatgccctgtatgatgcaaaattagctatgataccgccttttgattcatactaacatccctctgctgagaccttaaaggcttcctttcctttccagaaaactgctgatgtaagccaaatggaattttaaaatatgtatatgctttttttccttctttcagatgcgtggccagaaagttcttatatttatggattcgaatgacttttggaagagtatttccctctaaagccaggtagtattagctcagaacaacataattgtgttgagttcattctagggttttcttttatattaagcctgtatataaacttcattatggcttgtgctgttacattcctccccagcctccagtaggtagaagcagtccctaatataaccatgtaatacagtggtaacttcatatctgttagttgactgcagctgcattcatggtgagctgtgaatgttatctacaaagtagccagtaaaggttaagttttagtgttcagtggtgtggcctttagctagctactgtggccttcagcttcaaagaaaaagaaagaaaaaaaaataacaagcaagtgaccaaatgaaagaatcaggcagggcgccgtggctcacgcctgtaaacccagcactttgggaggccgaggcgggtgaatcatctgaggttaggagttcgagaccagcctggccaacctggtgaaaccccgtctctacaaaaattagccgagcagccaggcatggtggctcatgcctgtaatcccagcactttgggaggccaaggtgggcgggtcacctgacatcgggagtttgagaccagcctgaccaacatggagaaaccccgtctctactaaaaatacaaaattagccggacgtggtggcgcatgcctgtaatcccagctacttgggaggctgaggcaggagaattgcttgaaccctggaggcggaggttgcgatgagccaagattgcacagttgcactccagcctcggcaacaagagcgaaagtccctctcaaaaaaaaaaaaaaaaaattagctgagcatggtggcatatgcctataatcccagctactcgggaggctgaggcaggagaaccacttgaaccctggaggcataggtggtggtgagccgagatcgcgccattgcactccaggctgggcaacagagtgaaactccatctcaaaaaaaaaataaatgaataaaaataagaataaaaaagaatcatacttaagtaaatcaggatagataagatctctctgggaaaagtgtttgcccaagagaagtaattgagctctttcagggcactggtgagactgacagattggcttgatcaagtgcagaacctgggggaaaaaattggctttggcaaaggaaatgaaattttagtgaggagcaaattcctctgtcatagcttcattttgtatagaccagtgctgcccattgctgtggttttgggttataattgctttagctgcagtgctaagagtggactgcaagagagagtcacaggagtcagggacaccatacagaaggcaggggagctggagagaagggaccagtgcgaggtatgtttccaaaggagaattggcagcctttgagaatgtaagcacttcttaaaaactgaaatgtcttgggttccctcctgctcccctcttccccttttctttcccttactgtaatctttcctgtttcattttttgacagtctgactccttcattcaatgtctctcaagccaacttggcctgtgtgtgttttctgaaatcttttctttgtatactttatgaggggccctgctgttccatctcttcctttttgtatgtttacagtgaagctcctgatgtggctatgttactggccaggtctaggtccattctgcccatgtgtggtaaatcaatcactgtgacacaggttttgcaaaagagaaaaaacttacttgcaaggccactgagcgaggaggtaggagaacaggtctcaaaccggcctccccaaagataagccttagggatatttgtgggttagggaaktggggtggtttaaggtgtggggaaaggtgattggcagtggggaaaatgcagtaacattcattgcacacaagtgtagtcagggttcatggcatgtcataggacacgtgtacagaaaatagaggcgttaacatgatccaagggtggagtttttggccctcaggcatcaaaagtccctctcgggctccttcacaggcccagttgaagggttggtggtctctatcagtttgaactgtacaggagctagcccaggtttcctgaagaataactgaagtgaccattgccatggtgacctatgaatgttatctacaaagtagccaatgaaggttaagttttagtgttcgggccgggcgtggtggctcctgcctgtaatcctagcactttgggaggccaagacaggcggattacttgaggtcaggagtttgaaaccaacctggccaacatggtgaaactttgtctctactgaaaatacaaagaaattagccaggcatggtggcaggtgcctgtaattccagctactagggaggctgaagcaggagaattgcttgaacccgggaggccgaggttgcagtgagccgagatcatgtgactgcactccagcctgagcaacagagaatctgtctcaaaaaagttgtagcgttcagtggtgtggccttcagcttcaaagaaaaagaaacaaaaaaaaaagaaacaagcagcgaccaaaagcaagcagggcagctgagctgatcatgttactcccttgttttcagctgtagcctgtcctagctgcaagtgctaggcattgttcacctctattttaccttcttctgaatcttgggcatgtcatccttcactgccttggtagctcttcagtgccttaaataaatttttttgctctgctttttttgttgttcattgggagaattgatctaaattgctattgtcagaattctcttttttgtttaatttattgcatattctattctccactgttagcttagaagttatattctgttttactcttcctttactgactgtccagataagttacaaatgtgaatgtgtattttcattcaaatacaaatgtatatttgtaacttaccagaatctaatgttaattggttctttaccctcttcctagataagacagagtccttagaatactttagctctgcccatctccctctctttgtgtatatttttaaatctataaagcattattactctcattttattttattttattttttgagacagagtctcgctctgtcgctcaggctgcagtgcagtggcacaaggttttaccatgttggccaggctggtcttgaactcctgatctcaggtgatctacccacctcggcctcccaaagtgctgggattacaggcctgagccactgtgcccagcctattattctcattttatatagccaatatttatttagatttattcacatatttaccctacttacccttcctttttcatttgtttttctttttttgccctaacattacaacaaatatttaccctttctgttgccttttttctttcttctcacatctccaggtttctatctgkgataattttccttctcctatcagaacgtcccagggtattctctttcgggtaggtctgctagtgagaaattctctcatattttgtctaattccatcttcaccttggaaggatattttcactgggtatgaaagtctgggctgctggttttttcccagcacctcaaagatattccatcactgtcctatggcttccatttctaagctgttagtctaatttttgctcttttgaagattcattgcttgtcttagttttcagaagcttggaatttattttcttataatcttttatctcattttgagattgtaaacaaggtttttttttttcttttttgtggacaaatcttctggcatacttgtgtttatatrtgtgttattctgctccttatcttctttcctcatataacttcaaatgcttttttttttttttcctgagaccgcatctcaccctgttgcccaggctggagtgcagtgccatgatctcagctcagtgcaacctccgcctcctgagttcaagcaattcttctgcctcagccttccacatagctgggactacaggcaccacacccagctaacttttttatttttagtagagacagggtttcaccttgttggccaggctagtcttgaactcctgacctcaggtgatctgcccaactcagcctcccaaagtgccgggattacaggcatgagccacggtgcccggcctcaaatgcttttttattgctttttttttttttttttgagacatagtgttgcttgctccgttgcccaggctggagtgcaatgacgcgatctcggctcactgtaacctctgccttccgggttcaagcgattctcctgcctaagcctcccaaatagctgggattacagatgcgtgctaccacacccagctagtttttgtatttttagtagagacagcatttcaccatgttgatcaggctggtctcgaactcctgaccttgtgatccgcccgccctcaacctcccaaagtgtttggattacaggcatgagccaccgcgcctgaccttttttttgttttttcttttttttctttttgctgagacagagtctcgctctgttgcccaggctggagtgcagtggcgcgatcttggctcactgcaacctctgcctcctagattcaagcaattctactgcctctcctgcctctgcctcagcctcccaagtggctgggattacagacgtgcaccaccatgcccggctaattttattgcttatttttatgtgaaattagttttcctgaattttagtttttaaatttatatgtctttatatattttttagagacgaggtctcgctgtattgccctgcagtggtgtgatcatagctcactgcagccttgaactcatgggctcaattaatccttctgcctctgcctcccaagtagctgagactgtaggcacaagccaccacacctgccttattatactgaacttttagagtgagtcaaggttcggttaagttttactaatttcatagaactccttcttctgttgtttttgtttagggttcaaaaatatagtggcttttttaatggggtatcctggttttgttcccttaccacacttggtctggattttctttttccttgtctcttttgaccctctcctgctcaaatttttttctacccgtggctgtttctcctccatatgaagccctgtcctagaagggtaccctggcagatgagttttgagattccctaggggctggactgctctagctgtttcagttcttatgtgagccctggtgctggagaggataaaactcatagtttcagctgctggtcttaaattgggcctctgtaccttccaacaacagctcattggctattttagggttctcctgttgttaggttcctcagatgctactcggggatccaaagattgaaaactgtgttgctacctccactattttcctaaaatccgttttatttatttatttattttttgagacgaagttttgctcttgttgcccaggctggagtgcggtggcacgatcttggctcactgcaaccgccaccttctgggctcaagcaattctcctgcctccgcctcctgagtagctgggattaaaggtgcacgccaccatgctctgctaattttttgtgtttttagtagagacggggtttcaccctgttggccagagtggtctcaaactcctgacctcaagtgatccacctgccttggcctcccaaaatgctgggattacaggcatatgccaccatgcccggccctaaaatctattttttactcaattttatttatctatatttgacccatatttgactgggaacctcttttcaaataatgccttccaagtccttgggaaatgctgattgtatgttagaagtacattgactctaagagaaagcctaacaatggctgaaacaaattgagatttgttttttctgttttttgtttttttttttwaaattaactttttttttacctttagagacagggtctcactatgttttccaggctggtcttgaactcctgcactcaagcgatcctccctgctctgcctcccaaagtgttaggattacaggcatgaggggatttacttctttttttttaacaagccacctggagattggcagttactggtattgcttcagctgttcagtgatgtcgttttagactcaggcttctagtacctttctagttcaacatccttagcacattggccctttgtcctcataggtaacacttcgtagttgcaagatgactattctagctttacacaggaaggtgggggtaagggtggcgtcagtttgatctctttatcaggaaagaaaacttccctggaagttccccactgcattctgcttctgcctcattggccagagctttgtcaccggccacctttagctacagaggaggtttggaaagaaatctttctggcctctgtagtggatacttacgagaaaaagggcttggcagtgggtgttgggttagccagtgactgctagctaacctgctacattgctttaaaacattcgcattatgctgtttttcatgtcttcgctcttcagtggtaggcgggtgtagaggaaagaatactggactagaattaaggagacctgagcttcggttctaacccaggccctagctaattgtttgatctgaggatagttacgcctgtaggcctcagttttgcaaattacaaaatgatagagtgagaatatttgttttctaagcagctaccagaattagaattctgatactgtgtttccattgacttagaaatttgtgaagggatagttattttctaatatctatatatcaatatcaaatatcaatctgttaaaatcaagtaggttctttgttacttgggggaacattgggcatcctgatctttgtttttaggctttttccatactgagttatttatttctcaattttaggagtgttaggcgggaataatatcataccacaaactacagaataatgcctttatgtgcttagataatgttttagctttgttttttgtttgtttgtttgtttttgagaccgagtttcactcttgttgcccaggctggagtgcagtgacgcgatcttggctcactgcaactttcgcttcccgggttcaagcaattctcctgcctcagcctgccaagtagctgggaccacaggcatgcgccaccatggccggctattttttgtatttttagtagagacggggtttcaccatgttggtctcgaactcctaacctcagatgatccacccacctcagcctcccaaagtgctgggattacaggcatgggccactgcacccagccttaacctttttttttttttttttaagtacaatttccattttatttttctctggagaataatttttcttcagtccttaaggacacagtttcttaacgggttttagtgggagtcatggggcaacgcctgcaggtcgaaatggaggtgtgggtattcagtcctagcaggcttcatgagattgatttctaactactttgctgtgaatggcacaactcacatattaaggtagcttcatatatggcttgggtagcacctaggcatcaaagatcctcacttcagaaatgtccctgactgctgcagcctctactgtgtttcaaatgatgaatttctcctgtttttgttaaagtcactacatttgctaaaatcaatgatgaattcctaaactttctttaacttgacctaccaggtagcattagagagtccatcatttccttcttctagaatacctttcttctcccaggttctagttaccatcctcttgtgttttttctcctacctgtttgactgccccttctaactctcctttgttgattcttcctcatctgaatatcccaacacctagtctttgcactgcttctctagctgcctcacaaccaaaatctcattaaatctcacagtgattctcagatgtgtatgcccagccaagacctctgccttgaaactctggacttttacgtacgtgacaactccactgggtgtcacaccatagtatgcccgaaactgaaatcgtcatcctccccctctcagtgagtggaaactccatccttccaagtgctcaggtcagaaatggtgaagtcatccttcacacctcttgttctttcacaccccaatttaaaatgccatatgccaaaatcatgttgcttcaaccttcaaaatgcattcagaatccagccacttttcagacctccagtagctaccacccagtccaagccatcagcatctctcccccgagtgactccaatggcccctcattggtctcctgcttcctgtcttgcccctagtcagtatcttctcaggaggtagtctgagtaaatcaagtcacatcattctgtcaaacttccagtggcttcctgctgaaagtaaaagcccagagtccttactrtggtctataagaccaaccaactttttgtgtcacctattgagtttgtttttcatttctgctgtcatatttttaatttccgagagcttgttcttgttctctgcatgttccctttttaatttccaaaagcttcttttgttctctgcatgtttcctttctttttaatagtatcctggaggctcaaaattttttgaggataatgtggtttaagatttttatctgcttacactgtgtttcttctaagatccttttttctttgtatttttggtcactctgtcatgttggagcctttcctcaaatgtcaagagattctttattgtctgtttatatttaagagcaggaccctaaaaagcttattttagaagccttttttttttgagacagggtctcactcttgcctaggctagagtgcaatggcataatctcagcccactgcaacctctgcctcctgggttcaagtgattctcctgcctcagcctccagagtagctgggattacaggcatgcaccaccacgcctggctactttttgaatttttagtagagatggggtttcaccacgttggtcaggctggtctcaaactcctgacttcaggtgatctgccttacctcggcctcccaaagtgctgggattacaggtgtgagccaccacacccagccagaagcttttatatgtaagcatgaagacttataacttgaaggcttcactgtaggcttttggggcagatttcaccagggaatctagctgtctgtgtctctgaaggcctttccccttaggttgatcagttttccccagacaaaagagataccctctaactccttctggcacggggtgggggggtgggattgagatgaaggtggtaattttttaattttttaatttgttatttatttatattttattttattttatttatttatttatttttattttattttatttttgagacagagtcttactctgtcacccaggctagagtgcagtggcgcaattgactcactgtaacctccacctcccaggttcaagcaattcttctgcctcagcctcctgagtagctgagatcacaggtgcccaccaccatgcctggctgatttttgtgttactagtaaagacggggtttcaccctcttggccaggctggtattgaactcctgaccttgtgatccacccaccttgacctcccaaagtgctgggattacaggcgtgagccaccgcgcccagcctacattttttttttttttttaaacagagttttactctgttacccaggctggagtgcaatggcatgatctcggctcactgcaaccgccacctctcaggttcatgcgagttgcctgcttcagcctcccaagtagctgagaccataggcatgcgccaccacgcctggctaatttttgtatttttagtagagatgggggtctygccatgttggccaggccggtctcggactgccctcaagtgatccacccaccttggcctcccaaagtgctgggattatagacatgacactgcatccagctgaaggtgttaattataagcttggctgcaagcagggaaagggatggtgggtgtcattgttcagtttgtagacttttggtctaggaccatctcccaagctttgcctagtattctggagtccagttctcctctggctcgcctctccggagatatacctgagtctttgcttgagtgaatatgagtgaataatgggatccaggggcctaaccacttctgacacataggcttgcaaacagtcctgtgttttcatctcagtccacagctcctcgcctcctgatgcgtctcatttccacccctttctggggcctgtgccaccagctgggtgcttcttgtctcccttctccccctacaagaagacacttagttctctcctttatctggtgattcatctgccactctcttgcctaaaattgactaaaatttgttgacggctcttgtctgtcaccctttctcctattctcttggtctttttaggcttacacctttttgaatacatttgctgttatttaatgcggcgtggggaatggaaggaggtaaatggttatgttcattttaccatgtgcaaacggttcctttttattacaattttttagaattgtaggccaggcgtggttgtttgcgcctgtaatcccagcactttgggaggccgtggaagtggatcacaaggtcaagagttcaagaccagcctggccaacatagtgaaaccccgtttgtactaaaaatacaaaaattagccaggtgtgcctgtaattccagttactcaggaggctgaggcaggagaattgcttgaactcaggaggcagaggttgcagtgagccgaggtggtgccactgcactccagcctaggtaacagaacaagactccatctcaaaaaaaaaaaaaaaaaaagaattgtgaataaatctgttcaacagtctttcaaatattatagaaatgtacagtttaggctgggcatagtggctcacgcctgtaatcccagcactttgggaggccgaggtgggcggatcacgaggtcaggagatcaagaccatcctggctaacatggtgaaaccccgtctctactaaaaatacaaaaattagctgggcatggtggtgggtacctgtagtcccagctactccggaggctgaggaaggagactggcgtgaacctgggaggcggagcttgcagtgagccgagatcacaccactgcactccagcctgggtgacagagtgagaccccgtctttaaaaaaaaaaaaaaaaaaagaaatgtacagtttaggagccagtctcctataatctctcccccaccccccgagagagaaccactggcattagtttgatattctggagtcttttcaggcttttaatgtgtatgatgtaatcatttatgtatgcatacacacatgcttgtttatatgtacacaaatgtgtgtgtgtgtgtatatttgatgtattccaacatatgggtgctataaatacataaaaataggccgggcatggtggcacatacctgtaatcccagcactttgggaggccacggcaggcggatcacctgaggtcaggagttcaagcccagcctggccaacatggtgaaaccccatctctactaaaaatacaaaaattagctgggcatggtggtgtatgtctgtaatcccagctacatgggaggcttaggaaggagaaccgcttgaacccgggaggcggaggttgcagtgaactgagatcgtgccattgcactctagactggacgacaagagggaaactctgtctcaaaaatatatatataaatactattatttatttatttatttattcattctttgagacagagtctcactatatcatccaggctggagtgcagtggcctgatctcagctcactccaacctccacctcctgggttcaagcaattcttgtgcctcagcctcccaagtagctgggactacaggcatgcaccacaacgcccagctaatttttgtatttttggtagagatggggtttcgccacgttggccaggctggtctcaaactcctgagctcaagggatctgcccaccttggcctcccaaagtgctgggattacacgtgtgagccactgtgcctgacttaattttttttttcttttttttttttttgagacggagtctcactctgtctcccaggctggagtgcagtggcgcatctcggctcactgcaagctccgcctcccaggttcacgccattctcctgcctcagcctcctgagtagttgggactacaggtgcccgccaccacacctggctaattttttgcatttttaatagagatggggtttcaccgtgttagccaggatggtctcgatctcctgacctcatgatccacccgccttggcctcccaaagtgctgggattacaggcgtgacctaatttttttaaaaagataccatattatacataccacgcagtgactttattttttcacctaatcactttctgaggcatctgtcccttcagtacccttagctctgcttcattcatagaaaatgagcacatggcattgattaattgtattaacctgtcctcttttgatgggtatttgtggtggttcactcttctcttattattattataagcaatagtgaggtgaattaccttatgtatgtctttgtaagctagtttttaaaaaccgtgagtggaattgagcatggtggctcatgcctataatcccagcactttgggaggctgaggccagtggaccacccgagctcaggagttcgagaccagcctggccatcrtggcaaaaccccatctttactaaaagtacaaaaattagctgggcatggtggcacacgcctgtaktcccagctactctggaggctgaggcaggagaatcctttgaacctaggaggcggagcttgcagtgagccaagatcgcgccactgcactccagcctgggcgacaaagcgagactccatctcaaaaaaaaaaaaaaaagaaraaaaactatgagtgggttaggaggagtgacatgttagtaacctgcagaaccatgaaaagaaatttaaagtgattgacaggccagtgtggtggctcatgcttgtaatcccagcactttgggaggccaaggtcagcagattgtctgagctcaggagtgcragaccagcatgggcaacatggcgaaaacccgtctctactgaaatacaaaaaattagctcgtttgggtggcgtgtgcctggagtcacagctactcaagagactgaggcacgagaataacttgaatgcatgaggtggagattacagtgagcagagatcatgccactgcactccagcttgggtgatatagcaagactgtctcaaaaaaatttttaaaaaatcagcaccatctgtcactgcttttctgtgttccttattacctttttcctgactaatttctcttactcatcttttgctgttgttatgactcccctcttcagatttcagctaaattaatatcctgtgttcctgttaagtactaggaatattattaggcatttacttattttataagtttaatttcctatgtttgtaaataagacattactactttttagtaataaaaatatttttcattctggtgaatgaaaaaaattaaaaataataattttcaattcacttcatggtgtttgaaaagtcagattttgggagaccaagggaggaggatcacctgagctcaggagttcaagactagctagggtaacatagtgaaaccgtgcctctacaaaaaataaaaaattagccaggcatagtagtggagcatgtctgtagtcacagctatttgggaggctgaggtggaaggatcacttgagcctgggatgttaaggctgcagtgagccatgactgtaccactgcattccagcctgggcaacagagcgagaccctgtctccaaaaaaaagtcagatttttattttactttaacatctttaatcggtaaaatcaatattaaaaaatttttaacctcatttctagtttaagtagctctgagattctgacctgaaaaagccaaatatatctattttccctctttttaagtttttttgattgtttaagagacaaggtcttgctctgttgcacagaccagagtgcagtgacacattcacggctcactacagccttgacctctggggctcaagcgatcctcccacgtaagcctctggaatagctgacaccacaggtgygtgcctccatacttggctaactaaaaaaatttagggggggctggatgtggtgattcaggcatataatcccagcattttgggaggccgaggcaggcagatcacctgaggtcaggagtttgagaccagcctgaccaacatggagaaaccccatctctactaaaattacaaaattagctgggcgtgatggcacatgcctgtaatcccgctactcaggaggctgagtcagggaaatcgcttgaagccgggaggcagaggttgcgatgaaccgagatcacaccattgctctccaacctgggcaacaagagcaaaactccgtctcaaaaaaaaaagaaaaaaaaaatttgtagagctgggtacagtggctcatgtctgtaatcccagcattttgggaggctcaggtgaggattacttgagcccaagggtttgagaacagcttgggtaatacagtaagacattgtcacacatttttttttcttattttttgggtagagatggagtttttaatttaatttaatttaatttaatttaatttaatttaattttattttattttgagacgaagtctcactttgttgcccatgttggagtgcagtggctcgatctcggctcaccacaacctctgccccctggttcaagcgattctcctgtctcagcctcccaagtagctgggactactggcgtgcaccaccatgcctggctaatttttgtatttttagtagagatcgggttttactatgctggccaggctggtctcgaactcctgaccttgtgatccacctgcctcggcctcccaaagtgctgggattgcaggtgtgagccaccgtgtccagcttttttttttttttttttttttttaatgtatttgagacaggctcttactctttcgcccaggctggagtacagtggtgcaatctcagttcactggaacctctccctcctgggctcaagcgatcctcccacctcagcctcccaggtagctgggactacaagagcatgcccccgctatgcctggctaattttttattttttgtagagattgggttccaccatgtcacccaacctggtcctgaactccagcagtccaactacctcagcctcccaaggtgctggcattacaggcataagccaccacatccagccctagatggagtcttgctatgttgcccaggttggtcttgaactcctggcctcatgcagtcctcctaccttgacctctgaaagtgttggtattacaggcatgagccaccatgcctggcctctatttttaatctatcttggtgtttactttttcttttttttctttgagagggagtcttgctctgtcatcaggctggagtgcagtggtgcagtctcagctcactgcaacctctgcctcccgggttcaagcaattctcctgcctcagcctcctgagtagctgggactacaggtgcgtgccaccatgcccaggtaatttttgcatttttagtagagatgcggtttcaccatgttggccaggatctcttgaccttgtgatccacccgccttggcctcccaaagtactgggattacaggtgtgaggcactgcgcccgaccgatgtttacttttttttttttttttttttagtagagacggggtttcaccatgttagccaggatggtctcgatctcctgaccttgtgatccacccgcctcagcctcccaaagtgctgggattacaggtgtgagccaccacgcccggctgtactttttcatgagacrgcaagaatatgtgatttgggaagagatgttagctccaacatcatcatatatatatatgattttttttttgccgtagattttactatgagcagcgattactacggaaggtcttcgaagaatggaaagaggagtggtgggttttccagcacgagtggaaactctgtgttcgagctgactgtcactacaggtcaggtttcatgttacactccttcagttttactgatgcacattatcagatgattatttgttggcgtgtttatggtcaaaagaagcaaactttgggtcacttttggtttttcttcaaatcctttttggagttagcaagatcagagttccaaattaaacccaagcatgcatgcacatgctgggcacgtgcacacagacacacacacacacctcccacacctctaattcaggtaaccattatgtattggttatgctaatactttgaatgggattttcccaccgattttcatttctatataatttctcattctgaaagtattctgggttttttgtttgtttgtttgttttgttttgttttgagacagagtctcactctgttgcccaagctggagtgcagtggcacgatcttggctcactgcaacttccgtctcctaggttcaagcgattctactgcctcagtctcccaagtaattgggattacaggcatgtgccatcacgcctggctaatttttgtagttttagtagagacagggttatttcatgttggctgggctggtcttgaactcctgacttcaggtgatccgcctgccttggcctcccgaagtgctgggattacaggcatgagtcaccgcgccaggcctgttttttttgtttttttttgtttttgagatggaatttcgctcttgttgcccaggctggagtgcaatggcgccatcttgactcactgcaacctccgccgcctgggttcaagtgattctcctgcctgagcctccctagtagctgggattacaggcatgtgccaccacgcctgtaatggcgtgtaatgatgaggtttctccatgttggtcagtctggtctcaatctcctgacctcaggtgatcctgccaccttggcctcccaaagtgctgggattacaggcatgaaccaccacacccggccttgttttaaaaataataaattgtggccgggcatggtggctcatgcctgtaatcccagcactttgggaggccgagatgggcggatcacgaggtcaggagatcgagaccatcctggctaacatggtgaaaccccgtctctactaaaaaatacaaaaaacaaaattggctaggcgtggtggcaggcgcctgtagttccagctactcgggaggctgaggcaggagaatggcgtgaacccaggaggtggagcttgcagtgagccaagactgcgccactgcactccagcctgggcaacagtggagcgagactccatctcagaaaataagtaaataaataaattgttttaatttacattgattatgggagaaaatatatggggaaggccgagtgtggtggctcactcctataatcccagtactttgggaggctgaggcgggtggatcacttgacgttaggagttccagaccagcctggccaacattggtgaaaccttgtctctattaaaaaacaaaacaaaacaaaacaaaaattccagcctgtacaacacagagaaaccccatctcaactaaaatacaaaaaaaaaaaaattagccgggcatggcggcatgcgcctgtagtaccagctactcggaaggttgagacaggaaaattaattgaacccaggaggcggagactgcagtgagtcgagatcgcaccactgtactccagcctgggcaacaaagcaagactccgtctccaaaaaaaaaaaaaaaattagctgggcatggtggcatgtgcctgtagtcccagccactcgggaggctgaggcagaagaattgcttgaacccaggagtcggaggttgcagtgggccaagatcatgccactgcactccagtctggacgacagagtgagactctgtctcaaaaaaaaaaaaattcttttttaaatgaatgttaataaaatatttaaaactaggaaaatatgaagagatgaaggtcttaagatgtatagtgtatgtatcaagaagaaggaaaaggtgtcaatgagcatattgtagtgcaaacgagaagtgatgttttttacagtgtggatagttaagataattaggatgtgactgtcggccaggcatggtagctcacacctgtaatcctagcactttgggaggccagggcaagaggatcacttgagcccaggagttcgagaccagcctagggaacatggcaaaatccccctctacaaaaaaatacaaaaattagccaggagtggtggtgcgttcctgtagtcccagctactctgaggccaaggtgggaggagtacctgagcccagggagggctcaaggctacagtgagccatgttcacattactgtactccagcctaggtgacagagtgagaccctgtgtaaaaaaaaaaaaaaaaaaaaaaaaaaagacaagattgtcattccaaacatcatggatttttttttttttaattgaatttgagacagagtctcggtgtcacccgggctggagtgcagtggaacaatcttggctcactgcaaccactgcctcccaggttcaagccattctcctgcctcagcctccctcctgcctcagcctcctgagtagctgagactacaggcacatgctactacgagtggctaatttttatatttttagtaaagacggggtttcaccatattgaccaggctggtctcgaactcccaacctcaggtggtctgcctgcctcagcctcccagagtgctgagattacaggcgtgagctactgtgcctggcccaaacatcatgaatttgtggatgatgaaagtgaacttattcttggagaagtcaagccttttcttcctcagtgacactttaaggtatagagaatgactcttcttcaaagagaatagagttcattgtgattgtaggaaatgaaattttagctttggtgcagatatggcttttttttttttttaatcagaagcgtccctgttcatttcttctgagtatagaacagacttggtgtgttgggttaggagttgttttgttgttgttgtttgtttgtttgtttgtttcttgagacagagtcttgctctgttgtccaggctggagtgcagtggcatgcgatctcggctcactgcaacctccacctcctgggttcaagtgattctcctgcctcagcctccggagtaggtgggattatagacgtgtgccaccacacccggcacacggtatttttagttgagatggggtttcaccatatcggccaggctggtcttgaactccttgccttggcctcccaaagtgctagggttacaggtgtgagccaccgcgcccggcctgttattttgaagaaatgccatttactttttttggctcctcaggtattacctgtacaacctgatgttccagacgtggaagacctatgtgcgtcagcagcaggaratgaggaacaagtacattagagccgaggttcatggtgagaaaaagaagtccatgtctgaagaagatgcccacatttactttgcagaaggtcataggaaggacaaacacattgtctcagagagagaggaactctaggccaaaggaagatttgtttgattctctttcatatttttcagaaagtgtgatctctgagtgggcacctgtatgattgatccctatggttttctccatatggcatggtttgagcccttaaaactcatttaatcagaatttgtgtgaactggctgttcctggcctgctggttcagtgggctggctgtgactctcctgtggcacctggggctgccatctatcttgctgcgtcaagttgcccagagactctggagcagagctgcagtgctcttttctgatctgctttgctcaagttgtcccttagtgatactgtggccactttaggtctggtcagagtctggtttctcttgtgaattgagcccagaaacacatggagagtctaagggaaaaagacctagagtttcaaaatgataatacaggctgcattagcagcagaatgtcctaaaggtagctcaaactctgcaagtcacaagtacaacctgtcaactcccctaccacttacacctgctgttcctttgactcttctgtctaggaagacttacttaggaatggtgtccattcctcatgcctcatgtcatcacttacctaatcttttaagaaggccctctgaggcatcacttgcaatcatcgttgcattgctactgcctgagagtaatcctcatctttttcccagagtgttgtaagtgccacttcattaatctccctcatttattttttcgtgcttctcattgtacacatagctgcaagagtggtaagacatagataagatcatgacactcctttacgtaaagttaaccctgcttggtatgtcgtacaaggtcttcatttcttctgctttgcaccctctgcccttgacacactggatgtgcacttctttatctttccatctttgtccctgtagttcttccttcaggcccatttaaatgtgtagctttccttgatctcccccagcccagtgatctttcccctgtctgtattcccaaagtatgagaagctcttacccaagcctcatgattactgcaccaaatgcactgtttcactggtaagtaacttacgctgtttgttgtttatttttttaatacatacagtaagattcattctttttgaagttcagttctaagactttgatacacactaccacatacagctaaatttttgtatttttggtagagatgggcttttgccatgttgcccaggctggtttcaaactcctggactaaagcaatccacctgcctcgctctcccaaagtgctggcaatacaggtgtgagccactgtgcctggccttaagtttaattctataagaaactggcaaggttttttatcatggctgtgccattttgcattcccaccagtaattcacgagagttctacttgctctgcatcctcttgacctctttgtattgtcattaaaattttttctttggccatactaataggtgtatacaggcatttaattgtgggtttttaaaaattggtgttacatgagtatactgcataatgatggagatttgactrtccactacccaaatagtgaacgttgtacatgataggtaatttttcaacccttgggcctcttccaccctcccttcccctcgtttggagtccccagtgtctattatctccacctttatgtctgtgtgtaccaacagtttagctcccgcttataagtgagaatatgtggtatttgattttctgtttctgagttagttcacttaggataatggcctccagctccatccatgttggtgcaaaggacatgatttcattcttttttatggctgggtggtattccatggtgtgtattttctttcttttttttttatttgagactgtctcactctgtcacccaggctggagtgcagtggtgtgatctcggctcactgcagcctccacctcctgggttcaagtgttgcttctgcctcagcctctcaagtacctgggactacaggcgtgtgccaccatgcccaactaatttttgtatttttagtagagacaaggtttcactatattggccaggctggtctcaaactcctgacctcagtgatctgcctgcctcggcctcccaaagtactgagattgcaggcatgagccaccacgcccggctgtggtgtatattttctgtatctgttgatggatgctgaggttgattccatgactttgctgttgagaatagtgctgcagtgaacatatgagagcaggtgtctttttaatataataatttctcttcgtttgggtagattcccgctagtgggattgctgggtcgaatggtggttctgtttttagttctttgagaaatctccatactgttttccatagaggttcaactaatttatattcccaccaccagtgtgttaagtgttccctttctccacgtgcatgccaacatctgttattaaactttttttttttaaagacaggggatgtcttgctgtgtcacccaggctggagtgcagtggcttggtcatagctcactgcagccttgacttcctgggccaagtaatcctcccacctcagactcctgagtagctgggaccgtaggcatgtgctaccacacctggctaactttttatatgttatggagacagggtctggctatgttgcccaagctggtcttggacccctgggctccagtgattctccttcctcagcctccaaaagtgctaggattacaagcataagccactgcacccagcctaactttttaataacagtcgttctgactagtgtaagatgatatctcattgtggttttagtttgcatttctctgataattagtgatgttgagtatcttttcctgtgcttatttgctatttatatctgtttggtgaagtatctgttcatgatcttttgtccttttaaattgggttgtttgtgttctttttgagatttgaaagttttttgtttgtttggttggtttggttttttttgacacggaatctcactcttgcccaggctggagtgcagtggcgcaatctcggctcactgcaacctcgacctcccgggtttaagtgattctcccaccttagcctcccgagtagctgggactacatggtgcgctaccatgcccagctaatttttgtattttttttttttttttttttttcagtagagacagggtttcaccatgttagccagggtgatctggaactcctgacctcaggggatccacctgcctcggcctcccaaagtgctgggaccacaggggtgagccaccaagcccagctggttttttaaaatatgtattctgttataagcattttgtcaaagcatgatttgctatgttttctcctagtctgtgacttgtcttttcattctcttaacagtatcttttgcagaggaaaagtttttaattttgatgaagtccawtctatttttttttaatggattatgtttttttttttttttttttttttttttttttgcgagagtcccactgttgcccaggttggagtgcagtggtgtgaggataacccattgcagcctggaactcctaggctctgacctcagcctcccaagtagctgggactacagacaatgccccaccatacctggctaagttttttatattttacagagatgggggtcttgctttgttgcccaggctggtctgaaactcctggcctcaagcagttctcccacttcggcttcccaaagccctgggattacagtcatgagccactgtgcccagctggattatattttttcatatcctatcttagatgtcatctctaagaactttgccttaacccagggtcacaaagatttcctcttatgttttctcctaaacattctgtagttttacatatggatcttgtatatcctgcatccttgctaagttaatttattatttctttttcttttttcttttttttaaattttgagatggagtctcgctctattgcccaggctggagtgcagtggcacgatctcggctcaccgcaagctccacctcccggattcacgccattctcctacctcagcctcccaattagctgggactacaggtgcccaccaccccgcccggctaattttttgtatttttaatagagacgggatttcacagtgttagccaggatggtcttgatctcctgacctcgtgatccgcccacctcggcctcccaaagtgctgggattacaggcttgagccactgcgcccagccttttttttttttttcagatggagyctcactttgtcacccaggatggagtgcagagtggcgtgatctcggctcactgcagcctctgcctcctgggttcaagcaattatcttgcctcagactactgagtagctgggagtaaaggtacctgccaccacgcccggctaattttttttttgtatttttagtagagacatttactgctataaagttctcttaaacactaactatattacacgaattttaataagttatatttctgttttcattcagtaaaaacttgttttctgattttccctgagacctcatctttgccccacagattatttagaagtgtgtttagttttctaatatttgggagtttcccaatatctttctgttaaggatttctagtttattctattattgtcagagaacaagacttagtatgatttcagttcctttatttttgttaaggtttgttctgtggccccaaatatgctctatcttgtaaatgttctatatttacttgaagaatgtacattctgctgtcttatttatagttacagtgaatctagctagatattatggaatagaaggaaaaagtcacttggatgacttttttataggcggtggctcacgcctataatcccagcactttgggaggctgaggtgggaagattgcttgggcccaggagttcgagaccagcccaagcaacatggcaaaacctcatctctacaaaaaaatacaaaaattagccaggtgtggtggtgcatgcctgcagtcccagctactcaagaggcaagagttatttctgacataagacaagttatttcaggccattcccctagacctcagggagtgtccattcactcttggactgttaaatgaaaagtttgcaagtacttttaggccttaaggaagcatggttctcagttgtcacgtgcatcagaatcatggcagagacagttaatgagattcctgtgttccatactctggaaagagcagttagtgtttattttagatatttttcatagttaaatcatctcatttacactttccaaacataactctgagagaggcaccattttacagatgaggaacttgtatgagattaggtgtgtaataaatgaaagggccagtaagtctggcttgtcttactcaggatcccaaactctaaaccacagcactatactagtcctgattacctgaagtatgctgattcctgaggtccacagtgaaaccaaggaagatacatgttaaattctccttcgtatgttgatttgtcttgtcaacaactgtgaaatatatagttatagtcctgtcgactacatcttggaggctgtcctaaaaatgatttatataattttattttctcctttgtcttctaaaaagaagagaaatttgcttataagtggtaatttacttattagtggtgactttcataatgaaaatacaatttaccacaaagggagacctgtgggccattgcatcttccatatctagtaaattatcttttctttactaaaaagagtgagcttggagtcaaacagcaagttttatatcatgatttcttcttctttagctttgtattatggaaaactttaaatatctatacaattgaaatttttttttcttttcttttttttttttttgagacggagtcttgctctgtcgcccaggctagagtgcaatggcgtgatctcagctcactgcaacctctccctcccaggtttagcaattctcctgcctcagcctcctgagtagctgggactacaggcgcacgccaccacacctggctaatttttgtacttttagtagagatggggtttcaccacgttggtcaggttggtctcgaactcctgacctcaggtgatctgcccatctcggccttccaaagtgctgggattacaggcgtgagccactgtgcccagactgaaagatatttaatagaataatgaacctccatgtatccattacccagctttgattatcactcatgccatttttgttagatccatctctccacttctttgctgcctgtttattcatatcatttcgtctaaaaattgcagagtatatctatagaaataagcgcttttaaagcaaagggtttttgagcagttcagtacatgggttttcctttaaatgctttgtaaatgtcgttacttgcacagagccttcatgtgttcttgcactctaattaattttctagtgcttcacaacttttccagcaggggtcacttgtaggctggagggatttaggtattcaaaggagagcccttgagcttttatcataacccagagtaatccatctctccccatgccttttgaaaaatctctttggtgaatctagatgcaaagcaaaagatgcgacaggcctggaagtcctggttgatctacgtggttgttcgtaggaccaaacttcagatgcagactacagctctggagtttaggcaacggattatcttacggtgagtctgctcaactgccctacaaagtaccagccatcattttacctcatcagctttatggtgctggaaaacagcataaaacctcaccttaaaacaatggtttgtatttggttttatttttgtgttttgtttttttcgagatagggtcttactctgtcacccaggttggagtgtagtggcccaatctcagcttactgcaacttccacctcccaggttcaagcagtccttccacctcagcctcccaagtagctaggactacaggcatgcgccactatgcccagctaatgtttttttttttttcatttttttgtagaggcgaggttttatcatgtttcccaggctggtcttgagttcgtgggctcaagcgatctgcccacctcagcctcccaaagtgctgggattataggcatgagccaccatgcccccttcccaccttgaaacaatattttgaacatagttgatgcctaataaagatttactgataacttgtttataagatcgattttcacataatcataattaacatgaattgagtgcttactgtgttctaaaccctgtgttaagtttgtgtgtgcatgtgttaattttgtaatgtaaagtatcttatttaacccttaccgtaaactgtaagtaccattattgtacagattaagatgtacaataaggctcagagaggttgagtaacttgcctagcacatacaggttgtaattggcaaaactagggctcacccacccatgctcttaactggtcttctgcattgcagcccatcagcattgtagacatactggaagaacatgaattagtccacttttatagccagatatgtaacaatgagctgcattatcatgggacagatttcactctatgttgtctgtagttgtccactggtgtcctgaatggtaatatattaataaytcacttcctgcctgaaagttgggtattgaacaaagtatggataataggagaggctttgcagctgcacttacttgggtttgaatccctcttccaacctgtattattgggtcatttcatctcttcagctcttattttcctcatctgtgaaatagttacaccatacttaaaggtttgtcatcaggaataaataaagtaatatctgtaaagtatttaacagtgtccagaaaatcagtggacataaagaagttatttaagtagaaataaaataggcagagtgcagtagttcaaacctgtaatcccaacactttgggaggctaagatgggaggcttgcttgaggccgggagtttgagaccagcctgggcaacaaagccaagaccctatctctacacacaaaaaatttttttaaataattaaaatcattacttaaaatgtatttagcaagtatttcaaaatgcctaattagtatgcagttttacttgagtctgagtgaattttttttttttttttatgagatggagtctcacactgttccccaggctggagtgcagtggtgtgatcttggctcactgcaaccttctgggttcaagccttccaggttcaagcgattcttctgccttggcctctcgagtagctgggattacaggcgcctgccaccatgcccagctaattttttgtatttttactagaggcagggtttcaccatgttggccagccttgtctcgaactcctgacctcatgattcaccggcctcagcctctccaagtgctgggattccaggcatgagccaccgcgcctggcctgagtgatatttttatataattaattcatttactcaacgtacatttatttatttatttgagacagagtctcactgtttcgtccaggctggagtgccatggcacaatcttggctgactgcaagctctgcttcctgggttcaagtgattctcctgcctcagcctcccaagtaactgggattacaccatacctagctaattttttgtatttttagtagagatggggtttcaccacattggccaggctggtcttgaactcctgacctcagatgatccacccgcctcggcttcccaaagtgctgagattataggcatgagccaccgggcccagcctatttattgagggtttaaaatgttcttggtactgggccaggcacagggactcatgcctgtaatcccagcactttgggaggctgaggctggtgaattacctgaggccaggagtttaagaccagcctggccaacatagtgaaactgtctctactaaaaaaatacaaaagttagcctggtttgatggtgcacgcctataatcccagctactcgggaggctgaggcatgagaaccgcttgaacaaacaaggcagacgttgcagtgagtcgagattgtgccactccactgcaccctgggcaacagagtgagactctgtctcgaaaaaatwaaaaaaatggcttccgcgggaggcctacacaccgccagttgtgttcctgctatgtctctagtgatccctgaaaagttccagcgtattttgcgaatactcaacagcaacatcaacgggcagcagaaaataggctttgccatcactgccattaaggatgtgggttgacagtacactcatagtgttgaggaaagctgacgttgacctcaccaagtgggcaggagaactcactgaggatgagatggaacgtgtgatgaccattatgcagaatccatgccagtacaagatcccagactggttcttgaacagacggaaggatgtaaaggatggaaaatatagccaggtcctagccagtggtctggacaagaagctccgtgcagatgtggagcgactgaagaagattcaggcccatagaggaccgcaccacttctggggccttcgtgtccgaggccagcacaccaagaccactggccaccatggctgtaccatgggcgggtccaagaagaaataagtctgcaggccttgtctgttaataagtagtttatatacctaaaaaatataaataaagtaataaataagtaaaatgttattggtactgtattgatgctggggctgtattcagggaatttgtgattccctggatgcataagaagataagtgataatgtgagatagcttgaggttttgcagtgagtgctgcaagtgagcctggtctaagagaaatctttgtaggttagagtgaccaggaaaagtgagtgtttctgtaaagcacaggttgtaaactcttatttccccatgactcttttcctagagcaaattcgaaaattagtaggaaaaaaaaaacaagactgaaacaaaagtctgaccaggattctaggaaagaaaaggatacatacaagactagaaatctaaaagccacttgattgcagattattttgtgaaatctcctgattttcaaatgttggtaatactctttttttttttttttttttgaggtggagtctcactctgtcacccaggctggagtatagtggcacgatcttggctcacagccacctctgcctcctgggttcaagagattctcctgcctcagcctcccaagtagcagggattacaggcacacaccaccatgtccagctaattttttgtatttttagtagagacggggtttcaccatgatggccaagctggttttgaactcctgacctcaagtaatccacctgcctcagcctcccaaagtgctaggattacaggcgtgagccaccacgcctggccttttttttttttttcccgagatggagtctcactctgtcacccaggctagagtgcagtggcgtgatctcagctcactgcaacctctgcttcctgggttcaagctattctcctgcctcagcctcccgagtagctgggattacaggagcatgccactaccacctggctatttttgtatttttaatagagacagggtttcactgtgttggccaggctagtcttttaactcctgacctcaggtaatccactctcctcggcctcccaaagtgctgtgattacaggtgtaagccaccgtaccaggccataacatatcttttaacaaatcaaactgtgtaggtcaaacagagcatgtctgtggtgtctaaagcaggatctgaccrtaggaaccatargtttccaaccattaatgggcagatctgggactttttctcaattgttttgttttatttttttccccagcagtgaatctagagatggtactrtgaaggagaggactagagctgagggtctgaggccccacactaactgctcctctctttcctgagtggctttttactgatggattccatctttgatttgctgtttcacagggtgtggtggagcacgtggaggcagcgactaggacaggtccgtgtgagccgtgccctccatgcctctgctttgaagcacagggccctgagcctccaggtgcaggtgagtccagcagacgtgggatttggcatcctctgtcagtgttgtcaagcctctcacccacagagggcagtgctgggccttccctgcagctcagggcctgagagggggtggggacagaggtaatctggaaggctgggctcttccagagggaggctgctgttaggaataaagtagaggcttgtcctagatgagcctagatcagtggcttccagagtgcttctggtaattgtggagctggagagggatttatgaattagttataaacatgtttagagaaacagcagtatactctgatttcctcgttgctgttttcctacagcaaatcagaaaataattggggcagaaaagaaacttaagactgaaaagaaaacctrtcttccttttctttatagttttgattgtcttagagtgttcttttaggcaagccactagctttttttgtcaatcataaatggctaaggcctgtactaaaactttcttatcctttgacatattctctgaattcttgtcatgtttttgtgtctgctgggtacttacagagctgccaaataagttataggaaatagaacagagaagaggaaaaaaaaaattagtgcctgtttccaaatgtaggaatagtatcttcttattctaacaacaaattgcatagtccatgtgaatacgtgcagatcacatgcaaatagcatatatagtcatctagatcagtgatcagcaaactggctcacaggccaaatttggcctgctttctgtttttgtaaataaagttttattgggatgctgctacactcattcatttatatatcatctgaggctgctttcagattacaagagcagtgtagggtagttgtaacagagaccttatggtctacaaagactaaactatttgttttctgaccctttaagaaaaagtttgctgacctctgaacttgtaaggtcttctgaggcaatagcaaggaaataagagacacagttctcgccaataataataacagtaccaatagcagtagcaactgcagcctgagtgactgagttggggccctgtctcaaaaaaaaaaaaaaaaaagaagtagattttattgtggtcttacttgtgttaggtgctagactaagtgctttacgtgcattatctaattttcataaaccttttttaaaagtcccatattattgttaagggaaccaggaaggttaaataacttgaactagggtcacatgtatagtgaagcttagagccaggtttttttatttttttttgattttttgagacagagtctcgctctgtcacccaggctggagtggagtggcacagtcttggctcactgcaagctctgcctcctgggttcacgccatcatcctgcctcagcctcctgagtagctgggactgcaggtgcccgccaccacgcccggctaattttttgtatctttagtagagacggggtttcaccatgttagccaggatggtcttgatctcctgaccttgtgatggcctgcatcggcctcccaaagtactggtattacaggcgtgagccaccacatccggccgcttggagccaggttttaacctaagcagccagaaagctgcatcatcatcttttatatatatatatatatatgttttgagacagagtattgctcgctctgtcacccagactggagtgcagtggcgcgatcttgcctcactgcaacctctgcctcccaggttcaagcaattctcctgcctcagcctcccaagtagctgggactcagacgcatgccgccacgcctggctaattttttgtattttagtagtgatggggtttcaccgtgttgcccagggtggttgctaactcctgagctcaggcaatctgcctgcctcagcctcccaaagtgctgggattacaggcgtgaaccaccgcgcctggcctgcatcattatcataatcaccatgcagtattgtgctgaatagacttgtaacctcaggagggagatggaactgataaatgggaaaatgctataaatgcagggatactgactaaacttatagactgactgtgaatatagggaaactaaacataatgagactgattttctgtcatcggtggacaactgtgctagttttcttccctttctaagagccactttgagaggccataaactcattctactgatgctactgttgctcagaacatgtttagaattccccttttcttgtttgttgttgtttgtttttttgttttgagacagtctcactcttttgcccaggctggagtgcagtggcacgatcttggctcactgcaacccctgcctcccgggttcaagcgattctcctgcctcagcctcccaagtagctgggattacaggcacgcgccaccatgcctgtctaattttgtatttttgatagagacggggttttgccatgttggccaggctggtctcgaactcctgaccgcaagtgatccacctgcccctcggcctcccaaagtgctgggattacaggggtgagccaccacacccagcctacacgtcttaatctacacagcatctctatgcactaggcaggtaagacatcatgaaatatgtaaaattttaattttaatttaaaatttaaaattaaatttggtatttcaaacatagaaacacataaaatataaaacacttagaaaaatattagcagataggccaggcgcggtggctcacacctgtaatcccagcactttgggaggctgaggtgggcggatcatgaggtcaggagatggagaccatcctggctaacacggtgaaaccccgtctctactaaaaatacaaaaaattagccgggcgtggtggtgggtgcctgtagtcccagctactcaggaggctgaggcaggagaatgacatgaacctgggaggcagagcttgcagtgagctgagatcacgccactgcactccagcctgggcgacagagcaagactccatctcaaaaaaaaaaaaaaaaaattagcagctagccaagtactcaccagcctcacccagatttaaaaggtgttagcattttctatacttgcaaaaaaaaaaaaattagcagatagccaagtactcaacaccctcacccagatttaaaaggtgttagcattttctatacttgctccagaattttttttaagttattttttgggggacaggatcttactctgctgcccagtctggagtgcagtggtaccatcatggctcactgtagtcttgacctcccaggcttaagtgatcctcccacctcagcctcccaagtagctgagaacacaggcatgtgctaccatgcctggctaatattttttttttttcccttgtggagtcgaggtctcaccatgttgcccaggctggtctgaaactcctgagctcaagtgatccacccgcctcggcctcccaaagtgctgggattacaggcatgagccaccatgcctggcccagaatttttttttttttttttgagacggagtcttgctctgtcgcccaggctggagtgcagtatcgcgatgttggctcactgcaagctccgcctcccgggttcacgtcattctcctgcctcagcctcccaagtagctgggactacaggcgcccgccacaacgcctggctaatttttttttttttttgtattttttagtggagatggggtttcaccatgttagccaggatggtctcgatctcctgacctcgtgatccgcctgccttggcttcccaaagtgctgggattacaggcgtgagccaccgtgcccggcccagaattttttaaagtaacaaaatttaatggacactgccaaagctttaccctccctccgtcccttctactgcctctcctccttagagatagccactcttttgattctggtatgattgttctcctatattcttttttcttataaaaatatgtgcacatatctgtaaagaataaacatgtggtacactcctgtagtcccatctactcgggaggctgtggcaggatgatcacttgaggtcaagtgtttgaggctagcctgggcaatataatgagaccccatcacttaaaaaggcgggaggggtcacggtggcctacacctgaatactaggactttgggaggccaaaataagaggatcacttgagtttaggagttcaagaccagactaggcaacatagtgagaccccatctctacaaaaaaaaaaaaaaaattagctagacgtggtggcgcatgcctgttgtcccagctacttgggaggcttaggttggaggatcacttgaacctgggaggtcaaggctgcagtgagccattgatcatgccactgcactccagcttgggcaacagagcaagaccctgtctcaaaaataaataaataaataagtaaatggtatggctttgtgtagttaggacatttatgaatgttgtcatactgtgctttgcaacttgtttttttagtgcaacggtatatttttgaggtttagccatgtgatttctttcttccttttttaaaatagagacagggtctttctctgttgcccaggctgttcttgaactcacggcctcaagcagttcttacaccttggcttcttaaagtgctgggattacaggcctgagccaccatgcctggccctatctatgtggatagacagagatctattaactgtgtatattatgccattgtataaacaaggcaccatttatctgcttacttactgatggactgttgacttcctctgctttttagaattacgaacagtactaccaagagcattctttttctattttttttttttttttgagactccgtgcagtggcacaatctcagctcactgcaatctccgcctcccaggttcaagcaattcttctgcctcagcttcccatgtagctgggactacaggtgtgctccaccacatccagctaattattgtatttttagtagagatggggtttcaccatgttggccaggctgtcttgaactccttacctcaagtgatccgcctgcctctgcctcccaaagtgttgggattacaggcgtgagccaccatgcccggcccccagtttcttttaattattcacggatctgtttctcggctctgtcttccattcatgtatttgtctatccagaccataccaatgccatactggtttagttacgatttgatgaagcagtaagcaacagtgtaggttcttgagtcagactgtccaagtggaattctgcctctatcacctattagctttgtgcctttgaatgagttatttcatctgtttgtacctcagaattcttatctgtaagtagattgtaatagtacctacctcatgagattattgaggcttcaggaggatgatccagttattaatatactcagagcaatgcctggaatgtggaaatgctcagtaaatgctagctgtttatattcctacttgacatatagttctcaaggctctatatttgacagagaatctcctttattcttgttttgtttttaaacttgtcttaattgttcttctgtactctttcttattaattttaggagcaacttgtcaagttctataacaaagcctattaggaattttttttttcttttgagacatgtctcactctgtcacccaggctggagtgcagtggtgcgatctcggctcactgcaagctccacctcctgggttcacgccattcttctgcctcagcctcccgagtagctgggactataggcacctgccaccacgcctggctaattttttgtatttttagtagagacggggtttcaccgtgttagccaggatggtctcgatctcctgacctcatgatccgcccacctcggcctcccaaagtgttgggattacaggcgtgagccaccgcacctggccaagcctattaggatttttattacaatgtactgactgacagcttattaggttagaaaaattgtcatattgagtcatttcatctttgaatttgatatatctcataatatattgctgagcttgagaaggagagtaggaaggatgaggttatgaggtaacagggagccagaacgcagggcctggcaggctgtgcctgataaaaaaggctttgacttttattcctgggaaggtgaagagctgctggctctgagcagaggagtgacatgattatacctacctcttaacaggattctttgattcatagtgtgctgcttttggggtaagaaagggaaggatatatatgaatgtgtgtctgtgtgtttgtggagggggggggtgtgtgtgtctgtttgcttatattttcaagaaggaataatggaaaaataaatgaaaaacttaccaaaaaatggttacctataggaggagggagagaagggtataggaataaagtacttctgtgaatttactttgttacatagttttaactttggaactatgcatatattttatataattacaaagcaagagtaaataaaaaaacaattgccagattttcaaaacaaactgaaacgaacatatcaagtttgtggcaatgactacacagagaataattacttcaagtaactttaaaatacaatattttgactgttcaccctggtggaatgtgttaaaaggacgtaatgaactgctaagaaatctaaaaccacattcttagtaaaacaagtgttattgttgctaggaggtttgaaattgttacattgaaagtattatagttacattgtaagataaagcaaataattatggcagtgttgttaggaataaagatcttcaatagaaaagaaaagattacaagtataaaaagcaaagaaatctgcaattggaactgtaaatatcaatatggactctctctctctctatatatatatgtgtgtgtgtgtgtgtgtgtgtgtgtgtgtgtgtgtgtgtatatatatatatatatttttttttttttaccataaatgcatttctggtctggcgcgatggctcccagcactttgggaggcagaggcaggtggatcacccgaggtcaggagttcgagactagcctggccaacatggtgaaatcccgtctctactaaacatacaaaaaaattagccgggcatggtggtggtgggcacctgtaatcccagctacctgggaggctgagcacgagaatcacttgaatccaggaagcagaggttgcagtgagctgagattgtgccaactgcacttcagcctgggcgacagggtgagaccctgtctcaaaaaaaaaaaaaaaaaaaaaaaaagcattagaagcagtgacagtaatatagcatttagtatccccagtgcccaagttgtggtcttaactatttcccactaataggaaccagggctttttagagaaatggctgattataggtccggggcaggaaatagacaagatacacctaggactaaggaacttaacaaaagctaatggaattgtgtcagaaggactcaggaaccaatttggaagggttcccagggcttaagatagaaaagtttgagcatcaaaaaacaataagctaggcatagtggtgcctgtagtcccagctactcaggaagctgaggcaggaggatcacttgagcccagtagattgaaaacatcaaatacataaaaattcatgcatttgaaataattttcaaagaaagtggaactcatcggtcatgattttgggttgttaggggagttaactaaattctttaaaaattaaagcattttaattctttaaaaattaaaggcaaaaaattaagcatttatcccacctttcctatataaactgttaactccaagaaaccagagggttaatgagagagaagccttctttatagaagaattccagttaataaatgctgaaggaatactagaactagaaaattgctgttttgccacccctaatgaggacatagatctaggaagccatcactaggtgagaggatggtgggaaaatataggagaaatctggctacctgccatctgaatccaccaaacaatcttggcattgctacaactgtggcagccagacatgatgtgcctcatgatactatgtaaggggaagtacccagccacattcatgaactgttcttgcctaaaaaattgaacatgactccaagcctaatgcaaatctctcagtttataggaaatacaggggtcagaggaacaagttaaagacacctcgaggttacagtcagccaaatccaaaatgtaggacattttataggatagatgacttgatttctctagtagattgatggcatgaaagagaaaaaaagcaggaagggaagttgtcatataaaacagaactttaagtgacctaacaattaaagcgaaccaaaatggaccactctggctgttgtgttaggagtacatcagagccaggcgtggtggcagatgtctgtaatcccagcactttgggaagccaaggcggggggacagcttgagccctagcatctgagaccagcctgagcaacatggtgaaaccctgtctctacaaaaaatacaaaaaattatcctgttatggtggcatgtgtctgtagtcccagctactcaggaggctaagtgggaggatcacctgagtccgggaaattgaggctgtagtgagctatgattgtaccactgccctctagcctgggcaatggagcaagaacctatctcaaaaaaaaaaaaaaaaaaaattagctgggcatggtggtgcatgcctgtggtcccagctgctcaggaggctgaggcaggaagattgcttaagcccaggaggttgaggctgcagtgagccgtattcttgccattgcacttcagtctggcagtctgagtaacagaatgagactctgtcaataaataaataaataaataaataaataaataaatcagagatgatcaaggatataaacagggaggacaggtaagaagctattacaaaattccaggtgagattttccacaaagatgataagaagacggtggttggattctcaatgtctttaaaagatgtaactgacatctytaaaagatgtatggatgagatacgaagttttagcgtccmagatgacttccaagttttggcctaagcagttggaacaatggagtgccatttactgaaataggaaagactgcaggagaagcaggtttgtgggaagagattaggaggagcccaattctggactctatcttcagcctgataggccttttgaatagccacaagaagctatgttaaggaggcagtgggatattgggatatatgtgtggaatactgaggatggggccaggatgggaggtacatttgggaaattcaggagttcttagtaggcagatggtatgtaaagttactagagtgagcggggtgcggtggctcatgcctgtaaatcccaacactttgggaggctgaggcgggaggattgcttgagcccaagagttcaagaccagcctgggcaacatagagagaccccatctgtttttttaaaaaaagctactagggtgggtgaaaaaataaaaggagtgagtgtagctagatgagaggttccagggctgagcctgcgaggtgcacagaggtgggagtcagcaacaggaacaaagcagggacacatcccgaaagccaggtgaaggaaggaggaaggctttgtcagacacttctggcaggtcaagggaggtgaggaccaaaatctgacctttggattgagcgatgtggagattgccgatgcacttgataagagtagtttcattcagtaagcctgtgggagcgggctcaagaaagcctgcctgggagacagaaagattagaaaatagctcttttgaggagcttgaaacagaaagaaccaaagtgttagctggatggcacaatgcggtctagagtctagagaggggtgttgctttgtttgtttaagaatcactggtttattcctttcagaaagtatttttgtgatggcagtctttccccaacaactttttattactgacaaacaccaaatcatagaaaaggtggatactgtctgtgtttcacctagtttaaccgattgtggttttttggtttggtttggtttggtttttttgagacagggtctcactctgttgcccagactagagtgcagtggtatgatcactgctcactgcagcctcaacctaccaggctcaagcgatcctcccacctcagcctcccaagtagctgggactacaggtacacaccaccatgcctggctaatttttttttttttttggtagagacagagtttcgccatgtttcccaggctgggctcaaactcctgagctcaagcaatcctcctgccttgggctcccaaagtgctgagattacaggtgtgagccaccccgccccaccaacccattgttaacatcttgccacatttgctttctttaagtatataaatacatttattttgtctgagctgctctaaaattgtagacacaaagtttatcttaaagtgtatatctcctaaaaaggatggtctcccacataaccataatatcattattatattccaagaaatttaatrttgatataatatataacatgcagttcatattaaaactgtatattgttgctattttcatttccatagtctaattaaaggtcacccattgcttttagttgttacatcttgaagatttttttttttaggataggaaaaataatagcacattgatatgctgatttcaaaaatctatagagagtgaaaactgatgattcgtaagaggggaactgccaaggcagtaaactcgggaaggtgagagatagccagagctggacagggttgggaggggactgacgttggtgggagcatgggcggttcatccagagtagcaggaaagagagaagacagagcccgtgggcaggtgggtagttaaacatggtggaccttaaggaaatttccttttgattgcttttattttcttagtgaaatgggaacgatggtattcagttgagaggagggaaaggagaggtgcgacaggctgaagaaaagatatgaagtctttgtctaagtcgtcttcagattaggacatgcattatcactgatctaagggtgtgcatttatagacccttgtagacccttagcttctatatataggcatccctggaactaatctgcctgaaaaaggactactttacagtaggcttcctctgactttggaagaaaaggcagaccctcacttatcccaaatctgaattaattatatcacccctcggattgtttctgctccttgtctgcttgtttttgtttttgttttgagttggtcgctcttgtcgcccaggctggagtgcagtggtgtgatctcagctcactgcaacctccacgtcctgggttcaagtgattctcctgcctcagcctcctgagtagctgggattataggcacccaccatcacgcccagctaattttttgtatttttagtagagacggggttttgccatgttgggcaggctggtctcaaactcctaacctcaggtgatctgccctcctcggcctcccaaagtgctgggattacaggcgagagccactgcaccagccatctgctttctgcttgttgattttattcttcttttttttaatccaggaaaaaattacttttgaaagcagaatgtccctcttaaagacccttttaccccacggtcccatagcttatcatcctgctaggggattgccacttccttgtttctaatttcagcctttccagcgtgtgtgcctttctcttttccctctccacctgtacttcaccctgttttcctgcctctcctttgactgttgcctcttctctggttttcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatggtgagtaggaagctccaggctctcgagatagaggatctggtcacagtttcactctcctgctgccagtggtactgtactaagaagtaatataatggtgctactccagaaattttggtaaaaggagattaaggaggaaaatacatcatccttgagtcacatttatttctctttgggcttttatttatatatctgtatctatatctatctagctatctgtagatagattttttttttttttttgagatggagtttcgctcttgtcacccaggctggagtgcagtggcgcaatctcggctcactgcaacctccgtctcctgggttcaggtgattcttctgcctcagcctccctagtagttgggatcacaggtgcccaccacctcgcccggctaatttttgtatttttagtaaagatggggtttcataactttggccaggctagtctcaaactcctgacctcaggtgatccgcctgcctcagcctcccaaagtgctgggattgcaggcgtgagccactgtttccggcctcttctgtatattttttatctaaatagggttttcattttgctataagtattgtaattattttgattaatatgttgataacctatggttttgtatcttccttttttccacacagttaatcaacacttccctacatcttaagtatttgtcgtaaatgttattttttaacaactattcatattttataggatggcttaccttaatatacttagccattctcctattaatagatatttggatagtttctgtttgtctccagttatgcaaatgcatgtgattttgatgttgagttttttggatactgtttatatggttttgtttcccaattagatkcagaagtaataatacatagaaatgtgaacattagtacactttttaacttaagtttattgagtttataccaaagtaagtcaagcactgtgctagacactgggttaagggtctctggcgttcacccaaacctccctgcagaaatctcttacgctgccaacactgtctcttgggagagtttgaatatgttcattggaggatagtgaccccagaccaacagtccagttgcccagtcctggaatgtgaaggcattaagctgtttagtatgataagctatagactaatgcctgcctccaattacagcattcaaattccaggtctgattcccatccccttcccaggccctagctcatcagaccattatctgactagcattaaaaggagatgaagctggcagccaggatcaggttggctgaaagctcaaaaaagcctatgccagcgtggcaactgaattttatgtcattgactcaatctctaagtcctatccaggagacatttgtttagaagcaaaagtaaaacagtcctttttgaaagtaacagttttcatttctgttcatcagtatctaactagaagcctcagccctttgatgtaactgattttatagcatcctcctccctaaaatcacagaccttttctctttccttggagagaggagatgtagctcagggattcctaatgacctttcaaggtttaaaaaacttgtattttggccgggcgcggtggctcacgtctgtaatcccagcactgtgagaggctgaggcgggcggatcacttgaggtcaggagttcgagaccagcttggctaacatggtgaaaccccatctctattaaaaatgcagaaaaatcagccaggggtggtggcacatgcctgtaattctagcaacttgggaggctgaggcaggagaatcgctggaacctgggaggcataggttgcagtgagccgagatcccgccactgcactccagcctgggcaacagagcgagactccaactcaaagaaaaaaaaaaaaaaacttagtgcgtgtgtgtgtgtgtgtgtgtgtgtgtgtgtgtgtgsccttgaacccctgctctctgccagtagtggggttcagcttgtcttaaagatgtttccagctcatcttctaaccttaggggagtagcacttaagttatttctctgttgcagagatggctgagcgattccatcatgtcactgtgctccagatayacttctgtgactggcagcaggccygggagcggagggagagcttgtacgctcaccatgcccaggtggagaaactggccaggaagatggccctgcggcgcgcctttactcactggaaacactgtatcctttcagatactcaggctgtccattgcctcagccaggacagcatgagctcagcagcatgtgaaacgaaagtcatgagatacatgggaaacaattgccaaacgattcaaaacagccttatctctgttgacagtcttaaaatttttgtttaattgggattgtgtataaaaagagtgcttatatatagtttaaaaataataaaatgaacaactatatatcttatcacccaactttcaaaatagaaccttcctagcacacctatttgctcctccctgactgcgttctttttcttttccctcagaggtaatcccactttcctgattcacattttttggtgttacaatttaagtgcttttctctacccactaggtggtggaaatagccaccactatctttttcttggtgataccatcaccgtgatcatagtttccatttattgcgcttttactacgtagcagacattatgcatcatcctcttcatcctcatagcaacgctgtggagtaggtgccactattaccattttacagacgaggaaagagattcagaggagctgagtgtattctaaagtcacaggtcattggcagagtcaagattttcaaaacctaggcctttaactcctgtgtacatattctttttttttttttttgagatggactcttgctctgtcacccaggctggagtgcagtggtacaatctcggctcactgcaatctccgcctcccaggttcaagcgattctcctgccttagcctcacgagtagctgggattacaggcatgtgccaccacgcctggctaatttttgtatttttagtagagacggggtttcgccatgttggccaggctggtctcgaactcttgacttcaggtgatccacccacctcagcctcccgaagtgctgggattacaggcatgagccagcgtacccagcctcttttttttttttgagacagagtctcgctctgtcacccaggctggattgcagtggtgccatctcagcttaccgcaacctctgcctcccgggttcaagtgattgtcctgtctcagcctcctgagtagctgggattacaggcggccaccaccatgcccagctaatttttgtgcttttagtagacatggggtttctccatgttggccaggctggtctcgaactcctgacccaaagtgatccacttgcctcggcctcttaaagtactgggattaccggcgtgagccaccgcgtccagctctatgtataaactcttttttttccctttttttttttgagatggagtttcgctcttgtagcccaagctggagtgcaatggcccaatcttggctcaccacaacctctgccttccgggttcaagcgattctccggcctcagccccacgagtagctgggattacaggcatgcaccaccatgtccggctaatttttttgtatttttagtagagacagggtttctccatgttagtcaggctggtctcaaactcctgacgacctcaggtgatctgcccgcctcggccttccaaagtgctgtgattacaggcctgagccaccgcacccagccatattcttaatcactacccctaccatactgtgtgcccaagtgtgagaatttggactgcctaggatgttcatccacacattttatttgttcatcaaagtcttgctttgtataaactcctgcttaaattctgggatatgaggaagctcagactaatgatagttcattgtctagtgggggaaatagacatgaaaatatgtctttaaatatggcatgataattcctatcataaagatttgtatgaagtcctgtgagagcgactgtggagattcagccaaggaggtaatgtttgtgcagagtctaagtcataggagatgagaagttgggaaggttgatgtcttaggggaagactgcagaaggttggaaaaggcatttcagtgaggaaaagcattcaagaatccagtgggctgtggaggtagggatggtgggaaggtagatgcaggaacctctggaggttttttaacttttaaaaatttagagacagggtcacatgttgcccaggctggagtgcagtggctttcacaggcgcaatggtagctcactacagtcttgaactcctgggcttaagcaatcctcccccctcagcctacgaagtaggtgaaactacaggcacacaccatcacacccggcttcaggggtttttaagaagagaagaggctgggggcagtggctcacacctgtaatccaagtgctttgggaggatcgcttgaactcaggagtttgaggctacagtgaactatgatggcacccttgccctacagcctgggtgacagagtgagacccagtctcttaaaaaagaaaagaagtgcagtcagatttgtgctttggaaaggataattctggattagcggagagaggctagcactggtgggagaccagttatgggaggaggctcacttaccagtctacgtaagggacgagttggatgaactgcagggtgttgggggtggggacagaagagcagaaggggatggagagagccaagagatttaggaagggaacagatggacttggcgaccgattagatgagagtgggaggagaaaaggtttgaaaataactccaaggtttttagctcaaatatctaactggattgtgatgccaaaacagagactatagaaaaaggagcagattctgctttagatatggtgatttctaaatgtttactgaaattgatagcagtttatctcaggtattttttgcgtctcatctcatgggcattcaaggggaggaatgcaagaccagatgtttgatcagtaactgacagggtttccctttgcccactgcttccctgggtcatcaggagtagacagaggtggacctcagcccacctggcacgtgtgttatccccgatagccacggcccttcaaggtggcttgctgagaatgcactgtgtaggggtcagaaccttgttgggactggaggccttcacttcctggcagacatgctgctgtgtgcagaagaagctgcccagtttgagatggcagaagagcaccacaggcacagccagctggtaagagccctgcatcctggcacrggtccgcttggcagccttgcttgggtatccactcttgggggaccctgacccctatcaccttcattaaatgcagtcagctatgggtgagttttggtcatgaagccctcctttcattgtgggtgtccttcttttcattttggattacaggtgctaatgttgtagggtcagaggggtatggagctgtaaaggaacctcagagattatttagtcctgagctttttttacatggtaaaaccccttttgagtggcggaagcctcacctataaaataggtcaaagtagccatgctgtggttgaagcacgtcagggagtccgtccctgttctacctgctactcttcccttcccttgctacacgaggtggtcttcatatgttttcaggagcctctggggctccacaaagcacagtacgaaaacccctaatccagtctgatatcttcacttctgtctcagaaaattgaagcctaaggcatggggaagtatgggcaaatcagctttgcttagccaatttgtgaggcattattattattttttagagatgcggtctcactatgttgtccaggctagattcaaacttctgggctcaagcaatcctcccacctcagcctcctgagtagctgggactataggcatgtgccaccaggcccagtgttgaggcattagtattattatcattactattattattagagatagggtctcctctgtcacccaggctggagtgcagtgttaaaatcatagcttgctgcagccttgaactcctggactcaagtgatccttccacttcagcctcccaagcagctgggaccacaggcacatgccaccatgcccaactaattttttagattttttttttttttgagacagagtctcgctctgtcacccagcctggagtgcagtggtgctatcttggctcactgcaagctctgcctccggggttcacgccattctcctgcctcagcctcccgagtagctgggactacaggtgcctgccaccacacccagctaattttttgtatgtttaatagagacggggtttcaccatgttagccaagatggtctcgatctcctgacctcgtgatccgcccgcctcggcctcccaaagtgctgggattacaggcgtgagccaccacgcccggcctaattttttagtttttttatacagacggagtctccttctgttggccaggctggtcttgaactcctgtgctcaagcagtcctcctgcctcagcatcctaaagtgttgggattacaggtgtgagccactgcacctggccttttaggcattattgatggagctggatccaggtccatcctggcccaactccaacccttcctttcactaaagattccttcttccattttagcagcactgcatttataatcatacaaatgtatgcactgagcccacatggtaaaaaaacaaaaaccaccacagacaaaaagtctgtcttctcctgagaggcaacagttgatgtttaccttggtctgtagaattgtcatgtgggtcatggggttctttcctggtgtgggtgtgtttgttcttgtgcagtatagatggacagcagggagggttcagcaaatatttattaagtgcctgctgtgcaggctggcttgtgttaggctcccagttgaatctcaaagcagagaaacactcagggagatggaacagctacaagaagctgtgaccaagcttctccccgctgatttgaggcactgtttgccttcctctactcttagtttacagactctactgatcccagtccttgtaatcagttgtgtcctttctttgcacagtatttttgctttagagccctaaaagacaatgtgacccacgctcatctccagcaaataagaaggaatcttgctcaccagcagcatggtgtcacggtgagggttgtcttctgtatcaagggacctcttctgaaggccattctctctcgctctttttttcagtcttgccaaattaagcagaactctttttaaaaaaactttttgtgcttcaagatttgtccagactgtcaactgtaaaaccttagtttgcattttctttctttcttttcttttcttttttttttttttttttttgagacagtctttctctattgcccagactgtaatacagtggcacgatctcagctcactgcaacctccgcctcccgggttcaagcaattctcctgcctcagcctcttgagtagctgggattacaggcatgcgccactacaccttcctaatttttgtatttgtagtagagacgaggtttcaccatgttggccaggcttgtctcgaactcctgacttcagatgatccacccgcctcagcctcccaaagtgctgggattacaggcgtgagtcaccatgctcggcctttttagtttgcattttctttggtaatccatacctgctgatagaaaaacttgtttgatcccatttttttatctatttgccaagaaatggatagttgactcaaagttcagggactgtggattttaaacctgacctaggggatatagtgatacaaatactttctttttttctttacttatttagaggcagggtcttgttctgtcacccaggctgtagtgcagtagatcactgcaggttcaagtgatcctcctgcctcagcctcccaagtagttgggactacagctgtaagccaccacacccagctaatttttgtattttttgtagatggggtcctactatgttgcctaggctgatctcaaactcctgggctcaagtgatctgcccaccttcgcctctcaaagtgctgggattacaggtgtgagccaccgcacctggcccaaatatacttttttttttttttgagacagggtcttgctctgttgcccaggctggtgtgcagctgcagtggtgcgatctcaactcactgcaacctccacctcccaagttcaagcgattctcatgtctcagcctcccaagtagctgggatcacaggtgtgcaccaccaagcccagctaatttttttgtatttttagtagagacgggtttttccccatgttggttgggctggtcgcaaactcctggcctcaagcaatccacctgcctcggcctcctaaagtgctgggattacagacatgagccaccatgcccggccccaataggaggctttgrttgtgtttctattgtaagtctattcacttccattgtaagtccattataaaacaatggtttgtttacttgatgccaacatatattgtctctactttcttggtgtaggatttttttccctgttactattttatgaaaaatgtttaaacatacagaaaaataggaaaaaaaagtataataagcctctatatagtcactacctggatatagtaattgttaatatttgctatgtttgcctcattgttttttgctgaataatttcaaagtaaattatagacatcaygacactttgcacctaaatatttcagcatgcgtcactcagagacattttcttatgtaacgacaatgtcattatcatccctaagaaaagtaacagtgattccctaacattaatatctagtcaacattcaaatttccatagttgtcttaaaaatgtcttatttgtagctgctttttacaaaccagaatgcagttaaggatcactaactccatttggttcttttctgattgatttttagcagaaatggattttgttactatatttcttaaagcttttaatctagaactttccttcccccaacaacacttctttattactatatatatatatatatatatatatatatatatttttttttttttttttttttttttttttttttttttgaaaccgggtctcgctctcgcccaggctggagtgcagtaagtagcttgatctcggctcactgcaacctccaccttccgtgttcaaactgttctcctgcctcagcctcccaggtagctgggactacagacgcacaccatcacgcctggccaatttttgtatttttagtagagatggggtttcaccgtgttggccaggctggtctcaaactcctgacctttggtgatcctcccacctcggcctcccaaagtgttgggattacaggcgtgagccacgacacccggcctattatattttttaattgtggtaaaagatacatcacttaaactttatcaccttaaccatttttaagtgtacagttcagtgacatgtacatccacattgtgcaatcatcatcactattcatctctagaactttttcatcttgcaaaattgaaactctgtacccatttcctctttcctcagcccctggaaaccaccattctactttctgtctctataaattagattattctagagacctcataggtggaatcatatagtatttgtccttttgcaactggcttatttcacttagcataatgtatactttttaaaatgactgcctttttttaaaaaaggacaggccagttattttgtttatacaatttatttattattataataattattgttagagacagggtctcactctgtcatccaggctagagtgcaatggtgtgattgtagctcatcgtagcctcatcctcctgggctcaagagaatatcctgcctcaacctcctgaggagctaggactacaggtgcataccaccatgcctagccttgtataattttttttgttgttgtttgtttgtttgtttgtttgagatggagtttcactcttgttgcccaggctggagtgcaatggtgccatctcggctcactgcaacctccacctcccgggtttaagcgattctcctgcctcagcctcccaagtagctgggtttacaggcatgtgccatcacgcccggctaattttgtatttttagtagagacagggtttctccctgttggtcaggctggtctcaaactcccaagaactcaggtgatccacccgccttggcctcccaaagtgctgggattacaggtgtgagctactgcgcccagcccagtgttttatgttattgatttatctgattgtttccttttgatatcatttatatcatttaattttcctttagtctacatggttcctataatcgttacatctgagggcttgtttagattgaagttaaacatttatgcgagactacttcataggtgggaatatgcattaaaatcagttttaatttctaaaatggctttctaaaatgtcattgtcttctgtgggattaggaatagcttcttcatctaatttccatagactggaagaaccatctttttgccttttatgttggcccagaatagctctatagttgagccctcattaatttgtatgcccactgtatgttggctgctcctaactgaggtcatttctgctttgggggagctcacagtctgttggagtaaggattcactgttttacctttcatctcagtacatttccatcttcttcctcccttgctttagctgctgcacaggttctggaacctctggcggtctcagattgagcagaaaaaggaaagagagctgctccccttactgcatgctgcctgggaccactacaggtagggactctggtttcatccctggctctcagggactttgtgcctctgacttactgttttccaggagtaattgcttgcccttctatgcgttagtgtggcagattcagaaaggcctgctggggtggaggtcctgctgtaaaccatttgttcctgactttgggtttttggctgatcakatgggagatagaatgagcatatttgcattggttcttggccaccatagtctgaagtatgtgcctggtcgctcactgccttggtcctacaggcatcaatatgttcacaagttagaattcatgcattgctagtgttaaagagaagggtcagggacatttgtgactcagtcttaaagtgtgcagggaatgtcctcaatattttagagctagtcattcagttaaataaataaaaacactacatttctgtgaggaaaactcagaatgtatagggtggaaagtataaagggaaaaataaaagttgcctggccccctccctacaagtaagagtaagatcttactcctcagaaggaagcactacgtataaactttcttgctgccagaaatgttcaatatgtccttcctttctttgccctccttttttcctctccccacagtataatcaacttaatttgcatagtttagctccaattttgaagcattttttaatgagttagtgagaatcccaataataaactgactcatttagagttatcaaggcatattattccaaaccctggtttacaaaacctagtgtgagaggcaacatgtcgtggacccccagcgtttggccatgaaaccagaaagttcaggatatctaggggatttcacacatatttcctaaattccagagctactgtgctttcrgtggtctaattaggttttacaagaaagttgcaacattttaggcaatccacagtccaaaatcagaggttgacaaattttatattagatatcaggttcttattgccgtctctcctagaatgaaactagtaagcccatggggtgcctttaactcacaggaagtaactgtaccgcartttacctgccttaaaacaaagttttaaaaacttgaaacctgaaggtgttcttccttttgtttcagaatagcactgctgtgcaaatgtatcgaattgtggctacagtatactcagaagaggcggtacaagcaggtatggagtactttttagcagatagctctactggcttacattcttggacccatttgctttggaaagattcttggaaaagacctatgccaagaagtcttatcgttctgctttggaagagagggtgttgaaaaagctcaaagtcatttcttccagttcccacctctaatatcagaaagtctgcataactcccatttcttatctgctatgaaaatacaagttctctctgaaagtactgagctcttatcagccattcacatctttactcaaattcatttagtctctgagttagccagcccttcacccagtgggacctgcaagaggtacagggagaggtgcagagcataagtgctgcatcccagtgctaaacagtgtgagacacatgtctcccgggggtggaggatgtgaggtcaggaccacaaataagtaaaggcagattgagaaagatagattcaattccatttaagaaatacttattgagcaactgctgttcttcagacactgcactaagcactgaggatacaactgtgatataaagtcaataaaattcctgctctcccagggctcatactttagcaccagggtgacaaatgagtgtgaccttacaagcccgttctaccaattgggagtacctgtctggaatgttgaagtgagaaggatttcaaggccatatttacactcagtgggaaagggttcagttgatggcatctgccattgtgagaagtgccccctttttggtcatctctggcagtgaaacagaggaagacacaaaccaaactcctcccagttattttcgtgctgcccaccctacccgtacctccatcttctgttggagtctaacaggtgaatctttagattcacctgttagctagttccctatagtttggggatagaatccaaatttttagcaaggcctacaaactccttcgggagctggtccctgtctgtttctctcccctttcctgttaccactctgttccttcacaactgcactctgaccagttaagctgccagtggttccctaaaggtcctctgtgccctcctgcttctctttgtacctccagttctctatttcacactcccttccagctcagatgtcacctcctcccccaggccagtccacstccacccctaccccagaggcatagctttatcagaacattcatcttatagttgttcactggcttctctttccccacaggctgtgaagtcctttagagtacagcctgtcccttttgcctccttagcccacagtgcttggcatgggatatgtgctaatatttggatgaattaatgcacagaccaacaaatgaactgctgttgatttcttcagagtttttttccaaggatgatctaagtcgatagagcttggatgctacagggcatggcctctttttgcgtcactcttgcctcctacacttaagaaatgctagagtcactgcattctttgacatgcctttggattatgttactggctttgaaaagacattgccacttgttatcttaagttcatgtaatacaagttcaccagaatgcaggaaagcctttcagaaaaagactatgagtgtcagagttgaaaggttgtatttattcaaggtggagagcagagggtctcttttatttccttcctggaaaacgagcactccccttgacacaggggcccaacactggcggacagtccagggtcagcgttttcatctctcacactgatctagcacggcctgctttcaaaggtatagcgggtctgaaaaatgggaagagcactgcttagtcattcctaaacctttagctaacaatctgaatatcacctcttggtataggtatcccaggagcacatcagatctttctattcttagacaagataaaaatattattttttgtgggtttcttcctttttaaaaagtaacatacagtcagccctctgtatctgtgggttccacatccatagattcaaccaaccatggataaaaaatattcagagaaaaaaaagagtagttgtgtctgtactgaacatattcagacctttttttcttgtcattagcccctaaacaatatataaacaatatagcataacaactatgtacatagcattgacattgtattgggtattatgagtaatctagagatgcatacaggaggactgtgtaggttatatgcagatgccaatttatttgttttgttttgttttgttttgtttttgagacaggtttcactttgtcacccaggctggagtacagtggcatgatcttggctcactgcagcctcactctccccaggctcaagcgattctcctgcctcagcctcccaagtagctgggactacaggtgcaagccaccacgcccagctaatgtttgtgttttgttttttttttttgtagaggtggggtgccaccatgttacccaggctggtctcaaactcccaagctctgcctgcctcagcatcccaaagtgctgggattacaggcatgagccactgcacccggcctgctataccattttatataagatacttgagtatccatggattttggtatctgagaggggccctggaaccagtcccccacaaataccaaaggatggctctttgcagaatggcgaatgtttgctaactgttgaagcttgatggtagggtcatgggtattcattatactgtcggcttctacttttgtttacatttgaaaatgcccataataaaaaatagaaaagcaatgtgtagatattatagaaaatttaggaagtataaaaagatataaagaagaaaaaataaaaccattcatgacatttgatgggtaagcctggtatctctcttcctctgtttgggtaggagtgtatgtacctatctattcacatacacatacatatgcatactgatccaattatctattgctatgtaaaaaatcaccccaaactcagtggtataagacaacaaccattctattatgctttatggattatcaaagattgagacaggacataatgggaatggttggtttctgctccaagatcagcctcaactgaaaagattctaatggcaaggggttagaattatctagacgttttcttcacacacatctagatcctggattagaatgactcaaagactgggctcaactgggaatgttaaccaaagaacctgtgtatgacctctctgtgaggcttgggcttccttacagcatggtggccttggggtagtcagctatcagagcttcaaaatgagtgttccagtgaacaagtcagaagctctgtggctctttgtatagcctcagaactcacacagtgccacttttaccatgtgctattggtcagagcagtcactatcccagccagattcaaggggagggaacatagatcacttctcagtgaaggaggagcaaataatttgcagccatgtttttaaaacctctacacatttgggctgggcacggtggctcatgcctgtaatcccagcactttgggaggccaaggcaggcagatcgtgaggtcaagagatcaagaccattctggtcaacatggtgaaaccctgtctctactaaaaatacaaaaattagctgggcgtggtggcgcacgcctgtagtcccagctactcgggaggctgaggcaggagaatcacttgaacccgggaggcggaggttgcagtgagctgagattgtgccactgcactccagcctggcaacagagtgagactctgtctcaaaaaaaaaaaaacaaaaaacaacaaaaaaaacaaaaacataaaacctctatacatgcatatatgctttttccccccaaagttttggatcatggagacatatatggtatattcttatgtccattgtctgtcttcctactgatgtatcagtaaaatagtagacttttataattacattaatgtgtatgacaaacactataaacaaaatcaaaagatatattatggggtggggaaatatttaagatttataacacatgacaaaggactaataaattgtttaggttcaaaaaccccatacatatcactgagtcaaatgctaacagacagtgaaacaggtaatgggtatgaacacctaagccagggggaagagagagtgagtgagagtgtgtgtatgtgtgtgcgtgtgtgtgtgtgtgtgtgtgtgtagaaatgtttaactaatgtttaagtgaaaatttttttacctatcctatttcatttttcacctagcatattggcaaagataataaataatgattcatctttttctcatttttattatataggaagcaatcctcccacaagggtgtgaccctgagaggtcatgtttaaaaaaaaaaaagttaagtacaaaggttattcattcttttactttagctgctacaggccagagcggatggtcatttccagcagagagccctgcctgctgccttccacacatggaacagactctggcgatggcgccaccaggaaaatgtcctcagtgcaagagcaacacgtttccacaggtatgttgcgcagctcctgtctgcactggggcaggtgtttcaaatctaactctgacaaccacacagcccatttgctgtgcttttcagcttcccagaccccaggccctagtacttcctggattttcagtaatgtgggctcattgatttcatctagcaggaaaagacaagacagtgtttcccctgggaaatcttttgtccatctttatttattttttttttgtgtgtgtgtgtatatatgtatttattaaaaaaaatgtgtagtgtttaatctgaacagccagtggcttagtcaagttaacatatacatgaagagacttattatgaggaattgacttacactattatggaggctgagaagttccatgacctgccatctgcaagctggagactcaggagagtgggtagtgcaattccagtctgtgtccraaggcctgggaaccaaggggcctcgaggtgtaaatcccagttgaagggcaggagaagatgagatgagatctgcccacgcaggcaggcaggaagcaaaaggggcagattctttctccttttgttctactcaggccctcaaggggttggctgaggcccccgtacattaggaagagaagtctgctctactgagcccacagattcaaatgcttgtctcatctgcaaacacccagaaacactgtttaatctgggcacccagtggcccagtcaagttgacacatagaatccaccaccatggagtagagagaagtcacagaatcagactgcttgggttcaaatcctggctctgttctgtgaccttggccaaggtactcaaatgaccaattctctagttttctcatctctgcagtgggggagtaatagtgcttacctcaaagggttattcagattttggtaattggctgttgagctattcagattttctaattcttatgtcaattaatcatttcaagtttttttttgagacagagtttcactcctgttgcccaggctgaagtgcggtggtgtgatctcagctgactgcaaccgccgcctcccgggttcaagcgattctcctgcctcagcctcctgagtagctggaattacaggtgcctgccaccatgcccagctaattttttgtgtttttagtagagacggggctttcaccatgtcagcaaggtctcgaactcctgacctcaggtgatccacctgcctgggcctcccaaagtgctgggattacaggcgtgagccactgcgcccggccagcgtttcaagtttttaagagaatgtgtccatttccccttctctttttattttatttttatttttatatatatttttaaatttgaattgcttctctctttttcttgattagttttactactggcttttctatattccaacttttttctttttatttatttatttatttttttattgataattcttgggtgtttctcacagagggggatttggcagggtcatgggacaatagtggagggaaggtcagcagacaaacaagtgaacaaaggtctctggttttcctaggcagaggaccctgcggccttccgcagtgtttgtgtccctggttacttgagattagggagtggtgatgactcttaatgagcatgctgccttcaagcatctgtttaacaaagcacatcttgcaccgcccttgatccatttaactctgagtggacacagcacatgtttcagagagcacagggttgggggtaaggtcacagatcaacaggatcccaaggcagaggaatttttcttagtgcagaacaaaatgaaaagtctcccatgtctactcccttccacacagacacggcaaccatccgacctctcaatcttttccccacctttcccgcccttccattccacaaagccgccattgtcatcctggcccgttctcaatgagctattgggcacacctcccagacggggtggtggccgggcagaggggctcctcacttcccagtaggggtggccgggcagaggcgcccctcacctcccggacggggcggctggccgggcaggggggctgaccccccccacctccctcccggacggggcggctggccgggcggggggctgaaccccccacctccctcccggacggggcggctggctgggcagaggggctcctcacttcccagtaggggcggccgggcagaggcgcccctcacctcccggacggggcggctggctgggcgggggggctgaccccccccacctccctcccggacggggcggctggccgggcagaggggctcctcacttcccagtaggggcggccgggcagaggcgcccctcacctcccagacggggtggctggccgggcaggggggctgaccccccccacctccctcccagacggggcggctggccgggcagggggctgacccccccacctccctcccggacggggcggctggccgggcggggggccgaccccctcacctccctcccggatggggcggctggccgggcggggggccgacccccccacctccctcccggacggggcggctggccgggcagaggggctcctcacttcccagtaggggcggccgggcagaggcgcccctcacctcccagacggggcggctggccaggcggagggctgacccccccacctccctcccagacagggcggctggccgggcggggggctgacccccccacctccctcccggatggggcggctggttgggcagaggggctcctcacttcccagtaggggcggccgggcagaggcgcccctcacctcccagacggggtggctggccgggcaggggggctgaccccccccacctccctcccggacggggcggctggccgggcagggggctgacccccccacctccctcccggacggggcggctggccgggcggggggccgaccccctcacctccctcccggatggggcggctggccgggcggggggccgacccccccacctccctcccggacggggcggctggccgggcagaggggctcctcacttcccagtaggggcggccgggcagaggcgcccctcacctcccagacggggcggctggccaggcggagggctgaccccccccacctccctcccagacagggcggctggccgggcggggggctgacccccccacctccctcccggatggggcggctggttgggcagaggggctcctcacttcccagtaggggcggccgggcagaggcgcccctcacctcccagacggggcggctggccggggggagggctgacccccccacctccctcccggacggggcggctggccaggcgggggggctaacccccccatctccctcccggacgggctggctggccgggctgaggggctcctcacttcccagtaggggcggccgggcagaggcgcccctcacctcccggacggggcggctggccgggcggggggctgacccccccacctccctcccggacggcacggctggccaggtggggggctgacccccccacctccctcccggacggcacggctggccgggcgggggggctgaccccccacctccctcccggatggggcggctggccgggcggggggctgacccccccccacctccttcccggacggggtggctgccgggcggagacgctcctcacctcccagatggggcggctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatgggacggcggggcagaggcgctccccacatctcagacgatgggcggccgggcagagacgctcctcacttcctagatgtgatggcggctgggaagaggcgctcctcacttcctagatgggatggcggccgggtggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcctggcacctcgggaggccgaggttggtggatcactcgcggttaggggctggagaccggcccggccaacacagcgaaaccccgtctccaccaaaaccagtcaggcgtggcggcgcgtgcctgcaatcgcaggcattcggcagactgaggcaggagaatcaggcagggaggttgcagtgagccgagatggcagcagtacagtccagcttcggctccgcatgagagggagaccatggggagacggagacgagggagagggagagggacagggagagggagagggagagggaggtgtccatctttatttcaagggctttcaaaacagcctgtttgtaaccttcattattagccactgagagctccattaaagcagcccattagctttctggatcagagcacggtgggaccttgcctcaccttggcagacattcttaagtgtcatttccccgaaacacttagttcctgttctgctagacctggctttttgaagtcttgaaatgatagtcatcaacaaaattacaaaggtcgggccgggtgcagtggctcacacctgtaatcccagcactttgggaggccggagcgggcggatcacaaggtcaagagttcaagaccagcctggccaacatggtgaaaccctctctttactaaagatacaaaaattagcccggtctggtggcacatgcctgtaatcccagctactcgggaggctgaggcaggagaattgcttgaacttgggagatggaggttgccgtgagctgagatcgcatcattgcactccagcctgggtgacagggcgagacgccgtctcaaaaaaaaaaaaaaaaaagaaaaaggccgggcctggtggctcatgtctgtaatcccagcactttgggagtccaaggcgggcggatcacgaggtcaggagatcaagaccatcctggctaacacggagaaaccctgtctctactaaaaatacaaaaaattagccgggcgtggtggtgggcgactgtagtcccagctactcaggaggctgaggcaggagaatggcatgaacctgggaggcggagcttgcagtgagctgagatcacaccactgcactctagcctgggcgacagagtgagactctgtctcaaaaaaaaaaaaaaaaaaaaaaaattagaaagctcaaggagcagatctacatctttttagttcccacagggacaaacttgcccacagcagtttcttagtatatggtgggacataatgaagaaataataataatttatttatttatttatttatttatttttgagttggagtcttgtcctttcgcccaggctggcatgcagtggcaccatcttgactcacggcaaactccacatcctgggttcaagtaattctcctgcctcagcctcccaagtagctgggattacaggtgtgcgccaccacgcccggctaattttttgtatctttagtagggacggggtttcaccatgttggccaggctggtctcgaactcctgacctcgtgatccacccgccttggcctcccaaagtgctgggattacaggcatgagccaccacgcccagcctgtaatgaagaaattattaatcactaactgtatgtctgccactgtgttgggcattgtgtgatgggagacagaaaacaaatacataaactcattctgcccatggcatcattatcttcattaataatttccttttcacagtgattctgagaggtcaggttcaaaatgataaatggtaacacaaccagtaagtggtacagccaggttaattcacatctccagttccaaagtccaggtgctttcttcttgatcaagaggaagatctttttgatgactttgtaggagggtgaaatttttgtgaggagataagaaacaactgagaaccaattcaagagaacagatccacgtgtccccagtcatgtcagccacaagttcttccagtgctcagagctagtgctgagggagactgagcatggaagtatctgggagaggcttcctgtgagtgagagggtgaggatggtggctggagtgggcaagatggggaggcccagactgaagagattgggctgaccctatagatagatattcgaaagatatttgagcaggtacatggaactagtaaaatgacagttttggaaattaccttaagttcagtgtactttatcttaggacagaggggtgagatggaggggcatgcattgggagaagttgcagtcatctttaatctggaggatttcaggccaggtgtggcggctcatgcctgtaatcccagcactttgggaggcagaggtgggtggatcattggaggtcaggagtttcagaccagcctggccaacatggtgaaaccccatgtctactaaaaatacaaaaattagcggggcgtggtggtgcatgcttataatcccagctactccggaggctgaggcacaagartcactttaacccaggaggcagaggctacagtgagttgagatggcgccactgcactccagccttggatgacagagcgagactccatctcaaaataaatmtctctctctctctcyatctatctgtctatccatctggagggctttgaatgctagtttgaggttagccagaactctggcttccttagtacgaagtccagggagatggttttaggtggtggccacgggraatagaggctgatgaaaggacatctcttgtctcttctggcttctgcagacagagcagctttgcctttacctagtcatgtattgtgggctggtataagattcattcaaaaatggcttcaggctggacgcggtggctcacacctgtaatcccagtacttggggaagctaaggcaggtggatcacctgaggtcagaagttggagaccagtctgaccaacatggcaaaaccccatctctactaaaaatacaaaaattggccaggcatggtggcgcacatcccagctactcgggaggctgaggcaggagaatcgcttgaacctaggaggtggagattgcagtgagccgagatcgcaccactgcactccagcctaggtgacagagcaagattccatctcaaaaaaaaaaaaaaaaaaatggcttcagtactgaaaacacgcacacacagtacccgtttctaaatggcttcagtactgaagacacgcacacacagtacccgtttctaaatggcttcagtactgaagacacgcacacacggtacccgtttctaaatggcttcagtactgaaaacgcgcacacacggtacccgtttctaaatggcttcagtactgaagacacgcacacacagtacccgtttccaaatggcttcagtactgaaaacatgcacacacagtacccgtttctttttttactgtcaagtagccgtgcttggttctattctttttttgtattttgtatgctgtgagaaccaaaaattaaaagtaccttccaaatagccaagaggagcctttaaaggatttttgctagggagcagtttgggtggttttagagctatcactctggagaaaaagggcagagggcgacttggagacagggtatagccaggaggcttgcaggacggtgtaggcctgatctagatttttacctgttttggcttggttggaccttttcagtaaacttggttttttggattcctgttttccttgttcatgagcagagtgattgagagtctggcttagaagctggacaagcctgagttcagacctatgctctgtcgcctgccagctctgtgaccctggacaagtcagtctgtctctctgagcctcagtctcctcgaatgtaaaattgagatgatgtggtcatagtctctatctcatatggttgtcatgaaaatgaaatgggaaaacatgtaaaatgcaaaccaagggcctagcataaaaatatgaactgtccctgtggcccctggagttgttttaatttgtgactctcatggtaagtacattttcagaggattggtttggagtttagcaaattaaagttccaaataaatatgtatctttgatattcttagggtattttttaatgttttaggaatatagacagattttatgatggaatctcatgaattatggctaaaaataatttttataaccctccagtgaaaggtactgagaatgagacaaaattggtttgtcttttattttaatcgagataaaatgtgtatacagtgaaaggcatagattttaaataaagttcgatgagttttcataggttttttttttttttgagacggagtctcgctctgttgcccaggctggagtgcagtggcgtgatcttggctcactgcaagctccaccttctgggttcatgccattctcctgcctcagcctcctgagtagctgggactacaggtgcccaccaccacacccggctaattttttgtatttttttttttttagtagagaaggggtttcactgtgttagccagaatggtctggatctcctgacctcatgatccgcccgccttggcctcccaaaatgctgggattacaggcgtgagccaccatgcccggccgagttttcataatttatgcacctatataatcaacactccagtcaagatacagaacatttctgttaccccagaaagttccttcatgtcccctccagtcagtccctaccctgcataggtaaccagtattctgatttccgtcatcataggttagttttgcatggtttttttcttgtcgcccaggctggagtgcagtggcgckrtctcagctcactgcaagctctgcctcccaggttcatgccattctcctgcctcagcctcccgagtagctgggactacagacgcctgccaccacgcccagctaattttttgtatttttagtagagacggggtttcactgttagccaggatggtctcgatctcctgacctcgtgatccgcccgcctcggcctcccagagtgctgggattacaggcataagccactgcgcctggcctttttttttttttttttttttttgatgagcagaagtgtttgaattctgttggattgatacagtccagtttatcttttttttttttttttttttttgagatggagtcttgctctgttgcccaggctggagtgcagtggcacgatctcagctcactgcagcctccacctcccaggttcaagcaactctcctgcctcagcctcctgagtagctgggattacaagcgcacaccaccacgaccagctaatttttgtgtttttagtagagacggggtttcactgtgttggtcaggctgatctcgaactcctaaccttgtgatccgcccgcctcggcctcccaaagtgctgggattacaggtgtgagccaccgcgcccggcccaatttatcctttttttttatggttagtgattttagggtcctccctaagaaatatttgctactctaagatctgaaaagatattttcctatattttatctggaagctttatagttttagcatttacatttaggtcaatgatcatcttgaattttttttctacatatgatatgacgtaggagtcaaggtttatttttttctgtgtttatcaggtttttccagcaccatttgttgaaaagccttttttttttgagacagaatctcgctctattgccaggctggagtgcagtggcagtggcacaatctcggctcactgcaatcttcgcctcccaggtttaagcgattctcctgcctcagcctcccaagtagctgggactataggcacacgccaccacgcccagctaatttttgtatttttagtagagacagggtttcaccatgttgggttggccaggatggtctccatctcttgacctcgtgatccacctgccttggcctcccaaagtgctgggattacaggcgtgagccaccgtgcctagcccagactaatttttttttctaattttttgtagaaaaagggtctcactatgtcacccagtctggtctcaaactcctggggtcaagtgatcctcctgccatggcctctcactgttctgggattacaggcgtgagccaccatgcctggcccagttctgtttagaattaatataccatttcatgtttagtgcaagaacataaaaacaataaaattctattttgtccccatccttgatgatatttttattgttgttattttttttttttttaagaaataaatcatagtggggattcactatgttgtccaggctggtcttgaacttctgggctcaagacatcctcctgcctcagcctttcaaagtgctgggattacaggagtgagccaccacccccaaccagtggtactttttgtcatacattttatgtctaacgattgattgattgtagagacgaggtctcactatgctgcccaggctggttttgaactcctgagttcaagcaatcctcctgcctcagcctcctgaagtgttaggattacaggcatgagccaccaggcccagcctacaacgttactatttttgctttaaataatcagtactctttttataaattgagaagaaaaaaattcagcctcttatatttacccacatattttccctttccagtgttccttgtgtcttcctgtacatttgaatgttcatctgtatcatttcccttcagcctaaagatgatcttttagtgtttttatactaaggtcaactggggttgaangatctcagcttttgtgtctggtctctgccctctggctgggccagagctccgtctttcaaccctgtccagcttctgctgtctctgttcccctcttggccctgcagcagtcactctctgctaggcctccaggccctcatctgaggacctgggacaacctcagtaaaattttgggtatttccctctgttcagctgtctcctttctagtaccctgaccccaaattccagcccctctggcagtcatgnactccagtctttgcctcctcagctcactgagactgagggaggctctgcttagcctcccttcccctcactgtttagaaggtgcccccaggcagaaagtctgggcggcctaggggctcacctcgcccgtgtcctatcttttcagcatcagaatctacacttactgtccagcgcctgaagacagttgccatatgtattttgtctagttttgtcatatatggccagagggcagatccaggaccagtgactgtgttctgactagaagtggaatctttgctttaagtgatgtgtcttgcgtgttaaatgtcaggggagcaagatcccccagtgctgaacatggatcctgtggcttcaccaacatgtagcccctagtggctgttggtcaattgtcccagcactgctgctgcaggatttgatgttgttaatggtgatctgtaggcctaggcagagatgacaaaacagtggttcccaaacctttttacttttctttactttttttttttttttttttttgcaacctctgtggcccaggctggagtgcagtggcacgatctcggctcactgcaagctccgcctcccgggttcatgtcattctcctgcctcagcctcccaagtagctgggactacaggcgcccaccaccaggcccagctaattttttatatttttagtagagatggggtttcaccgtgttaggcaggatggtctcgatctcctgacctcatgatccgcccacctcggcctcccaaagtgctgggattacaggcgtgagccactatgcccggccaacctttctacttttctaattcacctgaaatacttgtttaaaatactatttcctgggaccccccctcagacttgctcagtcagccttaggggtctgccccttgtttttcaacaggtccccaaagcgttggtcagcatgcactggaaagggctctcatgaacaatcctttatcagtgctgttaagtcaatatagaattaatgaagacctggggtctcagggtctgagtctttttcgtacggtgtgaaggcttggctgataccagaaacaacctggaaaatgttggcctttttaacagtttatggttttttggctgtctgctttccttccctttctctttgtgttgctttctccctcatctaagcttattcacctcttttatttttttcagagacrgggtctcactctgttgcccaggctggagtggagtggcgtgatcatagttcaccacagcctcaaactcctgggctcaggcgatccccccacctcagcctcccaggtagttggtactacaggcacacaccatcacacccagcaattttaaaatttttttgtagagatggagttttgctatgttgcccaggctggtcttggcctccagcgatcctcctgccttggcctcccaaagtattaggattgcagacatgggccactgtgcccagccacttaattcacctcttatacgatagcatggtataaaaggaaaaatccaattatttggaacttctagttctgtttgggttaatttttatktttgttttaagtgctttacattcttccttgttttttagggagacattagagaagcaagtattttctctctggaggcagaagatgtttcagcatcgagaaaaccgcctggcagagagaatggtaaatggctgtccctgaggagatgtgtggaggggcaggatctgattcaagccattgcactcacggcctcccctcctcaggaagttgctcggacctcactggagggcccctgcctgtgactgttgaggcagggcaggctctggggcatctgtcctttctcagtggagcctacagacagcttctgggctggaccacgtcctgacatccattccttttgccttagtcattatttgtggcctgtaaattctttcctggcttctgtgcctctctcctacttgatttattctgttctctccttcctgtcctgcctcaggccatccttcacgcagagcracagcttctgtataggtcttggttcatgtggcaccagcaggcagcagcacgtcaccaggagcaggagtggcaaacagtggcctgtgcccaccaccgccacgggcggctcaagaaagctttctgcctytggagggaaagtgcccaagggctcagaacagagtgagtggccagttctgccttacaagcctttccatcmcaggccagctttgcttgttctagcagcaccatgagctccaagtgcctgtctggaggactgcattaccccagactctggttgtaagttctggaagttcaacctaaaagagtcttaagtaaaactaggttggccgggcacagtggctcacgcctgtaatcccagcactttgggaggctgaggcgggcagatcaccagaggtcaggagttcgagaccagcctgaccaacatggagaaaaccctctctattaataatacaaaaattagccaggcgtggtggcgcaagcatgtaatcccagttactcaggagagtgaagcacgnaaattggcatgaacccgggaagtgaaggttgcagtgaaccgagatggcaccgctacactccagcctgtgcaacagagcgagactctgcctcaaacnaacaaaagtgaccatagccagggaataaactgatgggcccatattgtgatagctgactgctgcagataagggatagggacagcagctgtggccagtgggtgggttgtggcagtttttaaccacaccacgtagttaagagagaggaggggaggcagcccagtcactatagagactgtcctgctttggggcctttcagtgtccactgtgtgttctgaggatctcactccctgtcgcacactgaccatgtttaacyagtttctcagttgggggcttcacacctgcacatgtgagcttcaatggcacctgaagccctgggaagttgtaggccaaaatttgatcataggtgcttttttctgagactgcaagttctttggcagctcttcagagagggtcttkgctcccccaaaaacttaaccaggtagggctatggactatgaggaggaacccatagagggtgccctcactgggtgggggctgcagcactgagctctgccatctmcccacaggaggacgggcagggtgcgggcagcagaattccacatggcccagctcctgcgttgggcctggagccagtggagggaggtaaggctttggtgcgaggtgccacccgtgtatyacttttsgacaggtgggctgtgtgtcagcaggactcacaggcaacatatgggccacaccacctacctctgagctgaaggaggagaacaggcagcatagaaagtgttaactcagttttatgagctgatttggctcaaaattttgtgttctttcagatcctaggctgttcttatttgaacttactgcatctaaaattcctgatctaaccatttacaggagtcctacgtcctactgagtgtaaaacatgtttaaactcacattaattgagcttttaccgcaaatcaagcacttacctcatcaaatcatcacagaacccctaagaagcacgtatttatagatgaggccagagaggttaatttacactcacacagatgatgtataaaatggaggcaaagcaggaagccacccccaactcagaccccagcccacggtrgctgctttctcctctgtctgcagtgcctggccctgcggggagcggagcggcagaagctgatgcgagcagacctgcaccaccagcacagcgtgctscacagggcgctgcaggcatgggtggtaggaactgctgcttccctcctgatcttgctgtggggacaggggaggtttctggagactttgttttccttccttgttcttcctgtccgtcccagaacagagtcacgtgacacacctcaaaccaagcaggtgccccggacagcgggccttaggccatagggttctttgattcttgcttggccaagtggaaacaagtgctgtctgtgggtactagccttgtagcgaaagcagctcctttccctggagtcccatggtttgacttaggaggtgagggcctgtgagacagtttctccctgtcgtctgggagggtctgctggccctgggaccaggggctgttggcctcttcctaccctttttgagttctctgggcatggcagccttgtggtagatgcacctctgaggcctgcctaaacagggggaagtgtgggcccaagagcagcctcagtcttccttgtcccctacagacttaccagggcagggtncgaagcatcctccgggaggtggcagccagggagagccagcacaacaggcagctgctgyggtgagtctcccgggcgcctcccaagctccagctggggaacaaggaatgcactccaaaccccagccttttagggggtcctgctgagggccaggtcggggatgatccngggttcctagtcnctaatatcatggtcttggcttttccacttcactcacgggttcgccttcatgtcttaagcccctgctgtgtgcagggcaggaccttggaaagcagctgttacctgcatgccttaaaggccacttgtcttgctcttctgagcactttttcctccctgcttcacgcctacaaaattcagctttgcaaggcaccttgtcatctcttccactccagaggcttcagcgactccctttcctgtcaatttccaagtagtccccttccagcttgctctgcaggcctgtcactgactctccagcgtcacctctaggccctgtcagaccatctgcaccactcacccctgtggagggtgcttctgcagcttctgccactctttctaagcccaactctaacctcactccttcccagcagtcctcccacatgccccctttcatttccttcctttgtatttgttcagcacatgatactcctggtggcctatggacagtgggtctcgtggactttaaacacctccatccttagctgggcgcggtggctcatgcctgtaatcccagcactttaggaggctgtttgacaccaggagtttcagaccagcctgggcaacatagcgagaccttgtctgtactaaatataaaaaaaattagctaggcacggtcatgtatgcctgtggttcaggtacttgggaggcttaggtgggagggtcacttgaaccttgaaggtcaaggccacagtgagccgtgattatgccactgcactccagcctgggcgatggagtgagaccctgtctctnaaaagtaaataaataaaataaatgcctccatccctcatatggagtcccatagagcacccatcccgctcttcagacagggtggaataagcaagaactccctgagctaactcagcagcaagctgaggcgtaggcaaccttcctccaggttccctgtctctccacacttctcttatcacagtgtgagtcacctgtgttgccactgcctggttatgccctgttatccccgtagcacctggagtttggtctccagcagtgctgggtccctcatgcactcttggtgcccagcccagagcagctgctcagtagccatttgttggacatagatgtgcaagtaaacataggtgttggtgaaacagacattcttaggtgtagagtccctgactcaggagtaggggaagaagtaggaatgattcacagaagcctcccttctctctctatcctggtgtcatctgccttccncgcacccatgcatctgcagcggggcattacgtcgctggaaagagaacaccatggccsgagtggatgaagccaaaaaaacctttcaagcaagtactcattacagaaggaccatatgttccaaggtgaggtataaggaggcaagctggtcacccaggagagttgggactgtgttctggtgagggcgtgggatgtagggggtggtgccagagatttgaactgaataaggaacctagaaaatgggtaactttcctccagcacacacacaaacatccatgtgggcacatgtttagttttttactgaattacaaaccaatatgcattaaatagaaacataacacatcataagtgaactagttcttatcagaaccagtattttctttttttctttttttttttttttttttttttgagacagtctcactctgtcacccaggctagagtgcagtggtatcatctcagctcactgcaacctccatcccccaggttcaagcgatttctcctgcctcaacctcccgagtagctgggactacaggcttgcgccaccacgtccgactaatttttgtatttttagtagagatggggtttcaccacattggctaggctggtcttgaactgatgacctcaggtgatccatctgcctcagcctcccaaagtgctgggattacaggctctttgaatccaggaggtggaggttgcagtgagccgaattgcaccactgcactccagcctggacaacagagcaaggttgtctcaaaaaaaagaaaagaaaagaaaaaatacccgaagctagcctgtgcctcccttcccctggaagaaggaacacaggaatctttgcttggcttcagagcttgaagaggaggcctttttggtgggaatggagttcatgacagctcgcagagcaggcaccaggcattccctgggcaagtgttttgttattgtgattttgtaggcatcactcatacaaaagaatgtatacgacgtaggtgtgttccatttactaaatagtaatagaggccgggcgcagtggctcacacctgtaatcccagcactttaggagactgagtcgggtggatcacttggggtcaggagttcgagaccaacctggccaacatggtgaaactccgtctctactaaaaatacagaaattagctgggtgtggtggtgcatgcctgtaatcccagctactcagaaggctgaggcaggagaatcgctagaacctgggaggcagaggttgcagtgaaccgagatcatgccactgcactccagcccaggtgacagagcgagactatgtctcaaaaaaaaaattacatatatatattttatatatatataaaaatagaattaagacccatgtatataatgacttcactactttatggcatggtatgatatgtaaatcctggtagaagagtcccagcagctgaaatgctgggcttcctgtgaggggctggggccctgtcctattgctcagtggtctgcgtgcaaggcagttacttcctggaccgtgtgtgagaagcaaatggcaacagcttggccttgcctctccaggagccaccgtcacagacctggggtggaccyggaagccaggaggtatagtgactcttgctgtgctccttgcctgcccataggtcctggtscagtggcgggaagctgtgtcagtgcagatgtattaccgacagcaggaggactgtgccatctgggaggcccagaaggtgctggacaggggtaagtggggccccagaagcaagtcatgttgaggaatgtgaagacagcgctgttgtggagatccctgtggcccgcataagtctgtctcctcctcatacatgccagttccctgtggttgccatgacaaagtaccacagactgggagtcttcaaacaacacaaaattgccctctcagttctggaggctggcagtcagcgatcaaggtgtggcagggccatgcttctccacaggctctaggggagggtccttccttgcctctcccagcttgtttcttgcttgtcatggctttcctggacgtgtagacccattgctccagtctttgccccatcttgacatatcgttcccttcctgtgtctgggtcccttagaaggactctggtcatatcggatgaagggcccaccctacttgagtgtgacaccatcctaaccaattacatctgcagtgagcctagtgccagataaaagtcacattgtgaggttccaggaaggacatgaatacggcaggtgtggagggggcactgttcagtccagtatatcttagaaatctattcccaactgactgccaaccagtttatgttaaaatggaaggctagagcttgagatctacagagaaataaagaaaagaagctggaatggaggagcttggggtggttggggagggggttgttttgatgggaaagtccttgctgcttgtcagggcagcccccaccgtgttagcgtcctgcttccttgtgtagctgggcccttaaatgtttaggggccagagactttctaattcgatctcaggaagtcctgctgcctgctgtatatacatctttggaaagattgcagggcacagtggtacacacctatagtcccagctacttgggagcctgaggtgggaggatcacttgagcccaagagctggaggctgcaatgaactatgatcacaccactgcactccagcttgggtgacagaatgagacccagtctctctcttttttgagacagagtctcactctgtctcccaggctggagtgcagtggtgcgatctcggctcactgcaacctccacctcttggggttcaagcgaatctcctgcctcagcctccagagtagcggggactacaggtgtgtgccaccacgccaggctaattttttgtattcttagtagagacaggatttcaccgtgttagctgggatggtctcgatctcctcacctcgtgatccgtccgtctcggcctcccaaagtgctgggattacaggcgtgagccactacacctggccaagacctagtctcttttaaaaaatctttggaaagatagtctagaacaggagtccatgcccctgcttgcaagatgcacagacacgcggcagacccatggggagctgtctcctaacacagctaggggtcccatagtaggagaatctgacacgctgaaggggacagctcatttttagaataaatgaaaatacaaataaaagtgaaaacatttagaaattgtttaaattggcccatagagaaattgaccaagtggttaagttggtttaatagagtttgctccaggacaaaactgaatcagctttggtttggttcngactgtagcgtgtgtgttaatgagcatgtttcaacacacatcctggggacaaaaccctggggtcagccatcccacacggctgcattactgcgccacgaatgtgctgctgggtcctggagcttctcctcagctcagaaaccagcactgtgtttctagtttacgaagaaagaagccgagggctttagccagaccttgggctctggagcttctgcacctgaccctttgggcacctgaccgtgcagcttcaagctccagaggcttttggccagtttgggtcagctgccttaagggtcaggtgcccactcctggccatggtgggaagttagaggcgacgggtttgagtgttgccggaagccgctgctctctgaaggactttccttagagggaggcggtggcaggcttgggttgccacgtccattacagatggtatgagaggcttgggagactgggctgcaagacagtgtacacgtagtaggtacacagtaaatacctggggaacaattgactggcttgtattaaggcctcagtgtctcaggcacaccttggcaggccaagggtgggactgggaggagggactgaggggaggatgtcacaagacccattatgcagagtgctgaagaagtacaggctggcggtcataacctggctgtgtgtgtgacctccagcaggccccctctctgagtctcaatgtcttcatctgtaagatggggataacagtgcctacctcttggggttgtcgtggagatcaagtgagatgacaggtagagagatacacacttaggacagagcccaggcatcagcatgcagcactaaygtgggtgcctcccacttgtgatctgccgccttccctgcctgcctcagtgggcctggagggctcctcatcttggcatctgtgccctgctctcaaccctgttctgttgtctcaaaaagaaagttctctcagggcctaagaaggattcaccaaagggagaatctggtgacacaaaaacaaaatgcaggatgtggcccattcctgcagaacccagggagccagagggcatggcctggcgaccagcgctgtcctccccatccgtggcttgggctgctctgactgctgtgactgggccttggtttccaccctggcaaaacaggctgccctctcttccaagctgcagctgaagtgggggctcctcctcctcccccctcagactgagggtcttcttccacgtgcccagcagcattttgcacgtgactcttagggtgcccctggcacccctgtggaggctgtggacaggcttgtggctctcagagggctgttggggagcacaacagtaaacagatctggttccagtccccggggggttcactgttggcaaaggtggccagagctgtccctagagaggggccatggtccatgtgtggtagtttcaccatgtgggctggacacctgaactctatccctgcacagccatctctgctgtctgcaccttcaccattatgtagtcactggtggaaatcccacaaaacagcaaactctgacttggatctgccttaggctgtctgcggacctggtttcagcrctggtgggactgcagccggaggtcagcccagcagagactgcagctggagagggcagtgcaacaccaccaccggcagctgctgctggaggggctggcccggtggaagacgcwccatctgcagtgtgtcaggaagagggtgaggctgacggtggcaactctccaagttctgcctgcctggcaaggggtgtccaggccaggagaccatttctcaggaaggggtctttcctgacagcactccatgcagccrgtatgagtggtgggtggtttggggtcctgtaagacaaagctgcaggagcctttctgggcgtttggtggagcctagcgagtagccagccccagaatccagtgtctcccagggaagacggctcagcggaaaaacccggttcatgctgacccgtggcttatcagtgctgggggacctacagagtgagtcctctaggcggcactccctgcctatgcaggagacccctggcaccatccaggactcctagcaatgggaggacattcagctgggcagaggctgggttagatcaggacccaccccaggctgtctaggctgggtcaggacgccactctctgtgcacttgctctcccccagctcctgcacaggcagagcacccaactgctggcacagagactcagccggacctgcttccgccagtggagacaacaggtgggaacccaggagatgtcccctctgcacttccttctccatcctctggcctgtgaggcctgggcagtgaatgaccttcagcctacacctctagttcagtatttttactatcaccctccccagggccacctcctctaccaccttcctgtcatttccaggcacatcagcttccttccgtctgcagtctgcataagaacagttacttcaaggccagtttctctctctacagtgttgtattaaaaaatacatcagtggaggccgggcgcagtggctcacgcctgtaatcccagcactttgggaggccgaggcaggcggatcatgaggtcaggagatcgagaccatcctggctaacacggtgaaaccccgtctctactaaaaatacaaaaaaaatcagccaggcgtggtggtgggcgcctgtagtcccagctactcgggaggctgaggcaggagaatggcgtgaacctgggaggcagagcttgcagtgagctgagatagcaccactgcactccagcccgggcaacagagcgagactctgtctaaaaaaaaaaaaaaaaaaawatatatatatatatatatatatatatataatcagtgggccgggcatgatggctcacgcctataatcccaggattttgggaggccgaggcaggaggatcacttgagcccagaagttcaagaccagcctgggcaacatagtgagaccccatctctacaaaaacaaaacagaaaaattagctgggtgtaggcagtgcacacctgtggtcccaactactcgggaggctgaggcgggaggattgcttgagcccgggaggtcaaggttgcagtgagctgtgatcatgccactgcacttcagcctggatgagagtgagattccatctcaaaaagaaaaatcagcataatatcttaaaaattaacatgaaatgtgttttaaggctttgctgggatcttgctttttaaaaagccaagagggatcacacagagcagcatccacacgtccccagctccctcttcccgttctgttgtcctgttttcaccattccccggacctcaggccgctgcctccacgcatccccctgcaggagccctttgccaccttctttcatgaaggtcattcctcaggccacagatggagcgtgtgttgagcatctcaccgccaggcacaaggctggcccttcctagtggaggaagtgggagcctcgactagagagggagccaagagggacgagctgggcagggccccgtgatcaccacggcctccttgaaggggctatagggaaatgatctggtctttctggccctagctggcagccaggaggcaggagcagcgggcgacagtgcgggccctgtggttctgggccttctcgctgcaggcaaaggtaattggggctctgcatcctaccatccctgcctctccctcaggccttagccctgccttgggtggagggagggcacctggtctgtgggggagctctaagcagggagacctgggcctcacctcctgycctccctggaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggccttgtcacagctgagctgctgggaaccccctcttctccagccagatcccatccctcccacggcaagagggagagaatggagtgggatttccaaaccctctctcctttgcctgccaaagctcaggaaataggtgtcccctcctctgcaacaccttcctaccctctctcccgtcctgctgacacgatcttttccggagtcatacacgtagttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcggaactgctgggagctctatggcccaggcccaccccagcttacttgctgaccttggcctcgcctttcctgactttcagtctccctataaaattggagatcccacagagatctcagacccccctgcagcccctggtcagcccargggaacagaccccatgtttctttccagcaacactgcccactcagcgaggaagcagccgcgacgcccacacttcctgttggagcctgcgcagagccagaggtccctggggtgcagcaccgtgggcaggcagggggagatggtcaggggtccccaaaggcagcgggcacctccatgtggggcctgtgttttggcagccctggggtgggtggccccctttccttcttgttctttggtcccagaggagggtcctgtggcctgaccaggctcttgccttccctgtgctcaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacrgcaagcacaggcccggagctgctgctgctgcctcyttcctccttcatgccctgcggggcggctgcaccagccagggtacgtcctccaccaccaggcctgggcactggggctctcactctggtctgacttctggtgctttctcatgccacagctgtactagtttctggaaaaccttggcacagggaggccactcatccatttgacaagcataggtagccactgcacaccaggtccaagggccacagcagtgaacagccagccaagggccctgccatcctgaagcttatattctagtcagagacaagcaaagaaaaacccctgcctgcaggccagtaaagtggctgcagatcacgtagggtcctgcaggccacagtgagaagtagcctgggatttgagaagagtaggaagtcggggaagggttttggcagggagcaccatgtcaggtttctgtgcaggctgtggtcaccatgaccacgtggtccaggcaagtagtactggtggcctgggctcagcggttgccacagaggggacaggtactctcttggaggcagatgaggcaggatatgctgctctgagggagttgctgaatgaggggaaagaaggaatccaggctgatgtgggctgctggcttgaataacttgggaaacagagttctttgactggaagaaggaactgggggtggggactggtttggggtgaagtgtcaagagtgttttgaaccaggctcttgatgtcaaayttgagagaaagcaaacgttgagtctgaccttcaaggaagaggtcagggccagagattgagaagaatcttcagcacaggccgaaggtaaccccagagccactgcggcctctaggaggagagtacaggggaaggagagaggggaggaggctccaagcagggagcctgggtggggatggccagggggtgtgagagctcagtaatggaagtgacagctgctctaaggccaccaaagcagctggttcctgaaaggggatgaggggacaggaaggaaccagttcctgtggtgagttaggccatgtggggccacttaccctggctggaatggtttgaatgtgggtttgaaagggttttgacccctgtccggtgatggaaggggcaagtccactctcaccaggagaggagggcatggaaaaggctgtagagcagtggcctctcactgaccacttctcactgatgtcaaagctcagcaaggtcatgagcttagagcaggtgggggtggagggttgggtaaggcaaggctaggaacagctgctcaggcagtggaggcgtgaggcggactgtggtgacacggggtgctccctggttgcttgcgggactttcccctacagtaccaggccctgtgtgcaggggcaggctagacactgagctggcacggccagtgcctgggaagcccagctcctgcagctgggagcctggtcttccccnacccctgcagggcaggcagtgacraggacttggtgtccccctccctggcttcctcctagcttccttgctcagcatctacccttctttcctttgcaggtgtcagcacagcgggctactcctagggataagcccccggtcccctcatccctggccagtgtccctgacccccatctactccttcctggggacttctcagccaccagggctgggcctggactttcaactgcaggtgtgtacctggggcctgtcagggcagaaagcactcaggccactcccggacctgggacttgctatttaccctggtccccgaggggaaaatagtctgaaacaagcttacttctgtcgccataggcagcctggaccttgaggctgaacttgaggagatccagcagcaactactgcactaccagaccaccaagcagaacctctggtgagccctgcgaaacgccctgcagccctggctacaggagcaggtgttgcctggagaggtgggcaggcagttccatttcccccgagccagctgccagggtcctgtaggtggtctcggtctagccatggaggggtgtggggagccctcagtgtgtgctgtccagaaagaccccatctccaccatggctctctacccggctcrgtgctgcttaggaaggcccaagtcgtcagactcacctgtgcacagaggctctgcttcctatgggggggacgataaagttgagcaaaactctaaaaacccgatgaggccatgctgtccccagtgactaattataacactgatattaaaggtgcagagaagggccaggcgcagtgactcacacctgtcatcccagcactttgagaggctgtgatccaggcagatcacggggttaggagttcaagaccagcctggccaatatggtgaaaccccatctctactaaaaatacaaaaattagccgggcatggtggtgcacgcatgtagtcccaactacttggaaggctgaggcagaagaatcgcttcaacctgggaggcggaggttgcagtgagctgagatcacgccattgcactccagcctgggcaacacagcaacactccatctcaaaaaaaaaaaaaaatgcagaggagacaggcccgtgactcagctgcactcagtggtctggggaccattcaacatgcagcaacctcagagcttccagggcaacagactggcgcctcatccttggctctgcacagggggagagagacaaggagtgtgttcttgcccaggcccacctgagttgctgtctgctggggagggcggaggagactgggagaggaaaaagaacaagtgtttggctcccaagcaggggcctgcagttcaggtcaggggccctaccagaccacctctctccacccgatacccgcatcagaattagctgaggtgcctctccctgagccggatggggctctgccaaggacccagcctggcaggcagtgggtatctccacccctcaggtcctgtcggcggcaagcgagcagcctgcgcaggtggctggagctgaacagagaggagccrgggcctgaggaccaggaagtagagcagcaggtgcagaaagagctggaacaggtgaggccccaggccatccccaggtgtccctggggacrccccgggctgtgctccctctcagccctgcctgtccctccatggccccaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactrtgctactgatacagttgaaaaaattcaatgatgtctctcctgcaggagaaattcacagcatccccagggtcaacatgaaatctggccctgtccccgccactgggggctccccaggcctgcgttcctgataaactgggacaggttttccaggcactgaccaactatccaccaagggtcctctgcctccaagacagaccctgaatcaatagcagcaactttcccatatttcatgtagggatatgtggagggggacaggaactctcccatttccccagctgggcctactacctgcctgccctgttcactctggtgccatgaggcaggttcagtgattgattggtcttgcctgctgcagaggacctggccagctccagaagggtcactcatcaggtcctgcaaaggtctgtatcattaatcagtgtcatcagtgtcctcagaagacactagcagagtccagggtgatgcgttcagccacaagcacaaaractgctttttctaaagagcaggatgaggtgaatgtgggaacggaaagcagttgtcacgaaggctgtgtggctctgctgggggagaggcatccacagtctgtgccaaggaggcacctcaccctgtgcagcaggagcgttaaggccaaaaaacaaaaggggccaacagaaaacagctcaggtgatggggggaggagcagcaagaaaaaacgacaaccgagaccaactgaaggttcggtcaggaatgcaggctcttccgtctatacagtgtttaaaaagatccaaatgtgactgagatcattccagcctgcactttttatttgtaggcagaaggaacgggataggttgaggggcatgatgggggctctcgccacctcttgtctgcacctctggaacaggtggtagccgaatcattcaagtcctacctggtcagactcccaaccacgctgaggcaggcccttacctggatggcctcatgggcctccctcttgaaaagaccctcactctgtttggaaaagatcccttagcagccataatcaggaaagagactctagagcgagcccagggcttccccaaagcggattttctgtcctgttttcagctggaaattgaagtccttgggggcctcgaagatgagcacgatggtggagcccaggttgaactcgcccaggtgctcgcccttacgcatggggacgccctctctattggtgtgcgtcacgaagctgaagtcattgtaggagcccttgctgtgccttgggctgtttgtgtgcaggtcctgtggtgataggctgggggtcagtggggcccaggccaccaagtgcacagtgtcacccccacatgtgtttggagtcccactccctctgttgcttgtccccaccaccacccaacccagctccaaaagggaggtggggatggcatctcagggccaggtgggcctgctctagccagatctcacacacagccttgacacctgctgtgaactgggcccagggaggacagggaacagtggggcccagtggtctccatgcatggtgctgggagagcagcacccgtgggagccaaggccgttggtcacaaactgacacccaaaaaggcagcccctgggggcagggtgggcagcagacctgcgagtgctgacccctcatgctgtaaccaacatgagccaccccgagctcaacactccctttctgttccctcctcactctcacctttgaccatggttcctagcagaagccaggtgccaggcaaggaggttaattccctccatctcttccagccacttccagccagcagtgcaaggagggagggaagcctcagctggctggcaggtggagcggccattctcaggacagctgctcagcagagccaggcctgaccagagctgtggcctccctagaattcagtcccaacgcatccgccgcacagcagacaaggcaggtagacccaagaggtctggcccttgggctttggcagggcctagatcctgcttacccggtcaaagtagatgcgaatggagcccacgttggtggcccccacagctgtcagtgagaagaagccatgtttccagtcccccgtcaggaccacccgctcgttatggcagaagagctctttgatccagcgagccatgccagggttcactgacatcagggagcctgcagaggcagggaatgccgctactccccgtccagagcccggtgtgtccaccccatggcagccaagacccaaagggactcatggcctgttgccccgatgtcactccaaatgctgagctgactgggccccacggtcccctgcccacaaccagcctgcataaagcagtcaactcctggcctcaatgaccctgatctggagcctggtcccccaacaccaagaagctgagagcctctatatgaagcccacagaggcagctccccccacgctggccccgggctgacctgggaagtggcgccggtgggacacagtccagtcggtgggggagtggaagcagtggtagtccccaggggccaggtagatgacacagtgatagagctcattcccttcccgggtgaccagctggttcttgaaggagtcacacgacgcggctgtggagtaggagcagacgtgggggccaccaacacagtgagcacccagcacggagcccgagtgtggtctgcacatggattctcagggaggccccacatgccagcctcagttccttccccagcattcccctccctcccggtccagccacacagcagcagggctgcctagccccgcctgtgcagtgacccacctggtgggaagggcaggtcctctgtgcacatacgcgggcccaggaacgactccagggagtaggtgaccccctttacctgctccacctcacagttcttcacctgcccaaagttgaggatccttccatccgatgggctaatctggaagggcaggagaggcttgctgccagggagagcagggtctcctccccccaggagacagcccccacctccccttgtcatcctgccccttccagatacgctggagaccaggggggctgtgctggggaggcaggaaaaagtcctgtttcctgcaggaggaaagggtcaggcctcaccacgctgtgcaggccacagacaggccgggcctgcggcttcagcttgcgccggaagaactcgctgaggttgcggtagtgatgcaggtcctccacagcggcctctttcatgttcaccccaaacgtccagatgtacaggctgtagacgggcctgcgcagccagtgtggcagctccacctgattgaggcgaccccaggcccgtgacagcaagcgcgttggcactgacttgtacaaagccacctgcaggccacagggcaaggggctgagttgaccacactgccccagctccagagagcccaagtagtgtcattagcccagctctcacttcaggggagaatctgcaccccacggaggacaccagggcccaggtgccccacgctgcttttgtgatgtggctgtttctcactgggaaccagactgcacctgccacacggagtgctggatttacatacaactccagtggatttcatcatttcatgcaaaagtcaaatagcaactgctccagtcccagaacgggagacgcccagcagtcttacttcttaaagtgggggtcggaaacggatctgatcctaaccacagtgtgtgaccctagccacggtgaccccaatatcacagtgtgtggagaggtggtgggcatcttgcccgtggtcactgcccatatcccagaccaccaaaggaggaggctcccaagtgcatggaacaagtctacagcccaaagtgtgtccctctgtcttaacaggaagaaggaggataccctgagcaccaacagggattttcagatgcaggtctgcgatgtcactgtcacctgggcctgagctgcagacacagggtctgcagcccccacaggtccagccagcactcttgagggcctggatgcagccagtctgagaagcccagccctgctgagccccaccttggccccacggcaggacttgtgttcaacgttctactgtgactgagccaggccataaagccatctgcacctggggttcctcccaggaggcaaagagaagtcatcccctcaggcccctctgttctctcttccttcagggaagcctggagcacctaagacagacgatggcctggggacaagcactgggtcccactagatggtcccagagctctccggcagggccaggtacccaggaaggggcagcctcttaaacttcaggtgctgctgccactgtagaagctgcctgtaattggtggctgctgcttctctaaacacaaccaagacaccaactccccaaggtgtaaaactgatttcattccaactttcaacacctctccaaggtaaggtaagctcccagagagctgctcttatcccttccagctgatgcccagtcacacagaagggctatgtgagcccaggcccttcccaggcacaggtgggagcctgggctaatgtccagggtgcctcagtgcccctgagctctgatgacacccatgtgactgtcaaaggcccaggaacagggtttcctccttggggtcaacctgcctgggaagccaagggcaagagcaagccctctagggaccaggagaggacaagccagttcccttgcccattcctggggcatgcctctgggttccttaagggtgtcctcaccctaagggacccaaacaggatccatccatcctgaaccacccctttggcatcccggaattaatttggcttctgttcaaaatcacctataagctcttttttgcttgaacacagaaaaatcagagacagacaccattttctgaatccccagactgggttccttccagaaccagagccccaaatggcagacatgaggcaggctaggggagtgggcagggcacgacatgccctcgcagtcacccgcggcccaggtagtggccttctcaaaagctgccttggccttgcccaccaatgaaccttccgacccggaccccctgaagatgtagcggtgacctctgcttctgacagctcgccaccacctcagtctctcctgcaccccaacctcaggcctgcccggaagggaggtccgagccacaggggcctgtgcacacttaccctgcttacgggcctccatcccacccggctgagcggtctgagggcgccgaagggcaggaggtagtagaggacggtcaagggccaggagcgcagtttcagagcgggtctggacatgcagctcagctgccccagcctccgcctcagggccagctgggggaagtgcaacctgcagggcacaggtccatgcacagccaggtcagtggccaggctctgggcaggacccaggaggctgccacctgcacccagggcaggattcctcctgtctacccacccttggcaagctgcctctccatgggggtgatggagcccagcaagcactggctgtgccccctcgtcccaaccccattctgattcaggggcttggctgcctctggctagcggactcatttcccaggctctcccacccgccagccagctggggaggactgggaatgtgggggcagccgcaagaggagagtcaggcccagctgcggggcacctctcagctgcagcagctcccagcaagggcctccaggcccaagcacctgggcccaggaaggggagagcagggtgtagggcctgcctcacatccctcagcctccgcagcccaggagagtgggccccaggggccagctctgccacacaggcactggcacggcagcacatagcgctgaggagctacgacccagccagctgggtaaccatttgctgagtcttccgctaccatcctttgcaggatctgggatatccttttcatggttccaggccccccctttcctcatctgctaaattacggggccaaggccagacaagatctcaaagggagcatttacactccgcctaccaccaccacacagctacggctccatccatctgcatggtctttctataacaggccaggttctgaaaacccatccacaggtttgtgaacaaaacctccccaccacaagctctcaagccacctgtctgctctgctggggctgcacagacagacagacacacacacacacacacacacccatcccaagcccctcctttcagcaaaggtggacacacacacacacacacacacacacacacacacacacacacacgaaacccaagcccctcctttctgcatccagcctctctgtgatccggcctctccccaccctcccagcacaaatgcagggcactcagcaggggctcagcttcaccagagccgcagaggctggacgggcctttccaccacaaccctggcctcctgcgcctaaacaaggcccaccccaccctgtctgtgcctaggcctagcaaatgctcctgaggcccagggtagccagcaggagaccacactgccatccactcagaacgtccccaggtctcagtttcctcatctgcaaagtaactgcatttagctaatctacggctgccatctgggactgtgctctcaagagaagctgagtcctctctcccagttgctgagcaaaccaaggaacaaagcagcatctcagc

SEQ ID NO: 10656 - DNA, 55759 bp, Homo sapiens
  misc_feature (1)...(55759): n = A,T,C or G, or insertion/deletion polymorphism (see Tables 1-2)
cttcctgtgtgctgcacacaaataatgttgcaaaccctcattataacactataaattgggtgcatcacccaggctggagtgcagtggcatgatcgtggctcactgcagcctcgatttcctgagctcgggtgatcctcccacctcagcctcccaagtaactgggactacaggtatgcaccatgatgctgggctaatttttctatttgttgtagagatggagtttcaccattttctcaaactccttggctcaagtgatcctcctgcctgagcctcccagagagctgggattactagcttgagatggaacaaggtaaactggtttccacagtggctgcaccattttacattctcatcagcaatgtacaaggattccagtttttcccacatcctctccaatgcttgtcatcttcctttttttttttttttttttggagatggagtcttgctctgtcacccaggctggagagcagtggygcaatctcagctcactgcaacctccgccttctgggttcaagtgattctacggcctcagccacctgagtaactggtattacagttactcggctcactgcaacctctgcctcccaggttcaagcgattctcttgcctcagcctcttgagtagctgatattacagttactcggctcactgcaacctccgcctcccaggttcaagcgattctcttgcctcagcctcctgagtagctgggagtacaggcatgcaccaccacacccagctaatttttgtatttttactagagacagggttttaccatattggccaggcaatctcgaactcctgacctcatgatccgccctccttggcctctcaaaatgctgggattacaggtgtgagccaccgagcccagcccgaccagctaattttgtctctactaaaaagtagagacagggtttcaccatgttggcctggctggtcttgaactcctgacctcaggtgatccacccaccttggccttccaaagtgttgggattacaggtgtgagccactgtgcccagcctaaaatcaaccattttaaagtggacaattcagtgacatttagtacattcacaacgtggtgtaccatttctgtctaattcaggacaaattttatcatctcaaaataaaaccttgttgtgcctatcaggtagttaccaatgtttcccaattttaacagattaagaaatggactaagacaataggaaaagtgctggctgggagccatggctcacacttgtaatcccaactttttgggaggtcgaggtaagaggattacttgagcctaagagttggagaccagcctgggtaacatagtgagaccctcatctctataaaaaatacaaaataagctgagtgtggtggtgtgcacccgtaatcccagctactcgggaggctgaggtgggaggattgcttgagcctgggaggtccaggttgcagtgagccatgattgtgccactgcactctagcctgggtgtcagagcaatatcctgtctcaaaaaaaaaaaaaaaaaaaaagaaaaagaaaaagaaaaaaagtgctaaggacccacaacaaaatttttaatattaaaattaaaaaatgaggctgggtgcgatggctcatgcctgtaatcccaacacttcgggaggccgaggcaggaggatcacttgagcccccgaatttgggatcagcctggccaacatgacgaaaccctgtctctctaaacaaaaatacaaaatttagccaggcgtggtggccagtgcttgtaattgaaggcactggagaggctgaggcaagagaatcgtttgaacccggtaggcggagattgcagtgagccgatatcgcgggccactgcactccagcctgggccacagagtgaaactctgtctcaaaggaaaaaaaggaaaagaatataataataatgaattcagcttggatttataaatataaatgtgttaatataaagacaatagtctttataccaatacggttgtaaaataaaattcttaattttttatggagaaaagggtcagtccactgaggcaaaagtgcttggggctcacgaaagcctcgaagctctgccactaccatccacactgcaaaaatcctttgaaaacaaaattgaggcaagctcgttttttttttttttcttgagacggagtctcgctctgtcgcccaggctggagtgcagtggcgctatctcagctcactgcaagctctgccttccgggtttacgccattctcctgcctcagcctccagagtagctgggactacagacgcccgccaccacgtccggctaatttttttgtatttttagtagagacggggtttcaccgtgttagccaggatggtctcgatctcctgccctcgtgatgcgcacgtctccgcctcccaaagtgctgggattacaggcgtgagccaccgcgcccagccaagcaagctcgttcttaaatgctaggctaattctgccccctagcggccacagagaaatctcagaaattaatgcccccagttgttgagtaattcgcacctaccaggtgccttgaacttacgctgcattattttgtcctcacaattccatgaggttaagtgatatccaaatgtatagataagctgccgaagattcgagtgcttaagtcggtttgttgttgtttttttttgagacggggtctcaaaagacaggatcttacggaagttaatgctgtttcctactgaaggaggcacagcgagcgcaagccttggtgggcaggaagcgtgctttaaagtttgagactgtcaggcccggcgcggtggctcacgcctgtaatcctggcactttgggaggccgaggcgggcagacttgaggtcagcaatttgagaccagtccggctaacatgatgaaaacccgtttctactaaaaattcgaaaattagctgggtgtgtggcacgcctgtagtcccagctactcggaaggctgaggcaggagaatcgcttgaacccgggaggtggaggctgcagtgagccgagatcgcatctctgcactccaacctgggcaacagagtgaggctctgtctcaaaaaataaagttggagacttttattctaaaagcattcagtgagccatttatttatttattttcctgtaagcttggaaaaataggttcttccccacccatctacatgacagtaatgagcaaatatccttatcagataatacatgatttgcaaacattttctttcattctgtgggttgccttttctctctctctctcttttttttaaggcagagtttcactcttgttgcccaggctggagtgcaatggtacgatctcggctcaccacaacctccacctcccatattcaagtgattctcttgcctcagcctcccgagtagatgggattacaggcttgcgccaccacatgcggctaatttttgtatttttactacagacagggtttcaccacgttggccaggctagtctccaactcctgatctcaggtgatctgcccgccttggcctcccaaagtgctggggttacaggcgtgagacaccgcgcccagcgtcttttcactctcttgatagtgttctttgatgcacaaaagttttaatttcgaagtatatctttttgttgtttttgttgttgttgcctgtgcttttaacgtcatatacaagaaatcattgctaaatccaacgtcatgaagatttcccctatgttttcgtctaagagtattatagttttagctcttcagtttacatctctgatccattttgaatgaatttttgtatatggtgtaaggctgcactttactttttgtatatggatattcagttttcccaatgcacttcatttggaaataatttccccccattccctgctggtttactactctcaattggatagtaaaaccaattaaaccaatatgtattttttttttaaatggtgtctcactctgtctcccaggctggagtgcaatggcattatctcagctcactgcaacctccccctcccgggttcaagcaattctcgtacctcagcctctggagtagctgggattacaggcaggcgccactatgcccagctaatttttgtatttttaatagagatggggtttcaccatgttggccaggctggtctcgaactcctgacctcaggtgatccgcccgccttggcctcccaaagtgctgggatcatagggtgagccacggtgcccagcctcttaaaaaaaaaaaaaaagagatggagtctcactatgttgtccaggctggtctcttttttacttcctttttttttttttttttttttttgagacggagtctcactctgtcacccaggctggagtgcaatggcgcgatctcggctcgctgcaagtccgcctcccgggttcacgccatcctcctgcctcagcctccagagtagctgggactacaggcgcccgccaccacgcccggctaattttttttgtatttttagtagagatggggtttcatcgtgttagccaggatggtctcaatctcttgacctcgtgatccgcccacctcggcctcccaaagtgctgagattacaggcgtgagccaccgcgcccggcccaggctggtctcaactccttggctcaagctatcctcccacctcagcctcccagtgagtggggattgcaggcgtgagccactgcgcccggccaaaaccaattctatacatttgtttttttcttttccgacttttgaaaaccatgacaaagggaggtttcttccccccaataccaaacctggtgccttttaagctctctgtaggagctgagtatgccctagttgaacttaagccaactacacagaaatacctgcagggaccagggagcatattcctcctcctgtcaaatgcctggtgaaggcaactgtgattatcagcttagcagatgaaaaagtagggctgcattccttcagttgttggacccaaattctgccagattctgacaaagggcttaaaaggaagaatgtttaggccaggtgcggtggctcacgcttgtaatcccagcattttgagaagccgaggcgggcggatcacgaggtcaggagatcgagaccatcctggctaacatggtgaaaccccgtctctacgaaaaatatatataaaaaaattagccgggcgttgtggcgggcgcctgtagtcccagctactcgggaggctgaggcaggagaatggcgtcaacccgggaggcggagcttgcagtgaatcgagatcgcgccactgcactccagcctgggcgacaatgagagactctgtctcaaaaaaaaaaaaaaagaagaagatgtttaggacatggtttttggagtcagagacgtatgttcaaattctggcttcactattttatagtctttgggcatatgccctttatgtacccttgaagatgttgcttaaccttcctgagcctcaggtacctcatctttaaaatggggataatgtctcgggcctagctgcgagtctctagtcagtgctcagtaaaaagtagcagacatgattgaaaactcgttttcctcttacaattgaagataggaaccttttcaagagcaagcaccaggcaccgaatttaacgactggttgcatttctaggtgatccaagaccgtttgcccccggtctccctggcagcacagcggtaggagataagaatgatatgacaccatgcttgcaaagtgctcacaacacactccggcgcttaaaaaacgagagctgagtcatggatgcccagtttccccatccgtaaaatgagcaagttcgatcacttgaaacgacattcttggatcttggatgactcagattttccaggtacatgaggaaaggcacccagagggaaggaggaggagtggcagtgctgcgaccaagcccaggtttagcgaaacctacagctccactagttcccctacctccgcaggtgccaagcgggttaggtggggagtagccacagggcggagcttagtcggctccgcccccaacccgcgcttttctcattggcccactgaactcgagactcgtgacgccttaagcgtgcgcccagcgtgtgaagggggcgtggcacgctgagaaggagcagacaagatggcgacgtccgtggggcaccgatgtctgggattactgcacggggtcgcgccgtggcggagcaggtatagcagcgcggagagactaccttggggcgtggggcaacctggaccaagctggggtctgaagagagatgtttctgtgtcgcgggctcgctctgaggcgagctcgggtggagacggagccaccttcacctcgagcttaggagcaggtgcgactgctcctgcgtagggcggtccggatttacttagggtgtggcctagaagctcgcgctttgccctttccagctaggtggaagttcacgagggacaaaaatcagatgaaataggctacctgcccgtctcttgagtcgaggcagggctttcagatgttcagatgccattttctcgtgtgttcgttttcgtagaaggaatgatgtcctgtgggaaggacactagattgagtgtcaggcaactttcatttctggatcttagtctttgaagctagagggttaggttaggtaatctcaaaacaatatgttatggggctagagtcttggttacccttgtgacccccagctgttagattcttagaaatgtgggagacttgaggggtcttctgagtccagctgtctctctttggagttaatgagattgaggctccgagagagggagggatttgctcaagttcacctagccagtttgtagcagagccnggacccccatcaaggtaccccctcacgcgacgatctttctctcaggctgcccgccgtgagggcagtggttatacagaaaatagcttagagcatttggagtgtcggaaaatggattaaaatgkagctgtgattcagagtcggctgcctggtgtcatttcaaagagctaagatttgagagatgcgccatacttgtgtgtttcctacagggttcattttgtcagcgttgatcagaggataacctattgttttgggaggagacggacactggatttggactgagagggaacagaaaccatcattggtcttgttatgaaagcgtcactctttcatcattaactgtacagaaatgattatctctcaggagagggctctgcattgtggtggtaactgttagaatttgggcaggagactttgttttcaatgttattaccaggcgtgctgtgtatgagtcaaccctgaattcatttaaagtgtgtcacaggctgggcgcggtggctcacgcctgtaacctcagcactttggtaggccaaggtgggtggatcacttgaggtcaggagttcgagaccagcctggccaatgtggtgaaaccctgtctctactaaaaaatacaaaaattagccgggcatggtggcaggcacctgtaatcccagctacttgggaggctgaggcaggagaattgcttgaacctgggaggcggaggttgcaataagccaagactgcgccgctggagtccagcctgggcgacagagtgagactctgtctcaaaaaaattaaaaataaataaagtgtgtcacgaattgaaaggactaaaatgagactcttaaaaaattgttttttgttgttgttatttgttttggaagtcagagcctcactctgttgcccaagagggagtgcagtggtgtgatgatggctcactgcagcctccacctcctggtctcaagcagttcttccacctcagcctcctgagtagctaggaccacaggtgcacgccaccccgcccagctgcattttttttgggggtgggggtggagacagggtttcaccatgttgcccaggctggtgttgaactcctgggctcaagtgatccacccactttcacctctctaagtgctggcattacagaagtgagccatcgcagtccacctaaaataatttttttaaatgatgagaggaggctgtacctcagtcaccatcattaaaagggaaagaaaaaaagctatgttttagtaccagtgtagatagataaggctagacttagatgcagtgggtgagagagatgaagatttgggtacaataagaaaccttaattttcaaaggtattctatatcaagatagaaatgatattaatacacaaaccaaaaagataacatttctgtgggtttttagtaaaccagtgcctatttgtgagacatgtaaatgaaaaccttatatttcaggtaagtttttcaataactgggtgatgtgtgacaggtgatagataacatcttgggtgataatttagggccatgtttcctaaactcatttgataaaagaatgggctgaatgggctgggatgcttgttagaaatagagattccttgggagtctctctgagcctgctgtagtttgggaggctggctgattaaaaaaaacaaagccgggcacggtggcgcatgcctgtaatcccagcactttgggaggccaaggtgggtggatcatgaggtcaggagatcgagaccagcctggccaacatgctgaaaccccgtctctaacaaaaattagccgggtgtggtggcgtgtgtctgtagtcccaactactcaggaggttgaggcaggagaatctcctgaacccgggaggcggaagttgcagtgagccgagatcacgccactggactccagcttcggcaacagagcaagactccgtctcaaaaaaaaaaagattccagatatgcccccatcctactgccaatttcagattcagtagatataagttggggctctggcaactgtagtttttacaggtgattcttaggttcaggcaagtacggacaatagtacctaggaagtagcttctcgtgcatgacttccatcagaaatatttatggcatccctaccactgcaaaccacactgtcaacggaccatagagaagggagaagagagaagggaaggggagcaaatgaagaaattaaaaacatttgaaataggccttgtcttcaaggaactttactatatacttgtaatacatggtggaatacgggataaagccttcaagaggtctgtccgttctgttttaggagaactttcacagctttagaaagcaagggagacataaggactataggcaaaatgttactactaggggtgatgttaaaaatgtcttaggcctgggcgtggtgtctcatgcctgtaatcccagcattttgggaggctaaggcgggtggattgcatgagctcaggagttcaagaccagcctgggcaacatggcaaaaacccatctgtacaaaaaacacaaaaattagctggtcatagtggtgcatacatgtagtcccagccacctgggaggctgaggtaggaggattgcctgagcccaggaggttgaggctgcagtgagccaagatcatgccactgcactccagcctgggcaacagagtgagaccctgtctcaaaaaaaaaaaaaaaagaaaaagaaaaaatagtgcaactggccaggtgtggtggcttatgtctgtaatctcaacactttgggaggstgaggcaggagaattgcttgagcccaagagttcgagaccaacctgagcaacatagtgagacctcctctccgcaaaaaatggctgggtgcacatctgtggtcccagctacttgggaagctaaggtgggaggttcacttgtgcccaggaggtcgaggctgcagtgagctgtgatttcaccactgcattccagcctgggtgacagagtgagaccctgtctcaaaaaacaaacaaacaarcaaacaaacttataaccaggatgccatggagacagactagtgagagtgaatgctggtcatagatgattgatatgaccatctcagtgtatgtcagctgaatatcaactcttaataataacartctaactaggtgccaggccctgagctaagrttttgcatgattgtcttctaaygaggtgagttttgtttttgcaggtggagaaactgaggcttaagattagttaagaaatttcctaaggtcacacagctgctaagaagtggcagcgctgagatttgagttgcacaggcagactggagtgctcaattgtgggctttaattgcctacttgaaggatgcgatgtagaatgcatgtagaagagacatctgtttgaacccatccattcatctttctggggcatactgtcactattgagattgaaggccagtgagaacacagataaaccccgtgttcatcgaggtatacatacagtaaacaaataactgaatacatgcagaatccattcattttgtgtaataagaaatgccatgaagaaaaagaaagcaagataattaagaagttagtgctcaacagaaagacaaactttgcatgttctcacttatttgtgggagctgtaaattaaaacggttgaactcatggagatagtagaaggatggttaccagaagctggaaagggtagtggggggatgggaagaaatggggatggttaatgggtatcaaaaaaataaaatgggctgggtgcagtggctcacgcctgtaatcccagcactttggaggcccaggcgggtggatcacctgaggtcaggagttcaacaccagcgtggccaacaaaccctgtcactactaaaactacaaaaaaaaattagccgggtgtggtggtgtgctcctgtaatcccagctactcaggaggctgaggtaggagaattccttgaacctgggagtcagaggttgcagtgagctgagattgcgccattgcactccagcctgggcaacagagcaagatgccatctcaaaaaaatatataaaataaaatgaataagacctagtgtttgctagcacaacagggtgactattgtcaaaaataatttaaaattattacatttaaaaataactaaaaggctgggtgcggtggctcacgcctgtaatcccagcactttgggaggctgaggcgggtggatcacgaggtcaggagttcaagatcagtctggccaagaaggtgaaaccccatctctactaaaaatacaaaaaattagccaggcatggtggtgggtgcctgtaatcccagctactcgggaggctgaggcagagaattgcttgaacccaggaggcggaggttgcggtgagctgagatcatgccactgcactccagcctgggcgacagagcaaaactccatctcaaaaaaacaaaacaaaacactaaaagagtataactggattgtttgtaacacaaagcttaaatgcttgaggggatagatatcccatttacctaatgtgattattccatattgcgtgcctgtatcaaactagctcatgtaacacatagatatatatgcctactacatacccagaaaaattttttttaaaaattaagaagttagtgttcaagagggccaactcttgggcatacagtgctcaggaaaaactgcactgaggaggtaacatttgagcagagaactaaatgatgtgggagtgagccacataggagaggggtgtgcccagcatagcaaacagcaaatggaggagtgtggaaaggggcacatgtggtgtggacaaggagcggcaagaggagtgagtgaggaggaagagagggaaagtagctagagatctgagaggctgacaagatgtgggatcttgtctttctgttttgtttatttatttatttatttatttatttatttatttttgagacgcagtcttgctctgtcacccaggctggagtgcagtgtgcgatctcggctccctgcaacctccgtctcccagattcaagcaattcttctgcctcagcgtcctgagtagctgggactataggcaccgaccaccacacctggctaatttttgtatttttagtagagatggagtttcaccatgttggtcaggccggtctcgaactcctgacctcgtgatctgcccaccttggccttccaacgtgctgggagttctcataggcgtcagccaccatgcccggcctttatttttttgtttttttcagacagagtctcgctctgtcatgcccaggctggagtgcagtggtgtgatcttggctcattgcaacctccacctcctgggttcaagcaattctcctgcctcagtctcccaagtagctgggattataggccaccaccatcacacccgtctaattttttgtatttttagtagagacggggtttcaccatattggctggctagttttttgtatttttagtggagacggggttttaccatattggcgaggctggtctcaaactcccgacctcaggtgatccacctgcctcagcctctcaaagtgctgagattacaggcgtgagccactgagcctggccagtggtagttttcattgccttgccagtggattgaatgtggatgatgagaaagaaaggacttaaaaatgagtcctgggctgggtgcagtggctcatgcctgtaatcccaacactttcggaggccaaggtgggtggatcacttgaggtcaggagttcgagcccagcctggccaacatggcgaaaccctgtctctactaaaaaaacacaaaaattagctgggtgtggtggcttgtgcctgtaatcccagctacttgggaggctgaggcagaagaactgcttgaacccaggaggcggaggttgcagtgagttgagatcacgccactgaactccagcctgggtgacggagcgagactgcatctcaaaaacaaaacaaaacaaaacaaaaacgagtcctggcctggtgcagtggctcatgcctgtaatcccagaactttgggaggctgaggtgggaggatcacttgaatccaggagtttgagaccagcctaggccagatggcaagaccttatttatctccacaaatatttaaaaattagctaagtgtgctggtgcacacctgtagtcctagctactcaggaggctgaggtgagaggatgccttgagcccagaaatttgaggcagcggtgagctatgatcatgccactgcacttgagcctgggcagcaaagcgagaccccatctctgggaaaaaaaaaaaaagggggttgtacctgagtggctggatgaacggtggtacctttttttgacctgttgtgttaattatagtaatgttggtactgtaacagataaactccagcattctcagtggcttaacaccgtagaagtttctcactcttgtaaagctgcattgggtgttcctgattggcagggcagctgttctccaagcaatgttcagggacccagtctcctgccgtcttttttttttttttttttttttttggagatagagtcttgctctgttacccaggctggagtgcaatggcgtgatctcggctcactgcaacctctgcctcccaggttcaagcaattctcctgcctcagcctccccagtagctgggattacaggggcacaccaccacgcccatctaattttttggattttagtagctactgggttttaccgtgttgcccaggctggtctcaaactcctgagctcaggcaattcctccaccttggcctcccaaagtattaggattacaggtgtgagccaccacgcctggccttcctgccatctttaatacttcccacagtcggcatgtttgtctgcatcaagctggctggtgggggtaagcttggaggtgaatgcctgggaagcccgaatgatcctcagatttcattggttcacacttagtctcatggccacaccttgctgcacaggaggctgggaaatttagtctaacaggtgtccagaagaggaagtgcatttggtaaacatctggctagtctctcctatggatagagaactcgggcaggagcagattgaaggtgagttagagagggtcgggaatcctgtcttctacagactcagtttgagaggactcaaaatggggccattgggtagctggcccctggaggagcaatgaaggagtcatcagtggatggttctttaaagccatgggactggataagcatctctggggagagtttataggtagagaagagatctgaaccctgggcatggcaagaatccacagttaggaagcaaaggagaattcacaaatagagactgagaagaaaccagagaaataggaaaaaaatcacggtcccaaaagcccagtgaagagtgtttcaaggagagaaggatcaactgtgtcatgctgctgagacgtcaagtaagatgagacctcagatatgtgtgtgcattggtgttggcaacatgcaggttgttggtgaccttgatgaggtggtgtgataggaacaaaaccttactgagtgggactaagagaggctgagaggtgaggaagtggtaacagtgagtggagagctctttttaggcttggaatgaaggagagcagaaaagtagggaggaccaaagaatgatagcatggtagacagtgtttgtgtaagactgaagaaatgacagcattcatatgaaaatcgggacgatcccgtaataagattctcctgcctcagcctcctgagtagctggtactacagcgtgtgtgccaccacacctggctaatttttgtatttttagtggaaatggggtttcaccatgttggccaggctggtctcgaactcctgacctcaagtgatccacccgccttggcctcccaaagtgctggaattacagtcatgagccaccatgctcagctaggtgtttataagtcaaggaagttttatgtgaaaaaagggaagtacctaaatctgatgtaccaaactgatataatgaagcatttcccagtatttgttccagcagctgggactacagcggtggacaaaaagctgagctgtttgttcttgggcagggttcctgagggggaagatggatatgcaaaacaaaccacctgagtgccctgtgtccagttacggtggatacataaatgatcatctcccattcctatttcctcctgtcagacaaagccttgttaatcattgtgcaaacattctttcagttaggggtttttcagtattctggaaaacacaatgcggcaatgtacagaacacaacaatttatccttcagtccgtttttgcacttctcgttaaaattctgtttagaaagcagggttttaggctttttgctgtggcagtgggagtatccagtctaagaaatgaacattgttcagaactgaaagaactttcatatactgaaatatacccttcattgtgttaatagctgtctggccttgggggtggtgctcgtcatggtaagatgctttttctccttgtttgcctataggagaatcagattcatcatgttagctacaatagtgctatgctgcaaggtgggtgtggtttttttttttttttttttttaaggtagggtcctactctgtcacccagcctggagtacagtagcgtgttttcggctcactgtaacctctgcctcctgggttcaggcgatcctcccacttcaactttttggttaggtaggactacaggcacatgccaccatgcccggctaatttttgtattttttgtacagatggggtttcaccatgttgcccaggctggtcttgaactcctgggctcaagcaatcctcccacctcagcctcccacagtgccaggattatagttgtgaaccacaatgcccagcctggcaaggggggtgtttgttttgttttgttttgtgattctcctgcctcagcctcccgagtagctggtactacagcatgtgtgccaccgcgcccggctaatttttgtatttttagtagagacggggttgcaccatgttggccaggctggtctcgaactcctgacctcaagtgatccacccacctcggcctcccaaagtgctgggattccaggcgtgagccatcatgtgctcagccaggtgtttgtaaggcaaggaaattttatgtgaaaaaaggaaagtacctaaatctgataacatttgtaggatatctatacaagacataacttgggccaagtgctgtggctcacatctgtaatcccagcactttggcgggccgaggcaggtggatcacttgaggtcaggagtttgaggccagcctggccaacgtggtgaaactctgtctctactaaaaatacgaaattagtcaggtgcagtggcatgcgcctgtaattccaggtactcaggaggctgaggcatgacaatcgcttgaacccgggaggtggaggttgcagtgagccaaaatccgctccagcctgggtaacagagtgagactctgtcacagacacacacacacacacaaaagacataactaaatatccacgaaagtaaatattatagtgtgaaagtaataaatgcaattctatttttcacaaaaatatcaatttaaacatttataatagagtgaattattctatcataaagggttccaaggaaaaaaatgtttattgactcggatacagttttttaactttagatttcaggtcagtatttggtgaaactgaagtgatatctgaactgaaagtgagatatttcctctttgattaaggggaaactcaactaaaaactcattaatgctttgcttgctggcatagtcatttattgccactgggaatatgtcttatttcttcaggcaaagatgaaacaaagaagagaaagtaactgaaccagaatagtattttcctttttttttgagacggagttttgctcttgttgcccagggtggagtgcaatgtcacgatctcagctcatctcaacctctgcctcccgggttcaagtgattctcctgcctcagcctcccaagtagctgggattacaggcatgtgccaccacacccagctaattttgtatttttagtagagatggggtttctccatgttggtcaggctggtctcgaactcccaacctcaggtgatctgcccgcctcggcctcccaaaaaaaacccaaaaagcctttttattgggaaatagtttcaggcttacagaaagttatagaaatagtacatagaattcccaaataccttttacctagattcctcaaatgtcagccctatttgctttatcatcttccatctctgtttatatgtatatgtgtgtgtatacatatacattcttttcctgagacacttgagagcaatttgccaacttgatgaccttttgcttttaagcccttttctaggctgggcctggtggctcatgcctgtaatcccagcactttgggaggctgaggctggtggatcacatgagatcaggagtttgagaccagcctggccaacatggtgaaaactcatctctactaaaaatactaaagttagccaggtgtggtggcgggtgcctgtaatcccagctactagggaggctgaggcagaagaatcacttgagcccgggaggcagaggttggagtgagccaagattgcggcactgcactctagcctgggtgacagagcaagtctctgtctcaagaatgaatgaatgaattaataaataaataaatatttcagtccttcccctacaaggacattttcttatctacagtacagttgtcaaaaccaagacatttacattgctacaatattgttattgagtgtttaaattttgccgattaatccagtaattttaattttaagaataatatttaatggttcatttttgcttggttatagcctccatccctgtgagatcactgccctgagccaatccctacagcccttacggaagctgccttttagagcctttcgcacaggtaaggagcaattagagatggtggtgaccctctctctgcctcagtttggtcatctgtaaattgggataaacatagggttgttgttagagttaaatgagttagtatgtggaaagtacctggcatgcagttatcactgaagcgttaggttttctttttctttttttttttttttgagacagtcttgctctgtcgcccaggctggaatgcaatgatgcaatctcggcttactaaacctccacctcctgggtttaagcaattctcattctccaagtagctgggacacagatgtgcaccaccacgcctggctaatttttattgttaatttttgttgtttttttaatatttcaaagactgtgtgcatactggctaatttgtgtatttttagtagagatgaagttttgctatgatgcccaggctggtctcaaactcctggcctcaagtgatctgccgaccttggcctcccaaagtgttggcattacaggcctgagccaccgtgcccggcctcattatgtctttttgattatagccattccgatgggtgtgaaggggtctcattgtggttttgatttgcatttccctgattactaataatgttgtattagtttgctagggctgctgtaacaaagcaacacaaactgggttgcttgaacagcagacatttgyctcatgattctagggctaaatgtctgagatcaaggtgtcagggttgcttcctttggagggctgtgagggagaatctgttccatgcctcttgcctagcttccaatgttttgctggcaatctctggcattccttacatatagaagcatcactccaatctctgccttcagcttcacctggtattctccatgtgtgcatgtctgtttctagattttccctttttataaggacacccatcatattggatttggacacaccttggcaacctcattttattttatttatttatttacttatttatttttttgagatggagtctcgctctgtcgcccaggctgagtgcagtggtgggatctcggctcactgcaagctccgcatcctgggttcatgtcattctcctgcctcagcctcccgagtagctggggctacaggcacccaccaccatgcctggctaattttttgtatttttagtagagacggggtttcaccgtgttagccaggatggtcccgatctcctgacctcgtgatccgcctgcctcggcctcccaaagtcctgggattacaggcctgagccaccatgcccagcctgcaacctcattttaacttgataatctctgtaaagaccctctctccagccaactaagggcaccttctaaggtactcagggttagaacttcaacataagagttttgggggagttttcagcaatttaacgcrtaacagatatttagcctctgtcttttcttgtgcttattggccaatgtatttttcctttggacaaaggtctattcaaatcctttgcacattttgattgattgattgagagagtctcactctgttgcccaggctggagtgcagtggcgtgatcatagctcactgtaaccttgaactcctgggttcaagcaatcctcccacctcagcctacctagtagctgggactataggtgcaagccgctgtgcctggctatttgtctttttattgttgacctgtaagagtttatgagattttgcatttgagagagaataccagtgcctgatcaaaattgggcctgcattataaaagcaagatcaaagagccctgggtgagaaatggtgtttggcttcaagttctggacctgttggtgaccacctgggcaaccttgattagtttcttgacctctttgcgattcagtgttttcatctattaatacattttgtgactgcggtggcagttgaggtgcattgtaattctataggaaagatgcctgtcctgtacgtactgacagaatttggagacaggagggtctgagtagtggcccaaggttgcacctgcctgctagatatgttgagggtccagtcacctctactgagggcttcttttttttttttttttgaaatggagtctcgctctgttacctaggctggagtgcagtggtgcagtctcggctcactgcaagctccgcctcccaggttcacgccattctgcctcagcctcccgagtagctgggactacaggcgcccgccactgtgcccggctaagttttctttttgtatttttagtagagacggggtttcaccgtggtctcgatctcctgacctcgtgatccgcctgcctcggcctcccaaagtgctgagattacaggcgtgagccatgtgcctggtcccctactgagggcttctgaggtgcgctgacttttcctgaccctcctgttggtgctgtgtttgcatgactcttccctattcctgtctctcaggcttgaaattgtcctgttttttattacagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggaggtaggaatgaggtggaactgccttgggttctcgtccagcaaactttgtctgtcacttttccagttgttccaaagttgaaatgtttgaacaagtcaaatatgctttcttggaactcatgtctccagtaggttttggccagatacaggagttataactttggtgtcaagtcaagcttgtcttctgttgccagaccttaccctggtctccccaagggttctgagtagaaatttcttgctgttgaagtctcagagtgtatgtcttgaattggtgctgacatcctggctgttctgctattcttgcccttgttagtcagaagagggctgaaactattgagcttttgtgatgtggattagttctcaccaggaaccagacagaaataatcaaattcctttgtcattattgctcaaaatgcttccttccatcatagtcacacgataggggcagcctgcattgttatggaatgcacgatacgtaatgaaacatcttgttcatctgtgcttcccatgtcccaggatgattcctgacttagaggagacattcagtaaattgtgaaactgaatataaaggtgtaagtttaacaattgccttttttttgcagccataatttaacaaataaaaaatctgaaatatcaaaggaccagtaataggtcttaatattctgggcaaaagagggggtgacagttgaggctttgtgatatctggaatgcagtggtgatccactccattttgctaatccagatcagctgaatctattctaataggacatacggtgactggggcattaggatgctgaaggcaagtctcaaccatgctccgcagtagctgtgtgaactgggacatgtcactttctgtctggtcttgtgtctttaacagtaaaacagcaggttgggttcgaacatgactctgagattccatccagctctaacagtttatctaggagtatttgctgccattggcattacatgctacattataggtttccttccaaaatccttttttggactttaattttgaccattttcttccaatagaatctagtatacagacttcacttgatttctaacagtcctgtaaaaccgtgacttagtcaactggccatacagatccagctatgggagttaccctaagagatacctgtctgctcttgccctgtatgtccatgtgcctaccctttggcctgttcgtacgccttgggctttgtaataacctaccttaaacaaaaaaaaaagttttccggtactatatcacaaattccttttggtgaagggtaattatgtagtaggtgagtcacactttcaaagtatgctgccctctgttccctgtggcgttgctggtttcccctgtaaacatcattttccattagattagtagattagtaaagtacttgtaaagtgtaggtagcacgtgactgtgactgcatgacccccctcaagtgttaaacccaagctgacatctttctgaccttggggatttttgaggctgactcaccctgtgatgagcttgcatgctttcaagaaattcccacacacttcaaaggtttcccaaaagaatataaatttggaagaaacctgccacttccaaaatcataaaagaccaacgccagtagttttttagtatctgctgtttatgtaattggagttattgccatacatagtttcagacctggaagatggttgtaaagaggacagggttgattaactcataagtcccagggcctggaaagtgacaggacactggagtasagtggcctaatgcagtgtgagatctcaaagcacctattggtaaagaactgggcttaagttagatactcttcttgattgaataaaatggtcacagaaccactccttgatgttctttttctttttttgtagatatgaggtcttgctctgttgcccaggctggtctcaaactcctgggctcaagcgaccctcctgcctcagcctcccaaagtgctgggattacaggtgtgagccactgtaccggccactcctggattttcaagtgggactccaacacttcattttatgagggggaaatggtctggacttggagttgacattggagtttgagtatcccttatccaaaatgcttgggactggaagtgttttggatttttttttggatttttcaatatttgtatatatatatatactgagataacttggggatgtgacccaagtctgaacacaaaatttatttattttattttatttgttttgtttttcttttctttttttttttttttrgayggagtctcactctgttgcccaggctggaaggcaatggcgcaatcttggctcactgcaacctccgcctccccggttcaagcgtctcccacctcagccttcccagtagatgggattacaggcacctgccgttatgcccagctaatttttatatttttgtagagacagggtttcactggccgggcgcggtggctcatgtctataatcccagcactttgggaggctgaggcgggtggatcacctgaggtcaggagttcgagacaagcctggccaacatggtgaaaccccgcctctactaaaactaaaaaaaaaaaaagagacagggtttcaccatgttggccaggctgctctcgaactcctgacctcaggtgatccgcccacctcggcctcccaaagtgtgtggattataggtgtgcgccactgcgcccggccaatttatttatttatttgaggcagggccttgctctgtcacctagggctggagtacagtggcatgatcacggctcactgcatccctgacctcctaggctcaagccatcctcccacctcagccttctggagtagctgggaatataagcgtgtaccatcctacctggctaatttgtttgaatttttgtggaaacaggggtctcatttatgttttagatataccttctacacatagcctgcgggtaactttatataatactttaaataattttcttcatgaaacaaagtttttttcttttttttttgagacggagtctcactctgtcacccaggctggaatgcagtggcatgatctcrgctcactgcaagctccacccttgggttcaagcgattctcctgcctcagcctcccaagtagctgggattacaggtgcctattactgcgccagctaatttttgtatttttagtagagacaggggttcaccctcttggccaggctggtcttgaacttgtgacctcatgatccacccgcctcggcctccgaaagtgctaggattacaggcgtgagccaccatgcccggccaaaacaaagttttgactgtgacctgtcacatgacatcagatgtggaattttccacttgttggtgtcatgtcagcactcaaaaagtctctgattttggatgttcagattagggatactcaactatatacgttttcaggaatggcaacaggttaagaagggagagtgttgaatggctgtctggggcctggtcctaatcccacctctggttccacctaatcactgtcatcacaaatgaaaaatgtgagattttccaaatgtagctgatatcagaattgttggggagctttaaaaattatgaatttgaggctgggcgtggtggctcatgcctgtaatcccagcactttgggaggccgaggcgggcggatcacgaggtcaggagatcgagaccatcctggttaacatggtgaaaccccatctctactaaaaatacaaaaaattagccaggcatggtggcgggcgcctgtaatcccagctacttgggaggctgaggcaggagaatggcgtgaacccgggaggtggaggttgcagtgagctgagatcatgccactgcactccagcctgggtgacagagtgaagactccatctcaaaaaaaaaaaaaagaaaaaattatgaatttgaattccttaactcctagaaatctacaaagtttgggctaggtgcaagatctgtgttttccaggagccctgtaggtgattctgatgataagccagcttgaagaaccaaaggcagatgagccctacctaatgttcccttcagggctacagttttttgtttttgtttttgtttttttttttgagacggagactcgccctgtcacccaggctggagtgcagtggcgcaatctcggctcactgcaacctctgcctcttgggttcaagccattctcctgcctcagcctcctgagtagctgggattacaagtgcccgccaccaggcctggctaattttttgtatttttagtagagacggggtttcaccgtgttaaccaggatagtctcgatctcctgacttcgtgatctgcctgccttggcctcccaaagtgctgggattacaggcatgagccaccatgcacagccactaatttttgtatttttttgtagagatggggtttcaccatgttgcccagggtggttttgaactccttagctcaagtgattcacccaccttggcctcccaaagtgctagaattacaggcatgagccactgtgccgggccagttttaggtttttgttttgttttgtttttcagagacagggtcttgctgtgctaaggctggagagtagtggtgtgatcatatcttgctacagccttgaactcctgggttcacatgtttctttcaccttagccttcccagtagtggactgtaggtatgtgccacttcgccagggtagttttatatttaagtcttttatccattttgaattaatttttatttacggtataagagaagaatccaacgtcattattttgcatgtgggtatccagttttcccagcatcatttgttgaaaagattatcctttctctattgaatggtcttggcatgcttgtagaaatcagtcttactccctgttaaatgacggagatgaatatagcaaacactatgacagaatgttggaaaacaggggacatgatgattcccacgccttcttgccatgtgactgtgattgcttaatcatgcgctttgttttttatgcattcacttcctgtctttattttcttttttttttttttttgagatggcattttgctcttgttgcccaggctggagtgcagtggcacaatctctgctcactgcaacttccgcctcccgggttcaagcaattttcctgcttcagcctcccaagtaggtaggattacaggtgtgtgccaccacgcctggctaatttagtatttttagtagagacggggatgctccatgttggtcaagctggtctcgaactcccgacctcaggtgatccgcccgcctcagcctcccaaagtgctgggattacaggtgtgagccaccacgcccggctttttttctttctttttttttttttttgaaactgagtctcgctctgtctcccaggctggagtccagtggcgtgatcttcgctcactgcaacctctgcctcccgggttcaagtgattcccctgcctcagtctcccaagcagccgggactacaggtgcgcgcaccaccacgcccagctaatttttgtatttttagtagagatggggtttcaccgtgttggccaggatgctctcaatttcctgaccttgtgatccacctgccttgggcccccaaagtgctgggattacaggtgtgagctaccacacctgtccttttttctgtatttttaaattgattcagctgtttgtttgttttttgtttttcttttttgaggcaggctcttgctgtgttgcccagactggagtgcagtggcacagtcacagctcactgtagccttaaccttccgagtttaagcagtcctctcacctcagcctcccaagtagctgggacatggtgcacaggcatgcaccaccaccacactcagctaattttttattttttgtagagatggggtctcactatgttgcctaggctggtctcaagcgatcctcccaccttggcctcccaaagtgctgggattccaggtgtgagccaccctggagccactcttggctcttcctcagtggtgacaggcgcccaggtcctgaagtctctggttgccactgaggctttaccacctcagttgattctggtatactggtggtctttgccaccatgaataatgttgcagagcatacctttgcacataaagccttttcctcatgatgaaagcctacgtgtaggattgctgcctgaaagggtatggacacctttatggtttgtggcatgcatttggcttctaaaacaatcggagtgtttcccccttatccaaggtttcatgttcctgcagtctgaaaatattaaatgtaaatttccagaaataattcctaagtttttaaattttatcattattattattattttttgagatggcgtctcactctgtcgcccaggctggagtgcagtggcgcgatctcagctcactgcaacctgcgcctcccgggttcaagcagttctcctgcctcagcctcccgagtagctgggattacaggcttgtggcaccacacctggctaatttttttgtgtgtttttagtagagatcgggtttcaccattgttggccaggctgttcttgaactcttgacctcaggtgatctgcccacctcagcctcccaaagctgggattacaggtgtgagccaccrcacctggccacaattcctaagtttcaaatgtctccctgttctgagtagcataatgaactctctctctcccacctaggatatgaatcctccctctgtccattgtgacctcagtgtctatgctgcctgcccataagtcacttagtagccatctcagttaccgtatcagctgtcgtggtattctggtgcttgtgttcaggtcacccttatttggcttaacactggccccaaagtgcaataatagcaattctggcaatttggattgccgaagagaaagtggtaaagtgccttctttaagtgaaaatgtgaaagttctggacttcaaaaggaaagaaaaaaaatcatatgctgattttgataagatctatggtaagagtgaatcttttatccgttagttgagcatgatgtcgaggtgggtggatcacctgaggtcaggagttaagaccagcccgaccaacatggtggaacccctcttctactaaatacaaaaaattagccgggagtggtggtgcatacttgtaatcccagctacttgggaggctgaggcaggagaatcgcttgaacccaggaggtggaggttgcagtgagccgagattgcgccattgcactccagcctgggcagcaagagtgaaactccatctcaaaaaaaaaaaaaaaaaaaaaaaacaccgggtgtggtggctcatgcctgtaatcccagcactttgggaggccgaggcgggtggatcacctgaggtcaggagttcaagaccagcctggcccacatggtgaaaccttgtctctactaaaaatacaaaaattagccaggcgtggcggcaggcacctgtaatccctgctactygggaggctgaggtgggagaattgcttgaacccaggaggcagaggttgcagtgagccgagatcgtgccattgtactccagcctggttgacagagcgagactccgtctcaaaaaaaaaaaaaaaaaaaaaaaacaaccaaaccgaaacaaaaaggatgtttttattttaagtttttatttcacagaatgatgtctctagaaagggtagcttgaggcctggagtggtggctcatgcctgtaatcccagcactttgggagactgaggtggcggatcacttgagctcaggagtttgagaccaatccgcgcaacgtggtgaaacctcatctctgctcaaaatacaaaaatcaaccggtgtggtggcatgggcctgtggtcccagctacttgggaggctgaggtgggaggattgcttgagccaggaggtagaggttgcagtgagttgagattgtgccactgcactccagccggggtgacagagcaagactctgtctcaaaaaaaaaaaaaaaaagtagcttgaaatcgtgttctggaaagctgcttgctgagctgctcaggttgaagacccagagtgttccttttagttccatttagccccgtcgcgtggagtgtgcgcagcttgaataatgctttttggcttccagagtgctattcccttgagtccctgattcaacctgtggcccatcagtgggcagaggtgattttctgcagggtaccaagggcactcttgaaggcaggagctcagggactgctgagaagtagaagagccgcttctctgagtttcttttcaggaactcatgatgtcctgggaacattcttggttcttggcctgagtgttcacttgggttccacaggtgtggcttgtggctttggctgttgacatagaggcctgtgctcagagccgcggtgagtgagcacagacagagggtgggtggctaccaggtacagatctgtagtttatggatccatagtttatactgctgcagtggtcatatgtcctgcctttgtgtggcggttgtgatttcagatatgctgcctatttgtccccaaaagtcataaaaaaaatcattcagcaatcatgtcatattgcctgtttcctcttttcctgaaattgacaaatactgttttagattatatctcaaatttttggttacaaaacatctaattgaaaatatacactttcagctaggcatggtggctcatgcctgtgatcccaacactttgggaggctgaggtgggaagattgcttgagcccaggagttcatgaccagcctggcaaggcaagactctgtctctacaaaaaaatacattaaaaaattagccagcctggccaacatggtgaaaccccgtctctactaaaaatgcaaaaacatttgctgggtgtggtggcgggcgcctgtaatcctagctaatttggaggctgagacaggagaatcacttgaacccagcaggcggaggttgcagtgagccgagactgcgccattgcactccagcctggtcaatgaaactctgtctcaaaaaaaaaaaaaagaaaaaggaaaagaaaaattagccaggggtggtggtgtgtgtgcctgtggtccctgttacctgagaggctgagacaggagaatcgcttgaacctgggaggcggaggttgcagtgagctgagatcatgccactgcactccagcctggtgacagagcgagacgctgtctcagggggaaaaaaaggaaaaaaaagacaggctctcactctgtcatccagtctggagtgcagtggtgtgagcagggctcaccacggcctcgacctcccaggctcaggtgatcctcccacctcagctgaaactgcgccattgcactccagcctaggcaataagaacgaaactctatctcaaaaaaaaaaaaaaagaaagaaaaaaaaaatggaaaagaaaagaaaaatcagccaggggtggtggtgtgtgcctctggtcccagctgcctgagaggctgaggcaggaagatctcttgagcccaggagtttgagagcagcctgggcaacatagcaaaaccatgcctctacaaagaaaaaaccattagctagtagtagagacagaactggtttttgtggcagaggctagggaaggatgggggcagatctctgaggggaggagtggcctgcgggtgtccttactacccgttttgcctctcttggggcagctgtgtcatttcctctctgccggtcttcttggccaacaagcgtttctccctcttccctgttctccccacttccccacttcatcccccttcatccccccttcctcgcccctccacagacccagggcatttggtggacacttttgcttgcagttaggtcaagtggaggtgagtttcccatggggcaggggcttgacagcaggggtggccgtccagactctccagaagggacgtggggctgctgttgtgactggacctgccccacatctttgggcctgagctgtgcccggtcacagcgtcctgagttcctttgtgttgcctctgccccgtggatctaggtcttgggggagggctggtttcatcctggggctaccaccacctggcagcagccccacagccaagggcaggcacagccaaaatacatctgcctgagtggccacagagcagggccaggctctcctggcccagtggtttggaggacagagggcctggcccgaggggaggcacttgctcagcctgcggctcccacgccaaaggcagggcggcctctgggtctgtctggggccgagccttatttctggaagcacatggatcctccttccttgccactcagtctaaatgtttaggttacaaacattctgagtgagaaatttcagtcagagcttgtaatgtgtaggacgtgacattagggagtgaagagctttcctcttcactgattcaagatagccagtgccgggtgaggggagcgggacacttgcttcttcagaagagtggatccaaaagttgacctcttccccagactgagtcagcatgggaagagaattgtgctttcacaaaagcagagatgcttttctgtagctttcactgtttcttctttgctctggaaaatggaggacgaaggagttctcaggtcctcagtcactggagtaaagtgacatgcacgtcccagcgtgagtgcctgaatgggtctctcaggtctgaacagaacagccctgtggctgccgcgagctggtgcaggaggaagtacagaggagggtccggttcagagtggcgtgagaccagggttagatgactgttgccagtttagggccagtgagagatttttaatggtaaatatgtaacctcttttaaaaaaaaacaaaaacaaacaaaaaacacaactttttcttttttgagagagtcttgctctgttgcccaggctggagtgtagcggtgtgatcacagcttactgcagcctcaacctcccaggctcaagcgatcctcccacctcagcctgctgagtagctggaattactggcgtgcaccaccatgcccggctaatttttctatatatatatatatatatatatatatatatatatatatatattttttttttttttttttttttaatttatttattattatttttttttgtagagttttgccgtgttgcccaggcaggtctcaacctcctgggctcaagtgatatagctgccttggcctcccaaagtgttgaaattataggcgtgagctactgcgcccaacgaatatgtaatctttttaaaaaaagggaaaaggttgggcgcggtggctcacacctgtaatcccagcactttgggagaccgagatgggtggatcacgaggtcaggagttcaagaccagcctggccaacatggtgaaaccccgtctctactaaaaatacaaaaattaggctgggcgtggtggctcatgcctgtaatcccagcactttgggaggctgaggtgggcagatcacaaggtcaggagatcgagaccatcctggctaacacgttgaaaccccgtctctactaaaaaaaatacaaaaaattagccgggcgtggtggcgggcgcctgtagtcccagctacttgggaggctgaggcaggagaatggtgtgaacctgggaggcagagcttgcagtgagccgagatcgtgccactgcactccagactgggagagagagtgagactccatctcaaaaacaaaaaaaaacaaaacccagaaattakctgggcgtggtggcgggtgcctgtaatcccagctacttgggaggctgaggcaggagaatcgcttgaacccggaaggtggttttattgttttgaggcatggccctgggggcttgtggcaagggctgaggtgtttggggagcagcagtgcaggaaaggccttactcagctgggcttgcaggtatgctcactcctgtctgagcgctgcttccttgtttctagcctccgtttagaatwaaaaaaaaatgtatagtacagtattccaattcatcaaaaggaataaagacagatcagcctgtctggtctaccaccattcagcctaagcataaggcagaaccctgtgaagtggcctgtgtcctccttctctccctgtccccttcctggagccccatgggcctgtgctcagcacgcgtcctggcgccgcggtgtacctggtagtgggcagtatcggacgtgttctccatgttggtgagcgatgtacatgctgtagctttattattctcatctataaatagggccattcatgccctcataaagttgttaaataagagtgatgtgtatgtaaatacctggccccatgctggcagggagtggagctttagtactattttacttcttacctaataggtgtgagtgtggaaatgggcaaatagtcaagttggcagggaagcagagcctcctgcctgccccagtgccacctgaactcctgtagtgttcttatgccactggaactggctggcaggggccagctctgacctcagagaattgtgggctcactctagggcaggaggagatcgcagagggcggaacggtggctcatacagccatgcccccaggtggcccaggacccacctgggagctacctccaatggctttgagcggtcagtgtgtggacaagcggagggaccgtgtctcaagaatatgtggaactcagcggggcatggtggctgacgcccgtaatcccagcactttgggaggcaggcagatcacctgaggtcaggagtttgagatgagcctggccaacatggtgaaaccccatctctactaaaaatacaaaaattagcccagtgtggtggcaggtacctgtagtcccagctacttgggaggctgaggcatgagaattgcttgaacccgggaggcagaggttgtggtgagccaagatcattccactgcactccagcctgggggatagagtcagactctgtctccaaaaaaaagacatggaacttaaacacaaggctaaacttctgggctggaaggaatcgagggatggccgactcaagatacctgcagccctgcatgaagctgtctgccaggaggctctacctaaaagcagttttgttttgttttgttttgttttttgagacggagttttactcttgttgcccagactggagtgcaatggcacgatctcaattcattgcaacctccacctcccaggttcaagcgattctcatgcctcagcctcctgagtagctgggattacacgtgcgtgccaccacacctgagtaattttgtatttttagtagagacagggtttcaccatgttggccaggctggtcttgaactcttgacctcaggtgatccgcccacctcagcctcccaaagtgttgggattacaggcatgagtcaccgtgccaggcctaaaagcactttttctttttctttttctattttttttttttttttttttttgagatggagtcttgctctgtcacccaggctgaatgcagtggcaatctcagctcactgcaacctctgcttcctaggttcaagcgattctcccacctcagcctcccgagtagctgggattacaggcgtgcaccaccacacctggctaatttttgtatgtttagtaaagatggggtttcaccatgttggccaggctggtgttgaacttctcacctcaggtgatctgcccaccttgacctcccaaagtgctgggattacagacactaagtcaccacgtctggcctaaagcactttttctgaattccaccccagtctgcccttcctgagtgcctgggcagggcccttggggagctgctggtggggctctgaatgtgccaggggtatccgggacatcttgcaggctagtgggactgccaaaaacgattctcaaagatgagtggggagttgggcagggataggagaatctggtgtgtagagaaatagcctgaaggcactttgtgcttgcctggcctctctgcccagacgttggggaggctgatgcctgcctgtggtttcttgtactagccgttaagaccccagccatcttccttgaggggcttctgccagcccccagggaatgagaattagccaagagccaggaaatgagaattagctgaggacaccttttacccctgttccgcagctaccttctgttccctggcacagggcatccccttagaagtagtgcatgaaattcacacagctgggacctggcagagaatacaggtggcttgactgaggcagggaggcctccatctgcaggtggcctgagagcctgcagagcctcacagtggcactaggtggcactcccacccaagggagtcctaacagagtgggaggcgtggaaataaaggactccatggcctgaaggaaataaatacaaggtaggaaagtaaatttccagacaattttttttccctaatggaaattcacttgtaagtgattgttcaaaatccagaggcatttccccactgaaaatatgtgtggtggaggtctggttggaaggtggggtagtgctaatctcggccaacttgtgggctggtttatgggtttcgtttgtttgtttgtttgtttgtttgttttttgagacgagtctcgctctgtcgcccaggctggagtgctatggtacgatctcggctcactgcaacctccacctcctgggttcacgccattctcctgcctcagcctcctgagtagctgggactacaggcgcccgccaccatgcctggctaattgtttgtatttttagtagagatggagtttcaccgtgttagccaggatggtctcgatctcctgacctcgtgatccgcctgcctcggcctcccaaagtgctgggattacaggcatgagccaccgcgcctggtggtttacgggtttttaaacacccatctgccttagaggcttagaatggctaaaaagcaatgccagtggatgcagtgcagccgagctggccattccacagggaagagtgtgagaatcccagagatctctcagcacatgggaggtagaatgtgtgcagaagctggtctttcctctacagacctttctcccctggtctaactggggcttggttttgttccgtccccagggacctgtgtgggctggtctgtaagtactagaggctttgaggaggccaggatggtcttccagggtctttccagttctggaagttggtggtggcaggattctgcgtcaacatctttctgtgctttaattgcattttatcccatgtcatgtgtttccttggacctctgaggtgagaaggggtctgaagtttctttggggctctgagaatgctgggatcagttacagtaagttctcaatcttgatgataggttcttgggatcttcacctttaagcaaaacatagaatgaaaccagttttaccataggctgattgatagaagcaagaattaagttcctatggatgtttctgaccacaaaaacatcaccgaacttttaaagaccccaaacatttctaatattaaccattgaaatgtgagctatacatgcatttatgaatgattaataaaaagttagataattatttacctaattactccakttcagggttgcaggtggtcccctatccgatgggcagctcagggcacaaggcggaaaccagtcctggatgggatgtcttcccatggcagggtgcacccacacccacactcactcagactgggaccatttasacacaccagtgagcctaatgtgcatggctttgggatgtggaggaaactagggtactcagagaacacccatgcagacatggggagaacgtgcacactccacacagacagtagccctggctggaatagattttttttctcatcagtgttatgatgacactatttgaggacctcccgtagtgatgtctggacaggagaatattaggagcagctttgtataaggtatctgccacccctgtaccacatgctgaggcccttaggggtggcactgtgccttgttcacccctgcctccctgttcccatgggtgcattgtaggtatggaagaacatggaaatccatggaggaggaccctatctgtcttcttccccctgccgcatcccagggctgtggcttgtcatgtggcacttgcttgggctggatccaggtaaggacgacaggtgtatggggctgtgactgtacacccttatgtcctattccaggcgtggcccccacaccatttctccgcaagccctacagaccctctcctcctgttccaaaccttaattctttctttctttttggtttaaaaaaagaggtctcactatgttgtccaggctggtctcaaactcctgagcttaagtgatcctcccaccttggcctcccaaagtgctaggatcacaggcatgagccttcatgccttagttgctttagaaacaaagatctcagtggtgagaagccgctggaattgtatcctgttcagtggctcagaatgaggagactgagacttctagggccaactcaccattgaatagggaatgggcgtgctcagttgctcccacagatgtgaacaaggctacttaatgccacaccttttctttggttgaatggtgatccctctcagacccttcccctcccctaaaagcattaagctgattggtctgatcccatgtgggctgagtgcttgtcggatgcctggcaccatgtgggtacggggtggactgccaagccgcagactagggccctccgatctagcggggtgggaagacagcatgcatcatccatcccatgggctctgcatcctagtagtgaagcagggaggcctgtgtgctctaggctggggcggtcggaccttgtttctggctgcccttgttcgctggtctacatyagttttggagtcagggcattctgtttgtcagggttttgcgtgcctggagggcagaaggttggggtgggagcagccttgtagcttcaagatgggatgcgggaaggatcaaggatttcgcattctctggagcttcctagggctagcaggggtggctttctgttcagtccagtgaagaagctggtcctcagtgaggtcagcagcacgtggggtcctgagtctgcctagtgttgggtcgcgggtggtggaggggaggcagctgctttgggaggccagccacgggctgcagacaggcggctcacagaccagcggacagactgaggacagacaggaggcatcccttgggagcagccgggcccaccttgctggttgagtggggtcctcccgtgacagtgaccaagcagagctggtgtctgctgcccttccccttctccctggccttggcccttcctcttaaaggggccctcgggttgggcggacggcccagcaggactggggctcagagggggcggcagctttaagggtggctggggtcggcctcctgcccccgcccctggtagtctgagtggctggagcccgagccccgcccactcgccccaaggcttcccggctccgggagcgcccctagggagtcggagcccggaagctggagccacctgcgggtgagtgagcggagccggcgccccggccctgccgggagccccaggtgacttctcagggaggcgccccaccctgcccgctcagagggccagtgccgggtgggggtgcccttctagggccttcggtcgcaggtgggctctcccagctgtgacgacgcggccccggcctgaggagccccgcggacaaggttgagcgagtcgtgggctttttttccgtccccacgtgggcacggcccgggctgcgtgagctcacttcctccacatcttatctcctgccgggcgcgggtacgggaagtgaagagcgtacgggaagtgaggcggccgcgggaagtgagggggtgcctgcagtgaggcggctgcaggaagtgagggggtgccggctggcattggcggggcccgggctgagagctccgtctccttggtgctgccggagggcctgggggcaggccgcctggggaagagggcggcgcccgagggccagggagcgggtggccggcttactgcctttgcccagagccggttcccctcagcacccagagttgtctgagaggaggttccctgtctttgggcggctaggatagacccctgcgagtcctgcctgccctcttcccagggcctcctgggctgcctgccactgactctggtccatgtcgcccagggaggaccattttccccgtctcctacttgggaagtttgcctgcttctagctcaggaatgcagggaaggcagggttgtcgccccactagacgcacgccgctgcatggtggccaggcctcagctgagctggggagaaagtcagccccttgcccccaccctcgcccccgggggaagtgcatggcccgcagtcaggccactggacacaggatttggggccctggangtttctgctgaggcttcaagaggggtggtcctggcgttccaggcgcttcccatcagacagcaggagccagttctcagggtccttggctgaacacacaagctgcaaagctacatatactccggcagagctggctgcgggctgcagactgcaggtgacagtgccatatccctcactgcctgctccgccttgctaaggcttgaaccagaatccactaggagcaggactgtaagtgtatacacgcatacccctacacacacacacccctgcacctacacacaccctcatgcacacaccccctacctacacacaccccctcacctacacacaccccttgcacctacacacccatacacgcacgcgccccctacaggcacacaccccctcacctacacacaccctcgcacctacatacacacccctatatgcgcccaccctcacacctacgcacatgcctcctacatgcacacaccttgcacctgtgcacaccccctccaggcacataacctcacacctacgcacacaccacctatacgcataacacactcacacctacacaccccctacacacaccctcacacctacacaccccacacaycctcgcacctatacacgcacccctccatgcacatacccttgcacctgcacacgtatcctccatgcacacacacttccacctacatgcacctacccctcacgcacaacaatcttgcaggccccaacccaacctgtagtaactgctgcctggcctggggtcattcatcgacttcagttggaatgttccattccactgggggggcaggtgttgtggtctttaccctggttggtgagggacgggtggggacactgccttactgctctggtatggatccccaaaacagcatgtcctgacaaaggtgttcccctaccccctatacggtcctatcagccattgtytcctattcacagggccggtcactccgcgcaagtttgggttcctgttttagaactgccacctaagcccctcttatttcatctttcctgtggtggaaacccctgcccccaccggagtgtgaggttgactttttggaaagagaggtgaggtgttggaagccaggtctgaggctgcgtcgcgctcctaggtggaagtggggtttctgagcagttgttctgggccatggttgcagctgtgctctgagcctcaagggggtggccaggaggaatttcctttcccattttccagatgtacaaaccaagacttagagactacctgtgacttgccaatgcctttccctgctctcagggcagaggtagaggaaggcagccaggattgcagtgaccaggttgtcatcagccacaaagcsctctgagttctcatgttgcaggtgactggcccttaggccatgtagtgacattaaagtcctattggtcacaaccctaaactcctctccacagaatgtctttgaggcttagaagggagggaaggtgtcagtgcttcctccattctggatacccttcttgcaagctcctcatycagggcctgaggctcccacctcgtgtcacctcaagacagccagagaggatgaaatctttggcttgggcttccagggctgtcataggcagagggcaagccaggatttgaaatagggaggccagaaacactgctggccaaggaagtggcttggccttgggaagcaagaaggcagcaacctctaggcgccccttctctccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcaggtgcggtgccccagcctggcctctcaggatggttcttagtctctccagggctcacctttccctgatgggcatctgacctggcccctggcctcatgtgccttgattcctcagtagggccccctctgagaccggaggccagacccagcccctcacagcaccatgggagaatgaaatgccaaggctcacaggggaacctgctttgagaacccaaggtttttggccgagctgggtttatctgggttcatgtctttctaatacattcagggctgtggtcgtcactgtcccacatggtaggtcagtgaggaaaactggcaggaggctggggctccccaaggcccctcctctctgcctcccctcaaggccacgcttgcctccctctgaatcctggctgtgagctcagttccaagcctgcactctatagaccagggaaagagcttcccctttggaaccaggcaccaggctcacccctgactgctatcacccctgtttcctgggcagatggcaggaggccagcatggagcctggtgggccagggagggtggggcgtttgctcagtatgttggcggagtggttggagtgacatggccctggaggcctggacactggggctgtctatgggcctgggcctcggccttgagatgcaatgggcctcttgtgcctgtgccaatctcctggtgccggcaccttcccaagggaggatgctggtgtgtatctgtttgctggtgggtaggcgccctcctgcctgacccatctgcagtgagctgtccccgtcactcatttaggagaggggcctggaccagccccagcctggatcgggggagaaatccacgcttgtgtctgaccttagtcaccttattgtcctggctccaagaggccactgaatctcatacccggggcttcggtgattcttgcaggcaggttcccgggcggaatcttcacctgtgtggctgaggagggtttgccagggcgtcagatgttcaaccacgcgcgaccacagcgatgtctgagttaggcctcatggcgggctggccatgcctggcctattctttgctttagatggcagctcttggggccacatttcatcatctaaggatggtgacaggtgcctgccccttcctgggcagtggctgggggtgaaggactggaggggtgggctccctgtcagcccatatcctggagggccttgattgcctgggctgagatagcacagcttcagcatgtttgctcttccttccgctatctgtgcaggccaaggtggagaggctttgtaggggccgggtgtgtcctcccagatagccaggctggggccctggccaaagtgcttttctgaagcaacgatggaaaaaggggagtggaactggtttgtgctgcagtcctggcctgttcccagccccaggctggttttccccacatgcacagcttctgaggaggcctggagcagggagctgggtattttgtgtgtgtgttggtggggggtcaaggccaggaggggtgaggagagagccagagcaggtaagatgccaggttctcaccagggcacctstcgtggcttcccgctcatctcattcctcagatgctactttgtaacctgaattgaaaatgggtcaggtcctggcaagggaggggccaaactgcagaccggctgacgcggtgctgggcctgggcctggagcacggggctcaagttcccactttgtgcgtttggagccaagtggggcctgaaagccctggcagcagtggctggtcccctccctgtcatggcttactggaccgggcagccctagggccttgccccctactgcctccccaggccagctgaggaagaggatgagcagtgcaggctggctcagccctgggtagcagggacagagcaggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggtgagatgctgcccaccgcgccctaaccccacggttccccgccacgacctccggaaggtcagagttcacatccagcggcctcgcagtagaggtggcggcaaggggactggtggtcagcccccgaggctggaggagcctggcctggggggcctragcaccctgagtcggagagcccgcttcaggtatctttggttccaaccatgaggagggcccagcagggggaggctgccagcgagcctcagacctcatgcctgcgatcttccctaccctggtgctcccaggccccctgctcgcagcccagacccttgcctctgcaccccacctaggagagaggcttccccattccccttcctgcccatgggaggggtgtagctcttcccagttggtccctgctcttctgcagtgagtggggcaggtggcaaagccagaggggagcagtgatttgtctttgcttggcccctgccaccttcctggaccttttaaaaatacaccggggtgcgatgggagagaaagtaggcacccgggagctgcgtggatgcagccagctctgagcctgagcctgagcggggttcrccactggttcgcctgccgtctgctctgctgctatcagctgagatgctgctttgttccttggtttgctcagcaactgggagagaggactcagcttctcttgagagcacagtcccagatggcagccgtagattagctaaatgcagttactttgcagatgaggaaactgagacctggggacgttctgagtggatggcagtgtggtctcctgctggctaccctgggcctcaggagcatttgctaggcctaggcacagacagggtggggtgggccttgtttaggcgcaggaggccagggttgtggtggaaaggcccgtccagcctctgcggctctggtgaagctgagcccctgctgagtgccctgcatttgtgctgggagggtggggagaggccggatcacagagaggctggatgcagaaaggaggggcttgggtttcgtgtgtgtgtgtgtgtgtgtgtgtgtgtgtgtgtgtgtgtgtgtccacctttgctgaaaggaggggcttgggatgggtgtgtgtgtgtgtgtgtgtgtctgtctgtctgtgcagccccagcagagcagacaggtggcttgagagcttgtggtggggaggttttgttcacaaacctgtggatgggttttcagaacctggcctgttatagaaagaccatgcagatggatggagccgtagctgtgtggtggtggtaggcggagtgtaaatgctccctttgagatcttgtctggccttggccccgtaatttagcagatgaggaaagggggggcctggaaccatgaaaaggatatcccagatcctgcaaaggatggtagcggaagactcagcaaatggttacccagctggctgggtcgtagctcctcagcgctatgtgctgccgtgccagtgcctgtgtggcagagctggcccctggggcccactctcctgggctgcggaggctgagggatgtgaggcaggccctacaccctgctctccccttcctgggcccaggtgcttgggcctggaggcccttgctgggagctgctgcagctgagaggtgccccgcagctgggcctgactctcctcttgcggctgcccccacattcccagtcctccccagctggctggcgggtgggagagcctgggaaatgagtccgctagccagaggcagccaagcccctgaatcagaatggggttgggacgagggggcacagccagtgcttgctgggctccatcacccccatggagaggcagcttgccaagggtgggtagacaggaggaatcctgccctgggtgcaggtggcagcctcctgggtcctgcccagagcctggccactgacctggctgtgcatggacctgtgccctgcaggttgcacttcccccagctggccctgaggcrgaggctggggcagctgagctgcatgtccagacccgctctgaaactgcgctcctggcccttgaccgtcctctactacctcctgcccttcggcgccctcagaccgctcagccgggtgggatggaggcccgtaagcagggtaagtgtgcacaggcccctgtggctcggacctcccttccgggcaggcctgaggttggggtgcaggagagactgaggtggtggcgagctgtcagaagcagaggtcaccgctacatcttcagggggtccgggtcggaaggttcattggtgggcaaggccaaggcagcttttgagaaggccactacctgggccgcgggtgactgcgagggcatgtcgtgccctgcccactcccctagcctgcctcatgtctgccatttggggctctggttctggaaggaacccagtctggggattcagaaaatggtgtctgtctctgatttttctgtgttcaagcaaaaaagagcttataggtgattttgaacagaagccaaattaattccgggatgccaaaggggtggttcaggatggatggatcctgtttgggtcccttagggtgaggacacccttaaggaacccagaggcatgccccaggaatgggcaagggaactggcttgtcctctcctggtccctagagggcttgctcttgcccttggcttcccaggcaggttgaccccaaggaggaaaccctgttcctgggcctttgacagtcacatgggtgtcatcagagctcaggggcactgaggcaccctggacattagcccaggctcccacctgtgcctgggaagggcctgggctcacatagcccttctgtgtgactgggcatcagctggaagggataagagcagctctctgggagcttaccttaccttggagaggtgttgaaagttggaatgaaatcagttttacaccttggggagttggtgtcttggttgtgtttagagaagcagcagccaccaattacaggcagcttctacagtggcagcagcacctgaagtttaagaggctgccccttcctgggtacctggccctgccggagagctctgggaccatctagtgggacccagtgcttgtccccaggccatcgtctgtcttaggtgctccaggcttccctgaaggaagagagaacagaggggcctgaggggatgacttctctttgcctcctgggaggaaccccaggtgcagatggctttatggcctggctcagtcacagtagaacgttgaacacaagtcctgccgtggggccaaggtggggctcagcagggctgggcttctcagactggctgcatccaggccctcaagagtgctggctggacctgtgggggctgcagaccctgtgtctgcagctcaggcccaggtgacagtgacatcgcagacctgcatctgaaaatccctgttggtgctcagggtatcctccttcttcctgttaagacagagggacacactttgggctgtagacttgttccatgcacttgggagcctcctcctttggtggtctgggatatgggcagtgaccacgggcaagatgcccaccacctctccacacactgtgatattggggtcaccgtggctagggtcacacactgtggttaggatcagatccgtttccgacccccactttaagaagtaagactgctgggcgtctcccgttctgggactggagcagttgctatttgacttttgcatgaaatgatgaaatccactggagttgtatgtaaatccagcactccgtgtggcaggtgcagtctggttcccagtgagaaacagccacatcacaaaagcagcgtggggcacctgggccctggtgtcctccgtggggtgcagattctcccctgaagtgagagctgggctaatgacactacttgggctctctggagctggggcagtgtggtcaactcagccccttgccctgtggcctgcaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggcyaggcagccctgctgctgtgtggctggaccgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggtcagcccggggccagcgtggggggagctgcctctgtgggcttcatatagaggctctcagcttcttggtgttgggggaccaggctccagatcagggtcattgaggccaggagttgactgctttatgcaggctggttgtgggcaggggaccgtggggcccagtcagctcagcatttggagtgacatcggggcaacaggccatgagtccctttgggtcttggctgccatggggtggacacaccgggctctggacrggragtagcggcattccctgcctctgcaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggtaagcaggatctaggccctgccaaagcccaagggccagacctcttgggtctacctgccttgtctgctgtgcggcggatgcgttgggactgaattctagggaggccacagctctggtcaggcctggctctgctgagcagctgtcctgagaatggccgctccacctgccagccagctgaggcttccctccctccttgcactgctggctggaagtggctggaagagatggagggaattaacctccttgcctggcacctggcttctgctaggaaccatggtcaaaggtgagagtgaggagggaacagaaagggagtgttgagctcggggtggctcatgttggttacagcatgaggggtcagcactcgcaggtctgctgcccaccctgcccccaggggctgcctttttgggtgtcagtttgtgaccaacggccttggctcccacgggtgctgctctcccagcaccatgcatggagaccactgggccccactgttccctgtcctccctgggcccagttcacagcaggtgtcaaggctgtgtgtgagatctggctagagcaggcccacctggccctgagatgccatccccacctcccttttggagctgggttgggtggtggtggggacaagcaacagagggagtgggactccaaacacatgtgggggtgacactgtgcacttggtggcctgggccccactgacccccagcctatcaccacaggacctgcacacaaacagcccaaggcacagcaagggctcctacaatgacttcagcttystgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctmccacctgttccagaggtgcagacaagaggtggcgagagcccccrtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtrcctccttggcacagactgtggatgcctctcccccagcagagccacacagccttcgtgacaactgctttccgttcccacattcacctcatcctgctctttagaaaaagcagtytttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaactgtgttctgttcctggaggtggcctgaggcctccccgacagcccagcacctgcgttcctggtgcgaacacgctagcacagggcctgccgcagggcctggatgcgggcaacgcaggcgccaatgggctggcgctgagcctggagctcctctgccagcagctggatctgcatttccacctggggccatggagggacaggcagggctgagagggagcacagcccggggcgtccccagggacacctggggatggcctggggcctcacctgttccagctctttctgcacctgctgctctacttcctggtcctcaggccccggctcctctctgttcagctccagccacctgcgcaggctgctcgcttgccgccgacaggacctgaggggtggagatacccactgcctgccaggctgggtccttggcagagccccatccggctcagggagaggcacctcagctaattctgatgcgggtatcgggtggagagaggtggtctggtagggcccctgacctgaactgcaggcccctgcttgggagccaaacacttgttctttttcctctcccagtctcctccgccctccccagcagacagcaactcaggtgggcctgggcaagaacacactccttgtctctctccccctgtgcagagccaaggatgaggcgccagtctgttgccctggaagctctgaggttgctgcatgttgaatggtccccagaccactgagtgcagctgagtcacgggcctgtctcctctgcatttttttttttttttgagatggagtgttgctgtgttgcccaggctggagtgcaatggcgtgatctcagctcactgcaacctccgcctcccaggttgaagcgattcttctgcctcagccttccaagtagttgggactacatgcgtgcaccaccatgcccggctaatttttgtatttttagtagagatggggtttcaccatattggccaggctggtcttgaactcctaaccccgtgatctgcctggatcacagcctctcaaagtgctgggatgacaggtgtgagtcactgcgcctggcccttctctgcacctttaatatcagtgttataattagtcactggggacagcatggcctcatcgggtttttagagttttgctcaactttatcgtcccccccataggaagcagagcctctgtgcacaggtgagtctgacgacttgggccttcctaagcagcactgagccgggtagagagccatggtggagatggggtctttctggacagcacacactgagggctccccacacccctccatggctagaccgagaccacctacaggaccctggcagctggctcgggggaaatggaactgcctgcccacctctccaggcaacacctgctcctgtagccagggctgcagggcgtttcgcagggctcaccagaggttctgcttggtggtctggtagtgcagtagttgctgctggatctcctcaagttcagcctcaaggtccaggctgcctatggcgacagaagtaagcttgtttcagactattttcccctcggggaccagggtaaatagcaagtcccaggtccgggagtggcctgagtgctttctgccctgacaggccccaggtacacacctgcagttgaaagtccaggcccagccctggtggctgagaagtccccaggaaggagtagatgggggtcagggacactggccagggatgaggggaccgggggcttatccctaggagtagcccgctgtgctgacacctgcaaaggaaagaagggtagatgctgagcaaggaagctaggaggaagccagggagggggacaccaagtccttgtcactgcctgccctgcaggggtgggggaagaccaggctcccagctgcaggagctgggcttcccaggcactggccgtgccagctcagtgtctagcctgcccctgcacacagggcctggtactgtaggggaaagtcccgcaagcaaccagggagcaccccgtgtcaccacagtccgcctcacgcctccactgcctgagcagctgttcctagccttgccttacccaaccctccacccccacctgctctaagctcatgaccttgctgagctttgacatcagtgagaagtggtcagtgagaggccactgctctacagccttttccatgccctcctctcctggtgagagtggacttgccccttccatcaccggacaggggtcaaaaccctttcaaacccacattcaaaccattccagccagggtaagtggccccacatggcctaactcaccacaggaactggttccttcctgtcccctcatcccctttcaggaaccagctgctttggtggccttagagcagctgtcacttccattactgagctctcacaccccctggccatccccacccaggctccctgcttggagcctcctcccctctctccttcccctgtactctcctcctagaggccgcagtggctctggggttaccttcggcctgtgctgaagattcttctcaatctctggccctgacctcttccttgaaggtcagactcaacgtttgctttctctcaaatttgacatcaagagcctggttcaaaacactcttgacacttcaccccaaaccagtccccacccccagttccttcttccagtcaaagaactctgtttcccaagttattcaagccagcagcccacatcagcctggattccttctttcccctcattcagcaactccctcagagcagcatatcctgcctcatctgcctccaagagagtacctgtcccctctgtggcaaccgctgagcccaggccaccagtactacttgcctggaccacgtggtcatggtgaccacagcctgcacagaaacctgacatggtgctccctgccaaaacccttccccgacttcctactcttctcaaatcccaggctacttctcactgtggcctgcaggaccctacgtgatctgcagccactttactggcctgcaggcaggggtttttctttgcttgtctctgactagaatataagcttcaggatggcagggcccttggctggctgttcactgctgtggcccttggacctggtgtgcagtggctacctatgcttgtcaaatggatgagtggcctccctgtgccaaggttttccagaaactagtacagctgtggcatgagaaagcaccagaagtcagaccagagtgagagccccagtgcccaggcctggtggtggaggacgtaccctggctggtgcagccgccccgcagggcatgaaggaggaaagaggcagcagcagcagctccgggcctgtgcttgccgtcgggggctgcttcgggccaggggcgcttgacagggccccaggcagggggctgtgtgggaccagtgctgtcggggcctctgccaggaagggccgcgtcagggagggggctgctggctgagccatgcctaggccatgttcctgtggcttctgaggcctgagcacagggaaggcaagagcctggtcaggccacaggaccctcctctgggaccaaagaacaagaaggaaagggggccacccaccccagggctgccaaaacacaggccccacatggaggtgcccgctgcctttggggacccctgaccatctccccctgcctgcccacggtgctgcaccccagggacctctggctctgcgcaggctccaacaggaagtgtgggcgtcgcggctgcttcctcgctgagtgggcagtgttgctggaaagaaacatggggtctgttcccctgggctgaccaggggctgcaggggggtctgagatctctgtgggatctccaattttatagggagactgaaagtcaggaaaggcgaggccaaggtcagcaagtaagctggggtgggcctgggccatagagctcccagcagttccgacaaaaggtacctgacgccaggggactgcttcacccacattgtctcttttgacctgcagaacaaccctggtgacgctggtgtacaggtcgccagggtccatgtcacaggggagcagcctctgagacgttcaggatcccatcaaggtcagtcaaacagtgaggagcacagcagggaccgggacccaggccccatgcacccacctgacatctcccccgaggcccaaggctctcgggtagtgctggttgctgtgggagccaccagcttcatcagcatggggcagggcaggttagggtttgaggagaccatagtaggggtgggcagagggacaggtgccagctcacacaagaaagaggggcttctgacaaaaagccagtgtcttggctgtgatggagcagaagagaggccggcaggcacgggtaggagctgagcttgttccctttgtcaactacgtgtatgactccggaaaagatcgtgtcagcaggacgggagagagggtaggaaggtgttgcagaggaggggacacctatttcctgagctttggcaggcaaaggagagagggtttggaaatcccactccattctctccctcttgccgtgggagggatgggatctggctggagaagagggggttcccagcagctcagctgtgacaaggccgtgaccagcccgtcccatcccgtcagggctgttttcctccctgctatgccatccaaccttttgcccagggtggaagcgaggacaaggtgagcacaggctactcacagctccagggcgtggggctcctcagcagccaggcggcccagagctcccagaggccgagaagcctgtggcctcttggtctcaagggtgccatccccagccccagcagcaatgcggttgagaaggggaccctcaaacgtcactttcctgctgggtgcgatggctgccaggggctgaggcttcccgccccggcccagcactttctgtttccagagcgtggcacagcggcggacggcacgatggagactgtgagccgcctacaacacagcctctggtcagctcatgccacaccctgcctgctccccacaggaaggggccctgggcctacctggacctgctgctgggcctgcagctgctgccgggaggccttcatgctggctgcaaagcgcaggagccgcgtggcaccctcctggaggagctgcccctggtaggcctggagcgcccactgcagccgcgccttctttctcctcctttccagtacaaaggccagccacgtggcccacacctccagggagggcaggaggtgaggcccaggtctccctgcttagagctcccccacagaccaggtgccctccctccacccaaggcagggctaaggcctgagggagaggcagggatggtaggatgcagagccccaattacctttgcctgcagcgagaaggcccagaaccacagggcccgcactgtcgcccgctgctcctgcctcctggctgccagctagggccagaaagaccagatcatttccctatagccccttcaaggaggccgtggtgatcacggggccctgcccagctcgtccctcttggctccctctctagtcgaggctcccacttcctccactaggaagggccagccttgtgcctggcggtgagatgctcaacacacgctccatctgtggcctgaggaatgaccttcatgaaagaaggtggcaaagggctcctgcagggggatgcgtggaggcagcggcctgaggtccggggaatggtgaaaacaggacaacagaacgggaagagggagctggggacgtgtggatgctgctctgtgtgatccctcttggctttttaaaaagcaagatcccagcaaagccttaaaacacatttcatgttaatttttaagatattatgctgatttttctttttgagatggaatctcactctcatccaggctgaagtgcagtggcatgatcacagctcactgcaaccttgacctcccgggctcaagcaatcctcccgcctcagcctcccgagtagttgggaccacaggtgtgcactgcctacacccagctaatttttctgttttgtttttgtagagatggggtctcactatgttgcccaggctggtcttgaacttctgggctcaagtgatcc

SEQ ID NO: 10657 - DNA, 12885 bp, Homo sapiens
gcaactatctacatttttttccaaatatttttgatctgtggttggctgaatccagggatgtgcccacagatgcagagggccggctgccctttcctatctgtgatgatgaacatgagaatagacagctggagaaactggttctgttgccatcatttctcctttctaatcttgggtttaatcataatgcagtgggacatgacataatgtcttgtaccctaggccaactttatcaatttgcttagtttcaccagaaatgctgcatcgacatgtgttcatatatactttcagaggtgtcaatctgtttttcgtctatacccccactgttgtcgatacagcaaatggtaccactactgtgccaactccagaagcacaggaaccacacttaaacacactatataaatttcatgtgtttacctagagcccagagagcctttctgctgctgactgggtaagactagaccagcctgaacaacacggtgaaaccccatctctactaaaaatacaaaaattagccgggcgtggtggtgcgcacctgtaatctcagctactcaggaggctgaggcaggagaatcgcttgaatccgggaggcagaggttgcagtgagccgagatggccccactgtactccagcctgggcgacagagcatgactgtctcaaaaaaagaaaaaaaaaaaaaaagaaagaaattagactactgcttgtgggaacagcagtagcacattcctgttgctttaaccctttatcaaataggccaaacgttaataagcacctgccactgaaaaaaactaaatgcttttgtttcttagctttctcagcaagaagtctgagtatggtaacatccctaccttctcacggtcccttaaagaggacggaaagttgaggtgtttttaacatcatcccattccatcactacctttatggggagttgagatgggagacttggtcccctgagttcttcatctttccctgggcaactacatgttactacgttttctttccactggtctatgaagaagtaaacattagcttcatcaatatacataaatggtcagaactcaaagaactccaaatgaagaaaattcaccctggtagaaggttatttcagcatacattttgtaaggcatcttcagaatagcactagatgcctaaagcacaaatggaccttttccaagaatctggaaggaaccgattctaaatgtgaaaggccaaaaattctgtgtctgattgcccaagcccctctgttggtctttggtctagaacacatcagacaaataaagcaattcctgaaagcacactacctcactctgccagccacccccactactgaggaacagctctgctctcactgcagatacacatctatacatttgaatacatatatttttatgcttgtattatctttgcagataaaattagcaaatacttctcagaaagctctctgtagctcattgtgctctggtcgttatgcccaaaattattgggtttgttcctttttttttgaaatagagtctcgctctgtcactcaggctgcagtgcagtggcgcaatcactgctcacagcagcttcaacttcctgggttcgagtgatcctcccatctcagccttccaagtagctgggactacaggtgcaagccaccacagctggctaatttttgtattttttgtagagacagggttttgctatgttgcccaggctggtctcgaactcctgggctcgagccatctaccagcttaggcctcccaaagtgctagggttacaggtgtgagccaccatgcccagcctgtggttgttcttaaatgctatctttatgtaactttattctctcttcttgccaccttgtttttgtctttcataaaatcactctctggtgatgattattatgcctaatactttgttccttttttattttttattttattttattttgaaacagagtgtcactctgtcgcccaggctggaatgcagtggcacatctcagctcactgtagcctccacctcccaggttcaagcaattatcccacctcagcctcctaagtagctgggattacaggtgcacaccactacacctggctaatttttgtattttttagtagagacggggtttcgccatgttggccaggccggtcttgaactcctgacctcaggtgatcgtcccgccttggcctcccaaaatgctgagattacaggcgtgagccagtgcacccagctctgtttgttccttttctgaaaggacgaaatgaaggtatataaagttcttagcacaatatgtagcacatagtaaataattaataaatgttacctattattattttaaaataaaactgagatggcagcatggtataatgattaaaagagaagactctggagccaggctgcctgcatttgaatctcagctgtgaccttaattagttgtttgtgagtttggacaatttctatatcttctctgcactcagtttctccatctgtaaaacggagatagtcattgctcctatctcatagaggtgaatgagttacgatatgtaaatatttagaactgtctctgccacatagaaagcattctagaagtgtaagccattattttttcttcctttcaatcctgactgtccacaagagggttaatgtttttttctgcattctacactttcgtcctctttatccaaggttcttattttactttaatatttgatcaaattttacatctattctgtatttgaaagacactaagattttgtttaataaattttcagagtactagtaataatttttataatctacaaaggcactaaattccagtaagaaaaaaggcaattaacaagactagatgttcccacaagtaccatgttatgacatttaatgcagcagcacctgaaatcccaaacgcaaatgttattacgaactgcctaacttagatctagtctttccttggcacgcaagtcagcaacaaaaaaatggaaatgaagacaagtatatagcacttacaagaaaattaatttcacctttcttctcagactgtgagatagtctgctcactccttctggagactggtgtggtcagaactgaacgctttacaaataatatttttaatatatcagatttgaatacttcattaacaggaagcacactggttttatcccacaaatatttttaagagatagtttacactattctgagtagtaaggtgaaaaacatgagcacatgctgaatgtactaatggccatatttcaacacagtcttacttttggaatttgacctatttaaaaaaaataataggtaggcacgtaagggaaaacatttcttttccaccttcaacattgcaaaacatcacattgttaatgtttatatattaaacactaatcagaaacagaacactttgccaatgctgctaccaaaatgatgattttttaaaaattaattcccctcttgctttaaaggaaattcttgggatacatatgcatcaaaataacaatcggcccaattaagagcacagtctttggagcagtttgcaatcccagctctgccattgctggttgtatggtcttgaaaaaattacatggccttgtgcagctgtatctccaagattccttttcctcttctgtacaagacttcatgagtttgataggctttttgtgagaatttaatcataaaatccattaactgtataatatagtgtctgggacacaataagtaaacaataaatggtgaaattaaatgatatatgaatactaggtatgtccttattaatctgctcctttgaataataatttctgccaagctccttagcataactctcccacacaacacacagagtgcttcaaaaaggaaaacagaactctaagaatacgaatttccaatccattttcttgcctgaggattatagaaccttttatactttattaaacttgagggggctcttcttgatcagatttcatcacatattttcttccattgaatgtgttttgggttctcagcaccagatggaaggcacaggcggagaaacactggccccaagaaagctcccagccagccactggcatctccatacctaacccaaactgatctctgcctgaagctctccaacttcagctttccttcctacctttctatcttaggctctcaaagatggtgatgatggagataatgacagcagtgaagctgattgtaatgttaatgatggcaactaagaattattcaccatttattctgagccagacactacaagcaacatgcaatcaacatgaaaatcattaacaagacattttgcattattttttctgtactgtctctaaattccaatgtgtatgttacacatccagcacttggcaattcggactttgtacctattattcatttaatcctccccacagtcataagaagtaggtactatgatcaactctacttggcacataaagaaaccaaagcttagagaagttaagtaacatgtccaatgttgcacagtgactttgtagcagagagccaatttgcaagcagatcagacactaaccagggcctttattcttaacccccaggtgacaccgaccccgcagttgcttgcaagactgcctgtaggattagtccgggtctcggccactcaccccagatcaaccctgcccaaccccatagtttctaacatctttctgccccagtcacacttcctgatctaaaattcacaaagacagaggatcaggagctatagcaaataatacacccatcagtaacttcagtttgattccctatactccttgaatgaattacccctcctggcatgcaacagctatgaaccttaatgtagaaaaaaattcccatagggagatccctgatatacttcatgccttgtttttgcttttttttttttttttttgtctgttttttgagacaaggtttcactctctcacccaggctggaatgcagtggcatgatcacagctgtgatcctcctgggctcaagcgatgctcttgtctcagcctcttgaatagctggggctacaggtgcatgcaaccacacctggctaatgttttaaaattatttttttgtagccacaggggtcccactatgttgcccaggctggtctcaaactctgggctcaagtaatcctcccatctgggcctcccaaattgctgggattagaggtgtgagccatggcacccagcctctttatgccttttgactagtaccttttggcctccaacattaatatgcaatatacataaataattaaactcattttacagatgacgaaatagtaaggtaagagaaacagtttgctggcagtcacgtatcaagtggaaataaaatcgtcaataaagctcgatatgccctctagaagaccttatcgccttgtttttctaggcttttaattccttgttcaaacctcttcacacactaacagcacaaagatgaacctacggtggaatccacctttcacaggctcagctaagtgaagattaacaaatcggacagccctgtgggcaatagaataagttgacactttagaatgagtttcctattatcttttaactagacagtctagctttctcagggcaagacaaaaatgtcccaattacttgtcagcagtttttagtggaggaaaaactgcagttaaagcacctttactgagaactttgagcagtaaatgtgcttacatatttagtttgtgcaactttgattaggaattggatggtgagttgggatcccccagtccttagctttttgctggagttctgtaaatctcaaaatgtcagccacaggccatttcttttggtttatttaagtgtagattttttaaaaaatcactttttccacttcatggctcctttggaccagggtataaaaatagcgatgccaccaggagccaagctctttctggaataatgaagcaggcgaggacggagccttgctcaggacgacagaaggcttgcagcctgcctcaaacgcaactctaatttcagccacttcacttcttccccccgcgctcagacttgcctcaaaggaaggagccgtttatgagacactccgtggcgcgcccaacacggttacccaggcgcctatcacccttctgggacccggccacctgtaagaacctggagggcggagcgggcgaggttgttcggggaagggatccccggcggctgaggacatccaggagcaccgagattcttggggaggacctcgccgggcccagcgcaggagccgccgcgcgtccagcggctccaccgccgcagcctcgggaaccgggcgccccaggtctcaggcgcgccccgccgcggacgcgaatggactcgtccggcctcggcccctgcagcgaagctccgcttcacaccagcgctgggctgtccggccgcaacctgcgcgccgcggggggcgtcttacctgttgatcttgagcgcgaacgcgcggcgctctgcgctcggcagagtggccatggcccgccggcggttcggtggcttctagggtcgcggggtgcggaaagcgggggcctggcgcgccgcagagtagccgcggaacatgcccagccaagcgcaaacctcgtctgtcggtcggcgctggaaacttccgcatttccaccttctaagccgaaatcaccccgggggagggtccgagctcggagcagcgacggccggctccgccacccggcctggcgcgcaggcagcggcgggcgaggagggcgtgggcccagcgcggaactggcctccsgatactggggcagacggcgcgctctgcccggggccgccgacctccggccgaagggagcgcgggcggacgacaggcgaccactgcgcgcaggccggaagctccatctgcccgaagctgcgaggctgccagggaatgtaggcaagtcgggggagccccacaaagctggcgaggtcgggaatcaccccagggattcgtaaggctaggtgttattaagggttgacaccattctcgaagaaggcagccaaaaaaaaagacaaaaaagttagtggaatctatcaggattcaaatcaacttttgcaagcaatatgcccatcatccttcctgagacactaaataaatataatggattcatccaaggaataaacattatgagttctcaaaaaatgttttcgtcacaacctggcgtgaatgcttttctccggagaaacactgaaggcggcgttcttgcgattcaagggtacgctgcgtccaggtttatttcagtttcagactgaggtctgctaagaagcccggcctcaaactcaagataaaaacagaaaagtcccagtgttgacgggagtggaggagcccgtgttcgcttcaaggtgccggcgtgctgctctaacctgtgctatatatactcgagcactctccatataatgcctccatttaccaacttgctcttaaaaaataccaaagcaggccgggcgcggtggctcacgcctgtgatcccagcactttgggaggccgaggcgggcgcatcacgaggtcaggagatcgagaccatcctggccaacgtggtgaaaccccgtctctactaaaatacaaaaaattagccgggcgtggtggcgcacgccttagtcccagctacttgggaggctgaggcaggggaatcacttgaacccgggaggcggagcttgcagtgaaccgagatctgccactgcactccagcctggcgacagagcaagtctccgtctaaaagaaaaaaaaaaaaacaaccaaagcgaagtatttttggttcaaacctgcactatttaatatgatagccactagccacatgtggctattgaccactcggcattatggttagtctgaattgcccactgctggatgtgtaaaatgtacactggaatttaaagacagcgcagaaaacatcgtgtaaaatgtcttgttaatgattttcatgttgattgcatgttaaatgatactttggatataaaaaatatattattaaagttaatttcacctgtttgttttccccttttaaaaatgtggtttgcatttttaaaaatgtaaaattacacatgtggctcacatttgtgagcctcattatattcctattggacagtgccagtccaatacaacctaatttgtcacctaatactaaaatccacctaaggactatattcagtctcttcctgatacagccttccttcctggtttcagctgtgtcaggtagtttagtaacttttcagtactggttaggtaactccccgccccccaatgcccaccaaatatcagtgcccttttaagcatataagacaaagttcactgcatagactacaatagactacatacgaaaacaaacccaaagaaaaataaagcttttttgaaatttagagtttctgactttcataactgtccttatttactacattggaatttatgagcaaacatttggatagcaaaatacaaagagaacaaatgtgtaagtacttcttcaaactgagactcaacgaatgatacatagaaaacattttgccccagaggcttcggtccacggtgtaccatgtcagcctttcggatgaactcctctgaatttctgaatgtttatgacatacattttcatatagaacaaaaatatactggtttcacacaaacataaataaaatgtaatgaaagcatctcagattttcagcatttgcaatcaaggaaactttttgggtgaatgtgggaatcataaaaccttccatcttgcctcagatcatactgcaatagatttagtatttggtacctaaccatgaaggttaggccagcattattatcctctgtgctgtcaatttcttgatggttagaattgtctccagatttccttaacactcttttaacaattcaccatgaatgtgttatccattaatttagtcaaatgcctgttttcaagtttgatctgctgttagatacattcacatattgctggcaaatagccatccaagtgcctttcttccttattctcactgcctctttcgttttccatcagccctctgtccagagagaactctgggaggcctccttctttccgcatctgatggtctctcttggccttcctctttctccgtatctttgtgtcattcaattttgtttttcacctttatacaactcttcccttgacttctatctcagaccatacatcaattatcctaaatgctctagttttccccacatcttcttcttacctccccagaaagccgacctctttctctacattgcatcttacctattttattgaacaaacaactaaataacacttatcttgtaccgggtactgctccaagtcctttataaaaattaattcatagcaaccattaaataataacattaacccccccacacatacctctttgcaactggagaaactgaggcttagagaagttaagtgacttgaccaagattacaaactagtaagggcagagccatttcctatcctaaagttttgcctatttcccagatttctgtactctaacatcttcaaactccagtataaaactaaaattctccatctaccctacttaactggaagctagctatctctccataatcacacattttttggggggtcggtggtggcacactacttcctcattttccaggtttaaaactttggagtcatccagtggagggaaaagcaggaaatctgggttctggcttcagctttttgctaattgtgtaatcccgagtaagtcacacggtctttggatcacagaggcctgtatcttggaatgactccatctgcttgcctctctctgaactttagaaatacgtcagctctaactttttttcctcctgtgtccttcagatctaatcacctaccaaggtctgccatttatttcttataaatatcacttctttgtaaatatcactgttctcacagtggctttcattccggtccagcccttataaattaatacctagataacaaaaataagattttaaatggcttcactgcctgtagcctcttctttctcctatctcatctgtttctatcactagatgaagtttactaaaatacctgtttcaccatatttcttctctgctcatttagctttggtgacttcctgtagcctctatgaccaagcgtgaccttttctagctagctcgtatgcccacttcacaaaaccagctttattctttacctttctgttggagcagggaagatctccagcttgtccctaaagcaggcggtgctcctgtctgcccaggccctcttcctgcttacgttatccttcctgctgtcctcgcctcgcaccacatccagtctctgcccatccctcagggtctgagtcaagctaccatgctccatctctattggatggagtgtctctttcagtctgacagcatcatttaattaattaaaagtgtgggtcattaccaataaacacagcgcagtggaatgcaagatcctgaggacaggactagagaggaaaaaaaagtgtgatcattttcatgtcccttccttcttccccaaaaccacgcaggacctccccagatttagttcaaatgtcaccttccaagaacatctagttaacatgacagtgcccccttcccttgtcctgacactttctaactccttttccaactttgtttttctccatagctgttatgaccatctgacatactatatattttatttatttgtttattatctcttatgcttctagaataaaagttccatcaatgcagaggtttttgtttggttaatttgtgctctatctctactgtctagagccctggcatatagtaggtgctcaaaaagtatttattgaataaatgaatgaataagtgaacttgaatgggaatggccaagtttcacttgtctttcaggagacaatgacagtttttacctttttattctcttattttagttgtgcctttttatgaatatctttcaactctgttttgtatttgtttcttggtttgaaaaatcaaaccagcaagtagatatctttattgttgtcttacaattggtgaaacatacagaaagatttgagtgcaggtatttaaaaccagccatactttagatattagaatttgtagctcctaattttcttcacgtcattccttgttttgtcataaaaaatctttcaatatgaaaagaacaaagattagcaaactttcctttaaaaattatcattgaggccaggcacggtgactcatgtctgtaatcccagcactttgggaggccgaggcgggcagatcacctgaggtcaggagttcgagacgagcctgaccaacatggagaaactccgtctctactaaaaatacaaaattaacctggcatggtggcacatgcctgtaatcccagctactagggaggatgaggccggagaatcgcttgaacgtgggaggcagaggttgcggtgagccgagatcacaccattgcagtccagcctgggcaacaagagcgaaactccgtctcaaaaaaaaaaaaaaaaaaattatcattgtgttttagatatatacacatacagattttttatattttatatataactttaatatacatattagtgttttaaatatagcatttagaatatattcaaatgtacaatgctattgcatattcagtaggaatatttgtaccatagcattttataactaaaagaattttggattaattcattaatgagtgaataagttcactctatcatctgtgtgtcttctgttcgttcttccagacctttaccaagtggttaccatatgtcatgcactgggctaggtgatagtaggggccaaacaaaaaatagttgttccctgacttcccagaactcatagtccaggaatgagacacacgtaaagaaggaaagaagaggctcaggcccaggaacattttgccatataacagcctgggcaagtgaggaagcacagagaggaaatgacttgttcttgggagagggtagtggcagagagattgacgctgaggaagaatgactataccgacgctgtaaccgtggaactgggtcttaaacaagttcatgaggcagaaggagcacttgtgcaaaggcagggagacaggggacaccgcaacttatcctgagaactagaagaatgatgggagcccgggggtgcggagtgaagtgagtagcaaaaatagagccttggaggtgggcagggtctgagtgtgatcgagcttgatctcacaggctgttgacacccgcacacggcgattgctgtttctgtatctaggtcatagtctcttgggggaggccttgccaccggctgtccacagtgagggtgctgctgatcccagtagaacatggcagcagagggtggggaacattatgtctcctagacctggcaccgtcagctccacctttctcaacctgagctcacatattggacactaatgcaaaatacatagttctttagggaaaaatttaggcaattttcccaaagtcatatctcacggagagaaaaataaattacggggacagagagtcaagagatgattgtgtagtgtggtcatttttgtccctcatttgagtgcctacgtgcctctggtcactgcctcactcctgactcccaacttccccctgcacttccctcaggcctctctatttacccactgccccatcagtctgtcttctcctccctaaaccttccattgcacatcctttgtctagttcttatgtctggacaatttcccaggcagccaccaaatcttgtgaactcccctctccaccccttccagtttctgctggccctacagaggggaaagttgggctctgttctatgcttgggggagatccagtggtgggcttctattccaggctgtggataacattcttctatggaaaaaaattaatttccttctgaagacccccatcaaatatatatgaaaaaatcatattcttcccattcatttatcttgaccttacttcttataggttataatattggcctcactatgctaagagagaaactcctgcccacccccgcccc

SEQ ID NO: 10658 - DNA, 265113 bp, Homo sapiens
  misc_feature (1)...(265113): n = A,T,C or G, or insertion/deletion polymorphism (see Tables 1-2)
gaggaaatattccaacatgctgacagctttgtaatgtgcctagaggtgaggggcgggggtgggcaggagtttctctcttagcatagtgaggccaatattataacctataagaagtaaggtcaagataaatgaatgggaagaatatgattttttcatatatatttgatgggggtcttcagaaggaaattaatttttttccatagaagaatgttatccacagcctggaatagaagcccaccactggatctcccccaagcatagaacagagcccaactttcccctctgtagggccagcagaaactggaaggggtggagaggggagttcacaagatttggtggctgcctgggaaattgtccagacataagaactagacaaaggatgtgcaatggaaggtttagggaggagaagacagactgatggggcagtgggtaaatagagaggcctgagggaagtgcagggggaagttgggagtcaggagtgaggcagtgaccagaggcacgtaggcactcaaatgagggacaaaaatgaccacactacacaatcatctcttgactctctgtccccgtaatttatttttctctccgtgagatatgactttgggaaaattgcctaaatttttccctaaagaactatgtattttgcattagtgtccaatatgtgagctcaggttgagaaaggtggagctgacggtgccaggtctaggagacataatgttccccaccctctgctgccatgttctactgggatcagcagcaccctcactgtggacagccggtggcaaggcctcccccaagagactatgacctagatacagaaacagcaatcgccgtgtgcgggtgtcaacagcctgtgagatcaagctcgatcacactcagaccctgcccacctccaaggctctatttttgctactcacttcactccgcacccccgggctcccatcattcttctagttctcaggataagttgcggtgtcccctgtctccctgcctttgcacaagtgctccttctgcctcatgaacttgtttaagacccagttccacggttacagcgtcggtatagtcattcttcctcagcgtcaatctctctgccactaccctctcccaagaacaagtcatttcctctctgtgcttcctcacttgcccaggctgttatatggcaaaatgttcctgggcctgagcctcttctttccttctttacgtgtgtctcattcctggactatgagttctgggaagtcagggaacaactattttttgtttggcccctactatcacctagcccagtgcatgacatatggtaaccacttggtaaaggtctggaagaacgaacagaagacacacagatgatagagtgaacttattcactcattaatgaattaatccaaaattcttttagttataaaatgctatggtacaaatattcctactgaatatgcaatagcattgtacatttgaatatattctaaatgctatatttaaaacactaatatgtatattaaagttatatataaaatataaaaaatctgtatgtgtatatatctaaaacacaatgataatttttttttttttttttttgagacggagtttcgctcttgttgcccaggctggactgcaatggtgtgatctcggctcaccgcaacctctgcctcccacgttcaagcgattctccggcctcatcctccctagtagctgggattacaggcatgtgccaccatgccaggttaattttgtatttttagtagagacggagtttctccatgttggtcaggctcgtctcgaactcctgacctcaggtgatctgcccgcctcggcctcccaaagtgctgggattacagacatgagtcaccgtgcctggcctcaatgataatttttaaaggaaagtttgctaatctttgttcttttcatattgaaagattttttatgacaaaacaaggaatgacgtgaagaaaattaggagctacaaattctaatatctaaagtatggctggttttaaatacctgcactcaaatctttctgtatgtttcaccaattgtaagacaacaataaagatatctacttgctggtttgatttttcaaaccaagaaacaaatacaaaacagagttgaaagatattcataaaaaggcacaactaaaataagagaataaaaaggtaaaaactgtcattgtctcctgaaagacaagtgaaacttggccattcccattcaagttcacttattcattcatttattcaataaatactttttgagcacctactatatgccagggctctagacagtagagatagagcacaaattaaccaaacaaaaacctctgcattgatggaacttttattctagaagcataagagataataaacaaataaataaaatatatagtatgtcagatggtcataacagctatggagaaaaacaaagttggaaaaggagttagaaagtgtcaggacaagggaagggggcactgtcatgttaactagatgttcttggaaggtgacatttgaactaaatctggggaggtcctgcgtggttttggggaagaaggaagggacatgaaaatgatcacacttttttttcctctctagtcctgtcctcaggatcttgcattccactgcgctgtgtttattggtaatgacccacacttttaattaattaaatgatgctgtcagactgaaagagacactccatccaatagagatggagcatggtagcttgactcagaccctgagggatgggcagagactggatgtggtgcgaggcgaggacagcaggaaggataacgtaagcaggaagagggcctgggcagacaggagcaccgcctgctttagggacaagctggagatcttccctgctccaacagaaaggtaaagaataaagctggttttgtgaagtgggcatacgagctagctagaaaaggtcacgcttggtcatagaggctacaggaagtcaccaaagctaaatgagcagagaagaaatatggtgaaacaggtattttagtaaacttcatctagtgatagaaacagatgagataggagaaagaagaggctacaggcagtgaagccatttaaaatcttatttttgttatctaggtattaatttataagggctggaccggaatgaaagccactgtgagaacagtgatatttacaaagaagtgatatttataagaaataaatggcagaccttggtaggtgattagatctgaaggacacaggaggaaaaaaagttagagctgacgtatttctaaagttcagagagaggcaagcagatggagtcattccaagatacaggcctctgtgatccaaagaccgtgtgacttactcgggattacacaattagcaaaaagctgaagccagaacccagatttcctgcttttccctccactggatgactccaaagttttaaacctggaaaatgaggaagtagtgtgccaccaccgaccccccaaaaaatgtgtgattatggagagatagctagcttccagttaagtagggtagatggagaattttagttttatactggagtttgaagatgttagagtacagaaatctgggaaataggcaaaactttaggataggaaatggctctgcccttactagtttgtaatcttggtcaagtcacttaacttctctaagcctcagtttctccagttgcaaagaggtatgtgtgggggggttaatgttattatttaatggttgctatgaattaatttttataaaggacttggagcagtacccggtacaagataagtgttatttagttgtttgttcaataaaataggtaagatgcaatgtagagaaagaggtcggctttctggggaggtaagaagaagatgtggggaaaactagagcatttaggataattgatgtatggtctgagatagaagtcaagggaagagttgtataaaggtgaaaaacaaaattgaatgacacaaagatacggagaaagaggaaggccaagagagaccakcagatgcggaaagaaggaggcctcccagagttctctctggacagagggctgatggaaaacgaaagaggcagtgagaataaggaagaaaggcacttggatggctatttgccagcaatatgtgaatgtatctaacagcagatcaaacttgaaaacaggcatttgactaaattaatggataacacattcatggtgaattgttaaaagagtgttaaggaaatctggagacaattctaaccatcaagaaattgacagcacagaggataataatgctggcctaaccttcatggttaggtaccaaatactaaatctattgcagtatgatctgaggcaagatggaaggttttatgattcccacattcacccaaaaagtttccttgattgcaaatgctgaaaatctgagatgctttcattacattttatttatgtttgtgtgaaaccagtatatttttgttctatatgaaaatgtatgtcataaacattcagaaaytcagaggagttcatccgaaaggctgacatggtacaccgtggaccgaagcctctggggcaaaatgttttctatgtatcattcgttgagtctcagtttgaagaagtacttacacatttgttctctttgtattttgctatccaaatgtttgctcataaattccaatgtagtaaataaggacagttatgaaagtcagaaactctaaatttcaaaaaagctttatttttctttgggtttgttttcgtatgtagtctattgtagtctatgcagtgaactttgtcttatatgcttaaaagggcactgatatttggtgggcattggggggcggggagttacctaaccagtactgaaaagttactaaactacctgacacagctgaaaccaggaaggaaggctgtatcaggaagagactgaatatagtccttaggtggattttagtattaggtgacaaattaggttgtattggactggcactgtccaataggaatataatgaggctcacaaatgtgagccacatgtgtaattttacatttttaaaaatgcaaaccacatttttaaaaggggaaaacaaacaggtgaaattaactttaataatatattttttatatccaaagtatcatttaacatgcaatcaacatgaaaatcattaacaagacattttacacgatgttttctgcgctgtctttaaattccagtgtacattttacacatccagcagtgggcaattcagactaaccataatgccgagtggtcaatagccacatgtggctagtggctatcatattaaatagtgcaggtttgaaccaaaaatacttcgctttggttgtttttttttttttcttttagacggagacttgctctgtcgccaggctggagtgcagtggcagatctcggttcactgcaagctccgcctcccgggttcaagtgattcccctgcctcagcctcccaagtagctgggactaaggcgtgcgccaccacgcccggctaattttttgtattttagtagagacggggtttcaccacgttggccaggatggtctcgatctcctgacctcgtgatgcgcccgcctcggcctcccaaagtgctgggatcacaggcgtgagccaccgcgcccggcctgctttggtattttttaagagcaagttggtaaatggaggcattatatggagagtgctcgagtatatatagcacaggttagagcagcacgccggcaccttgaagcgaacacgggctcctccactcccgtcaacactgggacttttctgtttttatcttgagtttgaggccgggcttcttagcagacctcagtctgaaactgaaataaacctggacgcagcgtacccttgaatcgcaagaacgccgccttcagtgtttctccggagaaaagcattcacgccaggttgtgacgaaaacattttttgagaactcataatgtttattccttggatgaatccattatatttatttagtgtctcaggaaggatgatgggcatattgcttgcaaaagttgatttgaatcctgatagattccactaacttttttgtctttttttttggctgccttcttcgagaatggtgtcaacccttaataacacctagccttacgaatccctggggtgattcccgacctcgccagctttgtggggctcccccgacttgcctacattccctggcagcctcgcagcttcgggcagatggagcttccggcctgcgcgcagtggtcgcctgtcgtccgcccgcgctcccttcggccggaggtcggcggccccgggcagagcgcgccgtctgccccagtatcsggaggccagttccgcgctgggcccacgccctcctcgcccgccgctgcctgcgcgccaggccgggtggcggagccggccgtcgctgctccgagctcggaccctcccccggggtgatttcggcttagaaggtggaaatgcggaagtttccagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggcaagtctgagcgcggggggaagaagtgaagtggctgaaattagagttgcgtttgaggcaggctgcaagccttctgtcgtcctgagcaaggctcygtcctcgcctgcttcattattccagaaagagcttggctcctggtggcatcgctatttttataccctggtccaaaggagccatgaagtggaaaaagtgattttttaaaaaatctacacttaaataaaccaaaagaaatggcctgtggctgacattttgagatttacagaactccagcaaaaagctaaggactgggggatcccaactcaccatccaattcctaatcaaagttgcacaaactaaatatgtaagcacatttactgctcaaagttctcagtaaaggtgctttaactgcagtttttcctccactaaaaactgctgacaagtaattgggacatttttgtcttgccctgagaaagctagactgtctagttaaaagataataggaaactcattctaaagtgtcaacttattctattgcccacagggctgtccgatttgttaatcttcacttagctgagcctgtgaaaggtggattccaccgtaggttcatctttgtgctgttagtgtgtgaagaggtttgaacaaggaattaaaagcctagaaaaacaaggcgataaggtcttctagagggcatatcgagctttattgacgattttatttccacttgatacgtgactgccagcaaactgtttctcttaccttactatttcgtcatctgtaaaatgagtttaattatttatgtatattgcatattaatgttggaggccaaaaggtactagtcaaaaggcataaagaggctgggtgccatggctcacacctctaatcccagcaatttgggaggcccagatgggaggattacttgagcccagagtttgagaccagcctgggcaacatagtgggacccctgtggctacaaaaaaataattttaaaacattagccaggtgtggttgcatgcacctgtagccccagctattcaagaggctgagacaagagcatcgcttgagcccaggaggatcacagctgtgatcatgccactgcaytccagcctgggtgagagagtgaaaccttgtctcaaaaaacagacaaaaaaaaaaaaaaaaaagcaaaaacaaggcatgaagtatatcagggatctccctatgggaatttttttctacattaaggttcatagctgttgcatgccaggaggggtaattcattcaaggagtatagggaatcaaactgaagttactgatgggtgtattatttgctatrgctcctgatcctctgtctttgtgaattttagatcaggaagtgtgactggggcagaaagatgttagaaactatggggttgggcagggttgatctggggtgagtggccgagacccggactaatcctacaggcagtcttgcaagcaactgcggggtcggtgtcacctgggggttaagaataaaggccctggttagtgtctgatctgcttgcaaattggctctctgctacaaagtcactgtgcaacattggacatgttacttaacttctctaagctttggtttctttatgtgccaagtagagttgatcatagtacctacttcttatgactgtggggaggattaaatgaataataggtacaaagtccgaattgccaagtgctggatgtgtaacatacacattggaatttagagacagtacagaaaaaataatgcaaaatgtcttgttaatgattttcatgttgattgcatgttgcttgtagtgtctggctcagaataaatggtgaataattcttagttgccatcattaacattacaatcagcttcactgctgtcattatctccatcatcaccatctttgagagcctaagatagaaaggtaggaaggaaagctgaagttggagagcttcaggcagagatcagtttgggttaggtatggagatgccagtggctggctgggagctttcttggggccagtgtttctccgcctgtgccttccatctggtgctgagaacccaaaacacattcaatggaagaaaatatgtgatgaaatctgatcaagaagagccccctcaagtttaataaagtataaaaggttctataatcctcaggcaagaaaatggattggaaattcgtattcttagagttctgttttcctttttgaagcactctgtgtgttgtgtgggagagttatgctaaggagcttggcagaaattattattcaaaggagcagattaataaggacatacctagtattcatatatcatttaatttcaccatttattgtttacttattgtgtcccagacactatattatacagttaatggattttatgattaaattctcacaaaaagcctatcaaactcatgaagtcttgtacagaagaggaaaaggaatcttggagatacagctgcacaaggccatgtaattttttcaagaccatacaaccagcaatggcagagctgggattgcaaactgctccaaagactgtgctcttaattgggccgattgttattttgatgcatatgtatcccaagaatttcctttaaagcaagaggggaattaatttttaaaaaatcatcattttggtagcagcattggcaaagtgttctgtttctgattagtgtttaatatataaacattaacaatgtgatgttttgcaatgttgaaggtggaaaagaaatgttttcccttacgtgcctacctattattttttttaaataggtcaaattccaaaagtaagactgtgttgaaatatggcsattagtacattcagcatgtgctcatgtttttcaccttactactcagaatagtgtaaactatctcttaaaaatatttgtgggataaaaccagtgtgcttcctgttaatgaagtattcaaatctgatatattaaaaatattatttgtaaagcgttcagttctgaccacaccagtctccagaaggagtgagcagactatctcacagtctgagaagaaaggtgaaattaattttcttgtaagtgctatatacttgtcttcatttccatttttttgttgctgacttgcgtgccaaggaaagactagatctaagttaggcagttcgtaataacatttgcgtttgggatttcaggtgctgctgcattaaatgtcataacatggtacttgtgggaacatctagtcttgttaattgccttttttcttactggaatttagtgcctttgtagattataaaaattattactagtactctgaaaatttattaaacaaaatcttagtgtctttcaaatacagaatagatgtaaaatttgatcaaatattaaagtaaaataagaaccttggataaagaggacgaaagtgtagaatgcagaaaaaaacattaaccctcttgtggacagtcaggattgaaaggaagaaaaaataatggctyacacttctagaatgctttctatgtggcagagacagttctaaatatttacatatcgtaactcattcacctctatgagataggagcaatgactatctccgttttacagatggagaaactgagtgcagagaagatatagaaattgtccaaactcacaaacaactaattaaggtcacagctgagattcaaatgcaggcagcctggctccagagtcttctcttttaatcattataccatgctgccatctcagttttattttaaaataataataggtaacatttattaattatttactatgtgctacatattgtgctaagaactttatataccttcatttcgtcctttcagaaaaggaacaaacagagctgggtgcactggctcacgcctgtaatctcagcattttgggaggccaaggcgggacgatcacctgaggtcaggagttcaagaccggcctggccaacatggcgaaaccccgtctctactaaaaaatacaaaaattagccaggtgtagtggtgtgcacctgtaatcccagctacttaggaggctgaggtgggataattgcttgaacctgggaggtggaggctacagtgagctgagatgtgccactgcattccagcctgggcgacagagtgacactctgtttcaaaataaaataaaataaaaaataaaaaaggaacaaagtattaggcataataatcatcaycagagagtgattttatgaaagacaaaaacaaggtggcaagaagagagaataaagttacataaagatagcatttaagaacaaccacaggctgggcatggtggctcacacctgtaaccctagcactttgggaggcctaagctggtagatggctcgagcccaggagttcgagaccagcctgggcaacatagcaaaaccctgtctctacaaaaaatacaaaaattagccagctgtggtggcttgcacctrtagtcccagctacttggaaggctgagatgggaggatcactcgaacccaggaagttgaagctgctgtgagcagtgattgcgmcactgcactgcagcctgagwgacagagcgagactctatttcaaaaaaaaaggaacaaacccaataattttgggcataacgaccagagcacaatgagctacagagagctttctgagaagtatttgctaattttatctgcaaagataatacaagcataaaaatatatgtattcaaatgtatagatgtgtatctgcagtgagagcagagctgttcctyagtagtgggggtggctggcagagtgaggtagtgtgctttcaggaattgctttatttgtctgatgtgttctagaccaaagaccaacagaggggcttgggcaatcagacacagaatttttggcctttcacatttagaatcggttccttccagattcttggaaaaggtccatttgtgctttaggcatctagtgctattctgaagatgccttacaaaatgtatgctgaaataaccttctaccagggtgaattttcttcatttggagttctttgagttctgaccatttatgtatattgatgaagctaatgtttacttcttcatagaccagtggaaagaaaacgtagtaacatgtagttgcccagggaaagatgaagaactcaggggaccaagtctcccatctcaactccccataaaggtagtgatggaatgggatgatgttaaaaacacctcaactttccgtcctctttaagggaccgtgagaaggtagggatgttaccatactcagacttcttgctgagaaagctaagaaacaaaagcatttagtttttttcagtggcaggtgcttattaacgtttggcctatttgataaagggttaaagcaacaggaatgtgctactgctgttcccacaagcagtagtctaatttctttctttttttttttttttctttttttgagacagtcatgctctgtcgcccaggctggagtacagtggggccatctcggctcactgcaacctctgcctcccggattcaagcgattctcctgcctcagcctcctgagtagctgagattacaggtgcgcaccaccacgcccggctaatttttgtatttttagtagagatggggtttcaccgtgttgttcaggctggtctagtcttacccagtcagcagcagaaaggctctctgggctctaggtaaacacatgaaatttatatagtgtgtttaagtgtggttcctgtgcttctggagttggcacagtagtggtaccatttgctgtatcgacaacagtgggggtatagacgaaaaacagattgacacctctgaaagtatatatgaacacatgtcgatgcagcatttctggtgaaactaagcaaattgataaagttggcctagggtacaagacattatgtcatgtcccactgcattatgattaaacccaagattagaaaggagaaatgatggcaacagaaccagtttctccagctgtctattctcatgttcatcatcacagataggaaagggcagccggccctctgcatctgtgggcacatccctggattcagccaaccacagatcaaaaatatttggaaaaaaatgtagatagttgcatctgtactgaacatgtacagacttttttcttgtcattattccatacaaaatatagtataataactatttacatagcatttacattgtgttaagtattataaataatctagagatgatttaaagtatacaggagggctggccaccgtggctcatgcctgtaatcccagcacttttggaggccaaggtgagtggatcacttgaagtcagaagtttgagaccagcctggccaacatggtgaaaccccatctctactaaaagtacaaaaaaaaaaaaaaattagccaggtgtggtggcaggtgcctgtagtcccagctactcaggaggttgaggcaggagaatcgcttgaacctgggaggcggaagttgcagtgagccgagatcgcaccactgcactccagcctgggtgacagagtgagactctgtctcattaaaaaaaaaaaaatcatgaacaactctgcatgtaaatcaatacagagctrcattataatttacataggctgtataaaatcctgttgattagatgtaaaatgatttattaaattaattttctattattgggcatgaagataggttccaggctgggcacagtggctcatgcctggaacctgcctcccggtgctttgggaggcagacacaggagaatcagttgagcccaggagttcaagaccagcctgagcaacatagtgagacaccagctctacaaaaagcaaacaaaacattaggcagacagggtggtgcatgcctgtggtcccagctacatagaaggctgaggtgggagggtcacttgagaccaggagtttgaggctgcagtgagctatgattgcgccactactctccagcctgggccacagagtgaaaccctgtctcaaaaaaaaamcacaaaaaaccaaaagagataggttctgacttttcacaatagtgtatagagtttgatggagcagtcttatacatacttttttctgcgctagtgcaaacacctccttacaaatttctaacagtataattggtcataggaaagaaacatttttcaagcttttgattgccaaattgacgcccagaaaagstatacctgtttctgctcctaccagtggccctacgaatgctcctttccccacattcacacccccaccgagttttatcattcttttaaatctttatttgccagtgttgacctcttctcttaaatgcctgtaacctcttcctgtttagcttctctcctaggtcagagagtgaactctgaagtcattctttagggattaaaatagtcatgcatttctccttttttctttgccttacatgcaaccataaatggtgagaacttctatcctttttcactttctgcttctgttcctttaataggtggattaatgataaaggtagattgttcaaacaacttagttatttcttaattttgttgtaagctctagttgccagactttaaactgtgctttttactttgcttaacaatgtaatccaatctacctcctcctttgggtgcctaagccatagcccttttaaataaaatagcaaatggaaaatcagaatccctttctatcgcaaaataagagtccagattacataactcattgtatgtgttttcacttggatgagagaatagagagtatggacctctttcatactttttttttaatgttccttttcctctagaattggtttctggggctaaaaggaaacagtagttagtaccactctgctcagaaacctcaaaaaacttcgacttctgtcattctcatcaaagggcaaaattcattgttcttctgtgatagagaccaaaaatacaaatagctaaactggaactaaattaagaaaaacagaagttaataaactccaccgcctcactcccatctcttcgtaagttagtaggcttgtaagtcctaggctggttagttcattcatttgttcactcatgccagccattgaggrttattgtgttctaagtgctgtgctaagccccagaaatacaaagacaagtgagtcatgggcctgcctgcaaggagtgaggagatttactcaaaattgagagctggaaaaagaaaggcactttccctggcctcatagccctccgtgacttcaaagtattcctctctggggtcatgccactagggataatagcattatccaaaaacatttttggaaatccttttagaattattctcagggactggagtacatttatttttaaaaagaaacttggtgktttaaaatctttttttttttttagggagaatctgctttattatttgagaagtttcaaaaaatatagaaaatacagatgataatatggcaagtatctaaaggtctccacttaacagaattaacatctgttaacattttgtcacttttgctttagttgttttttttttaattaaaaaagagaacattacagataaatgtgaagtccctgttattctgttgcccatttctgtwctccctgctgctccctgagagtactaacacaaaggtgtacttctggggtgtgtgtgtatatgcatatccataaacaatatatggtatagcttctggagggatccaaagtcattagcactcaagcaagcctattaartaaaataatatcagcttgagttaaagataacatatagccgtgaaataacggagctgatttttaggtaccttgtcaaatagttctgaaagtaattgcaaagaggagttccaaaagtgagttcagaaagacagctttatcagaataaattgcatggtactgcatacaggaaactataaagaacaacggttatttagaactgttcattctgacagtgtttttcaattactccttaatattataaccacttmctcatttcctgaaatcaccaggaaatttttcaaaaagatttttctcccccgatgaatatacccacgatttgcatttgacccaagataagcagttgagtcgataacatgttwatttttaaatacatggttttaaaacacasaataaaaattctacctcattgcttggagactcaattaaggaragtatgcacattagcaaaaagaagatgtgatatttgctcagaagtcttgaagtggatattttggccttcgtatggctgaatggtcaagcttgactctctcgtttgctcagggaggcccagtccctctgctgccacgggtagaaatactttttcctaaatcgctgcttcttctcactgccatacagagcaatattcaggacacagccaaaaccttctttggcagacctttttgagttctctctactcagctttctgctgtgtaatatgagcactctagagaagtygggctgtcctcaggaaattacacttggggtctgtggttccccaggaagrcaaactggagctccctaaggggtactagtcatcatacggcatttatactagcattgcagtccactttcacctatgcaagtagaaaaactcaggctcaaagtccactgacaatgcaggagtcccttatctgctggttaacataaatgttgttttaagatgatggccatctgttgtctgtgagaacaagactatcacccacctgttgacatgctggctggtttaatatcttactckttcattccaaataactacctggtctcacagatccccttagatggggtatccaatttacctcctgtaccttattctctgtccaataatttcactcaaatcaacaagatattttattgcctatgacttcctctaggtattacgggagattcaaaacacaaacagacaagcagcctatgccctcagaatccagctggggtgagtgggtgactataaatgcaaaagttagagagcatggggaacagtgtttgattgtgtggctggggaggggtaaggacaaaaactcagagagagagaagcctgtagccctggctacagaagggcaacacctctgaggagatgagtctcagctgggccctgaagggaggtgactcacagatgaaacaaacctggtgggaagaatagttagcagtgtgcagaaggcattggaagggattccaggggaggagtgaggagggagccacagtcattccgatgtgaggtagtgagatctgggattagactgggtcatcagaatggaaaaaaagggcctgcttctgcagacagtttaaaggaatcagctggatgtgggaagcaactacatacttattcattcattcatttcatgcatattgcttatagcctactatgtgcctagcactattctaagtgctgaggatagagtcatgaataagatagacagggttcttattctaaaaaaagtaatataccagtggggagacaatgaagaaataaaccactaaataaacaaggaaacatcagataaaataagtgtgatacagagaatgtaaacgggccattgagagggcatggattctttagatgggatggtcaaggaaagcatctcttagagaaaaacctctgagccaagatcaagcaggggaatgacgaagcacatgactgaggcaggagtaaatttgatgtgttggaagaaaagcaagaactggtctgtctctagtggagtgaatgaggggagaggaggagagctgaagagggaagttagcaaagaacgaatcacataaaagccttaaaggcaatggaaaaaatttaaatgttattcaaagtgcaatggtgtattagtccattttcatactgctatgaagaaatacccaagactggataatttataaagaaaaaaaggtttaatggacttacagttccacatggctggggaggcctcacaatcatggcagaaggtgaatgaggagcaaaggcatatcttaaayggcggcaggcaagagagcgtgtgcaggggaattgccctttataaaaccatcagatctcgtgagacttattcactatcatgagaatagcatgaggaaaaacctgcctccatgattcaattatctcgcacaacatgtggggattatgggagctacaattcaagatgagatttgggtggagacaaagccaaaccatatcaaatgggatggtttatggagcagggcatgatgcgattgacttttgtgtttaaaagatctattgtacaaagaagcaaggaaaccagctgggaggcagtggagaatccaggggaaagatgacgatggcaaaactagagagcagagctgagaaggagagaaccaggcagctctgggataacattctggagctagggctgacgaattagatatggggtggggcaatgaaaaacaaaaaaaaagagaaatcaagatgtctccagggttggatattgatgcttttaacagagattgaaaagactggaggagaagcaggcttttagggtgaatcaagggtttaactggggacatatggagtctaagatgcatgttagacattcaagtagaattagctactatgcagttttatttaggaatctgaaactcaggggagaagtcaagactggatatttaagtttgcaagtcaataccaaacatatttttacataagaaggaaaaaatattgatatgattttgataagtttttaatagccagaaagctatatgcgtaatatggtatcattttaattaaaaaataaatatatgcataactctctgcagagataaatgatcaatacatataacaaggagagaaccagaaggacatacgccaatatgtcatgagtgttatctctgggtagtagaattattgatgacttttgtgtacttgggacatgcatgtatgagtgtatgtatgcatgcatattttgcaagttttcctcaaaggatgcttttgtaattggaagaagaagcaattataaaataaatggcacaagatttccatcctggtcaaatgggataaggatgatgccaatgagaaattatgaaaattggaaattagacttagttttggggggatgattttttacttccctcgtagaggttttgtttaagacgatgtagtagactgtacctttacatatatttgctgtccctcccgatgggaggattttacttttcacctgttgaaggtgatgtggtcacttggaggtgaagagatagcctggactttgtcacattatctttctcctattctaaacaatctgcagcgttccaggtggtggatgatctgtcatcctgcatcctggagtaaagatgattaaagcagagctgcagctgccctctgaaggcctttgtttttrtaaaccactgagatttttgaattgtttgttatctcaccataasctagcccaccctaacacagatgaacataaaatacagaacatttctattgggcggcttgaaatacaggcttggggcatcagtggtaggtcagcatggaaaatgttgattaaaaagtcatctgtgaggtggagattgggactgaagaatggataaattttctgaatggaaagtataagggraagagaagaggaatgggcctagaggaagagtcactgtcaatccatacaaaaagaagagatacgaaaagataggaggggggatttggccaacacatggcagaccgttgtagtatcagaaaagagagctaggagggtagttacaaagatcacatgccaaattatgagggcaaagagccattggatttaccctgaaggtggtcattgaaaacctctgaattagcagttttagcggagctgtggggaaggaagtcaggtttcataaggttatagagggagtccatgcagaggaaatagaggaagctggtggaggccactcctttaaaaagcctggatgaggccgaagagaaatgggacaagtggtaaccagaaggcccctacaaggctgtgacttttacacaaatatgacatacaatgctgaacaaaggatgtgctgatcttacagaggaaggatgtgttttattcccaaaaaaaactttacatatgggtaaagttattcaagagaccctgtgctgtctaatatgcaacaaatttttctttgcaccagcattaagacttctaacaataagtaaaatattctatttagatactttttacaggagattttgaaactctgatgacactgacatactacctttcagaacatggtactgtttaaaattttattatttttatatttatcttcatatgtttaaatttgaaaaattacaggaaagagtacttttataattatgtttttctgtttacaaaccacctcctgtgtgctgaattttgcctccccaacatttttcaggggagcatggccctactcgcactttgagttcagatttctggccttcagaactctgagaaaataaatttcttttgttttacgctatccagtttgtggtagtttgttacagtagtcctgggaaactaacaaaccaccccaaagtttagtgacttaaaacagccattattatttctcacaattctgtgggttggcaatttgggctgggctcagctggacagttattctgctggtcttcctgtagacattcacatggctgccattatcgggtggctcaagtgaagctgtagggtctaagatgggctcactcacaagtccaggaccttggtgctgactgttggctgagctttccctcttcacacggtctcttgttgttcagaaacctagctggtcttttttgcattcttagctggtaaagggaacattctaagagaaggaaggtggaagctgcaaggcttcttgaggcttaagtctagaactctccaacgtcacttccaccacattcattggttaatgcaagtcataaggcaactcagcttcaaagagtaggagaatagaatcaacctattgaaaggaggggctgcaaaatagttggtcattttaaccaaccacagcacccaaccaaaaaaattaatactatcccgtttcagatttcagaatgtttaatcagaaggccttgtctttccctacgtatatcacaatacccattttagtggcagagaaactgagaccaaataaaactgactcctttaaagttaccaagtgagtcatgctttgtgagagacatgaagacaactatatgtctggaagagctaaacatagtcctgcctggaggcaggtatatgaacttaataatcccttgagatgctcttaaatcccataattacactgatggactccagattgcagagctgtctggtccagagataaagcagcggtttgagagtatcagagagagaaggtgcctgaaaattgccacatgtccccaaaggcaggatttgaggctaaattaaatgataaagagttaccaagctctttattctcaagagttaccaaataagcttagaaactcaatgactgctgctgtctagtgttagttctggaatgggagaattaaaaatgagtagaaaaagaaaatagagacagagagactaacatatctgaaagataggtgctgtgggcagtcttagaaggatcacccctatatcaattaggattgcttttagctgctgcaagtaacagccaaccaaaccatccaatggtttaaacaaattaggggtttatttttttcttttcatttatttatttatttttaaatttaattttattattattattatactttaagttttagggtacatgtgcacaacatgcaggtttgttacatatgtgtacatgtgccatgttggtgtgctgcacccattaactcatcatttagcattaggtatatctcctaatgctatccctcacccctccccccaccccacaacagtccccggtgtgtgatattccccttcctgtgtccatgtgttctcattgttcaattcccacctatgagtgagaacatgcggtgtttggttttttgtccttgcgatagtttgctgagaatgatggtttccagtttcatccatgtccctacaaaggacacaaactcatcatctttatggctgcatagtattccacggtgtatatgtgccacattttcttaatccagtctatcgtkgggcatttgggttggttccaagtctttgctattgtgaatagtgctgctataaacatacgtgtgcatgtgtctttatagcagcatgatttatagtcctttgggaatatacccagtaataggatggctgggtcaaatggtatttctagttctagatccctgaggaatcgccacactgacttccacaatggttgaattagtttacagtcccaccaacagtgtaaaagtgttcctatttctccacatcctctccggcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtttgttcatatccttcgcccactttttgatggggttgtttgtttttttcttgtaaatgtgtttgagttcattgtagattctggatattcgccctttgtcagatgagtaggttgcaaaaattttctcccattctgtaggttgcctgttcactctgatggtagtttcttttgctgtgcagaagctctttagttgaattagatcccatttgtcaattgtggcttttgttgccattgcttttggtgttttagacatgaagtccttgcccatgcctatgtcctgaatggtattgcctaggttttcttctagggtttttatggttttaggtctaacatttaagtctttaatccatcttgaattactttttgtataaggtgtaaggaagggatccagtttcagctttctacatatggctagccagttttcccagcaccatttattaaatagggaatcctttccccattgcttgtttttgtcaggtttgtcaaggatcagatagttgtagatatgtggcattatttctgagggctctgttctgttccattggtctgtatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaacgtcattggtagcttgatgcggatggcttgaatctctaaattaccttgggcrgtatggccattttcacgatattgattcttcctacccatgagcatggaatgttcttccatttgtttgtatcctcttttatttcattgagcagtggtttgtagttcttgaagaggtccttcacatcccttataagttggattcctaggtattttattctctttgaagcaattgtgaatgggagttcactcatgatttggctctctgtttgtctgttattggtgtataagaatgcttattatttttatacattgattttgtatcctgagactttgctgaagttccttatcatcttgaggagattttgggctgagacaatggggttttcaagatataaatcatgtcatctgcaaacagggacaatttgacttcctcttttcctaattgaataccctttatttccttctcctgcctgattgccctggccagaacttccaacattatgttgaataggaggtgagagaggacatccctgtcttgtgcccgttttcaaagggaatgcttccagtttttgcccattcaatatgatattggctgtgggtttgtcatagatagctcttattattttgagatatgtcccatcaatacctaatttattgagagtttttagcatgaagcgttgttggattttgtcaaaggccttttctgcatctattgagataatcatgtggtttttgcctttggttctgtttatatgctggattacatttattgatttgtgtatgttgaaccagccttgcatcccagggatgaagcccacttgatcatggtggataagctttttgatgtgctgctggattcggtttgccagtattttaytgagtatttttacatcaatgttcatcaaggatattggtctaaaattctcttttttggttgtgtctctgccaggctttggtatcaggatgatgctggcctcatcaaatgagttagggagtattccctctttttctattgattggaataatttcagaaggaatggtaccagctcctctttgtacctctggtagaatttggctgtgaatccatctggtcctggactctttttggttggtaagctattgattattgcctcaatttcagatcctgttatttgtctattcagagattcaacttcttcctggtttagtcttgggagggtgtatgtgtcgaggaatttatccatttcttctagattttctagtttatttgcaaagaggtgtttatagtattctctgatggtagtttgtatttctgtgggatcggtggtgatatcccctttatcattttttactgcgtctgtttgattcttctctcttttcttctttgttagtcttgctagcggtctatcaattttgttgatcttttcaaaaaaccagctcctggattcattaattttttgaagggttttttgtgtttctgtttccttcagttctgctctgatcttagttatttcttgccttctgctagcttttgaatgtgtttgctcttgcttctctagttcttttagttgtgatgttagggtgtcaattttggatctttcctgctttctcttgtgggcatttagtgctataaatttccctctacacactgctttgaatgtgtcccagagattctggtatgttgtgtctttgttctkgctggtttcaaagaacatctttatttctgccttcatttcattatttacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttactgccaactatgtggtcaattttggaataggtgtggtgtggtgctgaaaagaatgtatattctgttgatttggggtggagagttctgtagatgtctgttaggtctgcttggtgcagagctgaggtcaattcctcggtatccttgttgactttctgtctcaytgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggttgaaagtctgtttcatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaatttaatattgttatgtgtgaatttgatcctgtcattatgatgttagctggttattttgctggttagttgatgcagtttcttcctagcttggatggtctttacaatttggcatgtttttgcagtggctggtactggttgttcctttccatgtttggtgcttccttcaggagctcttgtagggcaggcctggtggtgacaaaatctctcagcatttgcttgtctgtaaaggactttatttctccttcacttatgaagcttagtttggctggatatgaaattctgcattgaaaattctttcctttcagaatgttgaatattggcccccactctcttctggcttgtagagtttctgccaagagatcagctcttagtctgataggcttccctttgtgggtaacccgacctttctctctggctgcccttaacatttttcccttcatttcaactttggtgaatctgacaattatgtgtcttggaattgcttttctcaaggagtatctttgtggcgttctctgtattttctgaatttcagtgttggcctgccttgctagaatgggggacttctcctggataatatcctgcagagtgttttccaacttggttccattctccctgtcactttcaggtacaccaatcagacgtagatttggtcttttcacatagtcccatatttcttggaggctttgtttgttgctttttattcttttttctgtaaacttctcttctcacttcatttcattcatttcatcttccatcactgatacccttttttccagttggtcacatcggctactgaggcttctgcattcatcacgtagctcttttgccttggttttcagctccatcaggtccttttaggacttctttgcattggttattctagttatccattcgtctatttttttttcaaagcttttaacttctttgccattggtttgaatttcctcctgtagctcagagtagtttgatcgtctgaagccttcttctctcaactcatcaaagtcmttctccatccagctttgttccattgctggtgaggagctgcgttcctttgcaggaggagaggcactctcatttttagagtttccagtttttctgctctgtttttttcccatctttgtgtttttatctacctttggtctttgatgatggtgacgtacagatgggtttttggtgtggatgtcctttctgtttgttagttttccttctaacagacaggaccctcagctgcaggtctgttggagtttgctagaggtccactccagaygctgtttgcctgggtatcagcagcggtggctgcagagcagtggatattggtgaaccgcaaatgctgctgcctgattgttcctctggaagttttgtgtcagaggagtacctggctgtgtgaggtgtcagtctgcccctactggggggtgcctcccagttrggctactcgggggtcagggacccacttgaggaggcagtctgcccgttctcagatctgaagctgtgtgctgggagaaccactcctctcttcaaagctgtcagagagggacatttaagtctgcagaggtaactgctgtctttttgtttgtctgtgccctgcccccagaagtggagcctacagaggcaggcaggcctccttgagctgtggtgggctccacccagttcgagcttcccggccgctttgtttacctaatcaaacaactaactcggcaatggtgggcacccctccccaagcctcgctgccgccttgcagtttgatctcagactgctgtgccagcaatgagcgagagtccatgggcataggaccctctgagccatgtgtgggatataatctcctggtgtgccgttttttaagcccgttggaaaagcgcagtattagggtgggagtgacccgattttccgggtgccgtctgtcaccctttctttgactaggaaagggaattccctgaccccttgcacttcccgggtgaggtgatgccttgccctgcttcggctcacgcatgttgcgctgcacccactgtcctgtacctactgtctggcactccccagtgagatgaacccggtacctcagttggaaatgcagaaatcacccgtattctgtgtcgctcacgctgggagctgtagactggagctgttcctattcggccatcttggctcctccccttatttatttttttcttacataacaagaatgccagtggttggccctgcaggcttggtgtcatggcccccaaggtaccactggagactctggttctttgtgtctttgtgtcccaccaaccttagtgtgtggctttcatccttatggtcacaggatgactcctaaaactctgtacagtgaatcagtattggagacaggaagaagaaaggaggtaaaaaagacatgccagctaactttgctcccattaggaagctcttctagaagctcacagaattacatttgtttatgtatttcattattcagagctgcgttagctttgtctacaagggagattggcaaatgtagttttcattagcccagcacattgtcacccccaacaaaactagggttgagttagaatgaaggggctagtgcatattgataggccactagtagtttctacacagcctccaacaattgctgtggatgtagattagtaacagaacttccactatggcatcatagcacctctatcccactagtacctgtagtaggtccaaatcatctaattccaggagcctggcttaaagaagaggaatattgaggcttctaggtccagtattaatcaaggtaagctagctgtgagaacaaacaatctcaaaatctcagtgaacgaaaccaacaaaaacttgtttcatgtttatatcacagtctgatgcagatcgagtggttctcctccaagcagtgactcagggacccaggctgcttccatcttacagctctaccatcttgtgactttcrgattatgttggcatcattcagccagtgactaggaagaagagagaatgaaagattgtgcacccaattcttaaatacctccactcaacactgggacacatagcttctactcacacttccctggggaggactgcttacaagattcatcaatctgcaaggagggctgggggaatatattatagttcttgcctggcggcacttccagcaggaacacttcactatgaaaagggagcacaagtctttggggggacagctagccttctgtgccacaaaagcccagtcacaaagaaaaagccattaccaaaatgttccataaacaatgtagacctactgtggtttgctgttgtctgatagataaaaactgtgttgttttagtcacaaggatttggatgtgggagctgcaaggaaagcaaaagccaaacaagtacagctgaagcacctgagatcctaggaggagacaagaagaatacaaggtgccattgtcctatcagccaggcagaaagatggtaggaaacaaggccatttaaaatctaattgcaattgcaagggctgggtgctgtggcttacgcctgtaatcccagcactttgggaggctgaggcaggtggatcacttcagctcaggagttcaagaccagcctgggcaaagtggtgaaacctagtctctacaaaaaatacaaaaattagccaggcatggtggcatgcgcctgtagtcccagttactcaggaggccaagatggaaggatcaattgagcctgggaggttgaggcttcagtgagctgtgattgtaccactgcactccagtctgggtgacagagcaagaccctgtctcagaaaaaataataataaaataaaatctaattgcaggcaaggccacaggaagtggcaagtgcaactaaagacttcctagaaatcccacacattgataagcagccgggttgttcagccagtttttttttctgagaacaaccaattttaaaatattttaggaaaaaccacaatattgagatatttttaaacagcttatatttaaacagcatatatttaaacaaagtgattaatttagaattcatattttatttgagaaaaaaacaagatgttcctggtctggcagatgacattctaaattattcactcccacttgtggaatagctgagttatagtcyggcccctcctctgtagaggaggatttataggagaagatgagtcacgttactttttgtgactatttttctttgcatttgttgactcctcttgttttattcaccttctaatcattgaataatctgtacaatcagactgccttattcatgttggcagttgttttaataataacaatgcacagagccattgctactaacagaaagcagggcagacctttgagtctgagtttggggatacaagtttgattccatcccagctccactgattcccagcgagatgtggttcaacatcataggaccaaatgaaataaaaagcgtgaaaatgctacacaaatcaaagagtgctaaagacatattaatgaaacatctgtaaaatgggaataagtaccacgtttctgaggtagcatgtaatacaactggcacagggttccacacttggtagatactcaaaaaagaaaataaaaagttaacatggacaaagtaaaataaactggaaataggagatggagaaatgttaaaacaacaggcaccataataatgtaaagtaggatttcagctcatttacaagcacagaggttatatggtaagtcctcacttaatgttgtcagtaagttcttggaaacagtgtctttatgtaaaacaacataaaggaaaaccaattttgccataggctaatggatataaacaagagttaagttccagtacatatgtgatggcatatttccagttacaaaatatcaccaaacttctaaataaagaccaaaagactcctaatattaaacattgaaataaatgtgagctatactttcatataagaaaaattaatgcaaacaagtacaataattatttactgagttattccagttcggggtcgtggatggccagagtctatcccagccgtccagggccaagtttggaacccaccctggccaggacgccatcctatcacagcttgcactcacacacactctcactgggaccatttagacacaccgattcacctactctgtgcatgtttgggatgtcaaggaaaccggagtaccctgagaaagcccacatgggggaacatgcacactccacacagacggtggctccagccaggaattgatttattttctcatcaatgttataactaaatgactttgaatgaaacaatgttatttgataacctgctgtatttagagttcacaaaatttatccctctgaaacacatacacacacgcatggccgcacacacacgtgcatgcacacactgcacacacttaatgctaaacttgaaagagatttaaaggctaaaaggaaagttggactttaaatttcccctggasctcacattttctgggtactgaaagatatggtagatacatatgattgccttttccaaaaataacttctatggaaaatcctgagagttataagagactacaaaggtgatttgatagagccacttaagtaatgtatgcaatatgatcaccaggtatacttgtatgagagatgggaaagaaaggaaatattgaaagagcagaaccatgaaggagaagaagcaattgatcctgaagaatagcaactgtagtcagggattagagacctgcaaacaagtttcctattcttttcaaaaatgaagaatagcttcttattacaaaagctgtatatataaattatagaaaagtcagaagtgcaggtaagcaaatactttaaaaatcaaaattatctctaattctttgacttattaatcattttaacagcttgattgatattttttcagatacacacatacatacatacttctacaaaactggaagtatgcttatatattgtatcataacctgcttttttatttaaaaaatatcatgaacaacttttcatgtcattaaatattsttgcattacatttctaatgaatgcataacattccattgtaaggatacagcgtaatttaactcagtctgtattgagctacattgatttccagttattcacattagaaacagtacaccactgaataaatttatgcattcatctttgcttacctctttaatgattcttcacgataaatgctagaaatagaaccacagacttaaaggtctccattgatatgtgtggctcccttgttttcctttgcaaggttttgtgtggcatctgcctttaaaaggttaaagatatttttacttataacatccctgaactttacctcaagtcttggggaaagttattgaaaagtagtttgtattcaaataagtacaaactggcaaggtcaatcttttatacaggttatcagaaacaaatcaacctcataagatggaactaaacccattattatgattgagtcagcaaacttaaagatgtgtttggtttggacaaatactattaattccttaagttccctgtggccacagtttttttttttaatgaatgtttttctgagtaatcttggtcctatttgaggccatcttcatatgcactaccaatatttccagctatacccaacaggtaaactagccctctgtaggcaattaaatgtatattttcctgaagaaagtaaggttatatagaatataagtataaggtcacctagaagagctattaatgtattwtggacaatttctttttattgccagagctacatgttacttatatttaagtctgatatttaattctctattatattcccttattattgaattaattaattcatccattcatatgacagatatttcttgagcacttacttgtgccaggcactgtgttagactctggggatttggaaagaccctgcttccctcatgaaacttacattccaatgatggaaacagatcatctgtaagtgcgtaaactaatatatcatgtcagataatgtctcatttccttatctcttaaataaaaaaatattctattccatagggctgttatgagaactgagtgagactatgtggaaattaccatacacatgtttaaaaaatattgtttctttttcctcttatcttttagaaaagggaaaatgattattgtttctttttcctcttatcttttagaaaagggaaaatratttgtataaatcattaaatactcccttgatattacaaaactagcaaattgttttttgattttattttttaaattgtcacataataattgtacatattcatggtggtacatagtgatgttttggtacatataattatagtgatcagatcaggacaattagcatatccatcatctcaaactctaatcatttctttgtattgggcatgttcaatatcctccctttaagtatttgaaacgacacaatacattattgttaactacctcatcccacagtagtatagagcactagaacrtattcctcctatgtagctgtaatttcgtatcccttaacaaatctctcccatctttcccttccccctacccttcctggcctccagtaaactctgttctactttttacttctatgagatcgaagttttttagcttctgcatgtgagtgagaatgtgaagtgtttaactttctgttcctggcttatttcacttggtgtaatgtcctccatttccatccatattgctgcaaataacaggatttcattttttaatggataccattccagtgtgtatctatcccacattttctttatccattcatttattgtcagacacgtaagttgattccatatcttggctattgtgaaaatgctgcaggaaacatgggggygcagatgtctcttcaatataataatcttttcctttggataaattcccaggagtgggattgctagatcatatggtagttctaattagcaaattctatattccatattaaaggaaggaataggtaaatttttttcaaattttttattttgttaaagatggagtaatcctcccacttcagcctcctgagtagctaggattacagaggtgagtcacagcacctggcatgggataggtaaacattttttaaaatgtttgttttgtttcaggcaaaattaggtatcaactgtttctccacaaagaagagcagcttaagccttcacagcacatagttctgataattcaggtcttcttttgccatttctcaaacatagctatcttgtgttggtacatgcgatctgcagggccttagacgaatcatacatttcatctctctgggcctcagtttcctgaagatgaagttatgttatatggttcgtaaagttcatttcagggctaacttcactttgtccttgtaaaaattatctgcctagtgggtccactccccacctcaccaccccccaaaaaatgactgctgtgctccaacccaagccaatcaaaaatgataaacacttgactgtgacttttttcaagactctgttttacagagaagtggaaaggtctactgtggaatgcttatattttaatttgtcctcattgataggagaggacaaatgtaaactaggagaaatggaaaaaccagtgatacatgtcttgttatgttaaaggaaaaagctagagacaatatgattattaataattattttttaaaattaattcttgcatttattgagcacctgctgtatccctcatatgcattaccttgtataagtcttgtaatagcccaaaaagttaagagtgttcttattctcccaaggatgcagatatggaaactgaaactgagtacggttatgcagtatgtgaggggcaatgctgccacagaaactcaagtctagctgagaccaaacccatgtttttaaccacttgcttcttgcctttgccaatcattgccaccaacgagtcaaaacttacttgttgctggaacatggtttcatcctggccttccacggaatctgttgagcttgttttttttttttttccatatgccataatatgtttagtttcacctcagatgagwcagaggatttactttcaagaaagttggacgctgtccactctaaacagtaccagaggtagccttacagcatcagaaaatcctgtggtagtatctcttcatcggaacttggaatatgattttaagagttttttctatcttttcattagagcaggccaacactgacttgatttttctctgaaattagctgtggacaaagattccttttcaaactaaagattctaagcttattttcccccatcactttatcaaaactagaaacaatccattaaaaacactgcccagccttcaggggcttaatcaactcagtggtataaagcatgaaacttgattctgagatccaggagagaatatttggattgccgggaggtgacctttatatgtttctttacgtgtataacaaatacatttcaattcgcgtctagccccttaaaaccagtgcatgtttctgaccctgagtgctactgacattgtgaatcgcactgcaaacagaacacgggtcactgttgttttcctgatctgggaagacatcatggtgtggtgaaagggacagtgcgctgctgatcagacttgggttctgtctctcctctgctaccagtgaaatgaatttcagatgcaaagtggaaagatcaattgtttcttggcctctttgctgagatcaagggaagaagaaagatcagattagttccgtgacagtccaatatttactgactgacccatgttctgtttcatctcaggatttccagggggctccaatttggaccactgcagcggtcccaactgccaacctatgttttcccttcttccctacctttcccctgcagcctcaagtggttccagataaagtgttattccatgtatctcactgtctgaatctagaggactctgatacccaaatgtgtttctcagagtgtgtcaatgaaagggactctttgacccacaatccccctttttcttcacaactccatcatcggcatcctcaaagacaatccatggtgcctactactcctcatcttattgacatgattttaatgtcagctctcgccgggcgcggtggctcatgcctgtaatcccagcactttgggaggccgaggcgggcagatcacgaggtcaggagatcgagaccatcctggctaacatggtgaaaccccgtctctactaaaaatacaaaaaaaaatttagccgggcgtggcggcgagcgcttgtagtcccagctactctggaggctgaggcaggagaatggcgtgaacccgggaggtggagcttgcagtgagcagagatcgcgccactgcactccagcctgggtgacagagccagactccgtctgaaaaaaaaaaaaaaaaaaaaattttagctctcaaagttttcctccatgttccatgaaaatacactttacaatctagtattccccccaccacacacrcacacacacgcacacacatatatactgaaacgaaaccatatccaacttcatttccatttccaattcattcaacattttctattctgttctattgcatttaaaaaacgctggtcacaagccactaaactgatctcagatcagactttaataaatcagactcccccttttatacacacagagcactctctactgtttcttcctagtacttgtcacaatttgtaagtcctaaatcatgtgattgcctacttaatgtctcccgcaacctgcccctggtgttctgtaaacttcaagasgatatgttttgctcacctttgaatttttagatcccatacaacacctatcatatcataaatgtttaataaatatttattaaaagaattaataaatgaatgtggccaaacctattcaggtctgcatggttcctccctagagttccatcacacttcacagatctaaagtttcctcccagttgtggaggtttgaagctcaaaactgctggaggtgcttcccaccatagctcgtgaaggccctattggtgttttcttcctagtccgtctctagttgatcatgacagatgggccagtgtgttttgaagaagactggctgatgcctcaccaaattctggggacaggtgcctttctccaggggaattcatgaagagactctccaggggcagggcagaccactgggaaaaacaagacccttgggttttctgaccactggccacttgtttttcccacatcaggagagtttatcatctgtgctcatccacctcctgaggttgctttgctggtgctgatttcaggtcccaggcccctaaggtctcacactcactccacaagccacctacacagctgtagttgttttcagccgacagctaggttattttgccttccaagatattttcttttatttatttattcatttatttattttttgagatgaagtctcacactgtcacccaggctggagtgcagtggcacaatctcagctcactgcagcctccacctcctgagttcaagtgattctcctacctcagcctccccaatagctaggattacaggcaagcaccaccatgcctggctgatttttttgtatttttttgtacagatggtgtttcaccatgttggccaggctggtctcgaactcctgacctcaggtgatctgccctcctcagcctcccaaagtgctgggattacatgcatgagccaccatgcccggccaatagtttcttttttgataggcagctcttaaagccctcagaatacatctctaatgatgaaatcatcaggcaacttgacaaagagtgaagaaattgaagggttctctcaatagcatcccaaggaggctgacccacaccctactgcctaccataggctggcttcatgtgctctagtgctgtgaataaaggaaaaaactaacatgttgaagcatttatttagtgccaggaggcaggtactttctcagataccctttttcttctcacataattccaggtcattggcagaatagagatgcaaaccaagaacttgggcagcaccaagatgtagatgctaaaactttaaacttgctggacaaaatgataggggactttgaaataattattcagacaatttaggcaagcaaacaaaagcaattaaaaattgggcatctggctgggcatggtggctcacacctgtaaccccagcactttgggaggccaaggagggtggattgcctgagctcaggagttctagaccaacctgggcaacatggtgaaacctagtctctactaaaaatacaaaaaattggccaggcatagtggcgtacctgtagttccagctacttgggaggctaaggtgggaggattgcttgagcctgggagatggagcttgcagtgacctgagactgtgccactgcactccatcctaggtgacagagtgacacccatctcagaaaaaaaaaatgggcatctggccaggtgtggttgctcatgcctataatcccaacactggaaggccaagtctggacaattctttgaagccaggagtttgagaccagcctgggcaacatagcgtgaccccatctctacaraaaaattaaaattaaaattaaaaacagccagacatggttgtgagcacctgtagtcccacctactagagaggctaaggcaggaggatcatcaaaactgcagtgagctaagatcgcaccactgcactccagtctgggtgacagagtgagaccctgtctcaggaaaaaaggaggcatccaaaaaaatgttcccttagatccattttttgtctgacagagacaggagaggtgatgaaagggaatgtaagagtatttaagggattatttctttatggtagcagaaggacaaagacatgtttgaaaaatttttaatattgtataaaatgatgatattttcttagtggtcttgttgttgaatccagagattgtggtcatgtagttcataggtaatttatcagttattatttattttttaaagcttttatttatttatttatttattttagagatgaagtcttgcaatgttgcccaggctggcctagaattcccgggctcaactgatcctcctttctcagcctccctagtagctgggactataggcacacaccactgtgcctgtctaatttgtcaacttttaaatgagatcatctgcaagttcaaggaagttagataaagggtgataccacagaaaaaaaatgagatttttctctttaagatgaatattgaatttagaattccttaattaatattgaggatcacatgcgagctacagatagggaatattgagtatttaaagcattctgaatgacctgagtgttttccttctcatgcttattaaaaacatttaccacttacagctgaattggaatatagttctacrtaaattgttatttacacctgatacacagaaagaaatgtgtttccttatttatcatactattaatttgaatgtgctattctttttttaattgctttaaagtcaattggggaatcagattatgaatatctattttactgcttccacatttcctaagttaatcaaatacgacaagttagtgagcttgtggaatttacttgaatttcctaatcttttaactgagagggtattttcgacagcaaatattttgtagcatccatttgtcattttttaaatattcaaactagttttttttaaaataatgccaagtacacttagtgcctagtaaatgctggccactgttattgctgttatcattattcttttttgtttgtttgtttgagagrgagtctcgctctgtcrcccaggctgaagygcagtgacgtgatctcggctcactgcaagctccgcctcccgggttcacgcccttctccggcctcagcctcccgagtagctgggaatacaggcacccaccaccacgcccggctaattttttgtatttttttttagtagagacggggtttcatcgtgttagccaggatggtctcaatctcctgacctcgtgatccaccctcctcggcctcccaaagtgctgggattatggcagagaaatgtttgtttcaaaagtgtgttagtctctaaggaaatgaatacttccagactaaattctgtttatagtattatcattaataaataaactaaaacattacttctgtttcattgccccaatgtatattgtattaaaatgttcttttctgatcttctctaagttaaaaaaaaaaaaaaagaaacaaagttgagtaaacaagctgagcaaactttgtgttgaractttaatatgtccgaggaaaagaatcttgcattaagtccaatacagagagtctgataatttggtggagcagagagcctcatctgaggtggctttyygtgaacagcatctctgaggtgtcacctgctaccacattcactgtccaccctgggctttgcccctcaagcaccagggctcaggtctcttgttttgcctgtttctccctatagtctccctggcctgtgccttttagacaaaacagattaacatcacctttaagccgtcaatactgaacattctgtctttataaggcctgactcattaccaattttatttggtcaattttaccttccttgctttcaaaggaacaccatttgcctatgtcaagtgttctctttcttttatttttcccttccttctgtctttcccctccttccttccttccttcctccctccctcctctctcctctctttcttccttccttgcctccttccatccttccctccctctctctctttctttctttctttctctctctctctttctttctttctctctctctgtctttctttctctctttctttctttccatcttcttttctttctatctttcttacttttgatgtagctgtcacgacctaatgaaaatactggcatgagtgatgccacctttagattctccaccttcctgttcctgtcctattcaccaacatgaattggtttgtggctgtaagtacttggtgggttattgctcatagattcagttgcatttttgctgagatagtgctgttaccaaaagcaggggtgctgcttgaagaagtaaacctaactctgaaaaatagagactctccagaaacatcataatcttaaggatggacatttgtggcctgttattgttacttcattctaggtgacagagtgaagtgagtgagggcaaaaatgactgcacacttatggaaagagggctgcctccaccacagacaggtagtgggaggtcccactcttccaggttgaacccaatatcctatcttctccttccgstcttggtacctgttgttgctattgtaaacacttccctcacctgggactgcatatagatgaaagattgctggggggtttcccaggatcttgggccagtgccaacaaatggcaaactttcaagtctagagatggtcctatggcatgactgggggacaccacttccttcaccagaacattcacatccttcccaaggtgccaygcccagttcttttgtccaacrataaactctgcgaagtggagtgaagtcaccacccaagccttagcctacctctgaccacagcctgtgactccacaaagataaatgaaaagaggaaagtcagtgatgttttmtatactgtcagcagcaatctcacagcctcaatacattttctttcaaaagtttaatatgtaataactggcatttcttcttcattcctagttggttagactgcatcacatctgccatgccaaactattaagagtaatacaattcttactcttagtttattaagagtaaaaactattactcttaatagtttagcatgctattactcttttcttattttttaatttttttaattttttattttttgagacggagtctcgccctgttgcccaggctggagtggtgcagtggcacaatcttggctcactgcaacctctgcctcccaggttcaagcgattctcctgcctcagcctsccaagtaactgggattacaggtgcccaccaccatgcctggctaattttttttttttttttgtatttttagtrggcaaggggtttcaccatgttggtcaggttggtctcgaactcctgacctcaagcgacgcccccgcctcggcatcccaaagtgctgggattacaggcgtgaactgctgcacctggctgacgtgctattactcttacagcatctggacaatccctaacagtctgaaagctctataawgttgcrggtagtccaaaggccctatcccttattctagaacacaggctttatagcacaggctttggcaagtctgtaacagtctgaactcctccactgtattccacatactagggatcttttaagttgtcattatgtcctggcacaagcatttatcatatttctgggagcatgtagggttcaagatgcgagggcaagagagggctgagttgtttgttattaagctgacaggaaatggccaaggctcatgtgctactgcttgcagttgggcaaaagaggataaattaattgctttgtagaaattcctttctgcattctttagggaaaatttttccatgtgagctaaatgagtcaaagggggtggttttgggctcaacagctttgacattgtcccttcaaggaatgaaacaattaaagaaactgatctcctctgagaaaaagaccatttacaataacctatctactctacrtaaaatattcccagtagactcatcaaaacaagaccctctgataccacaccatactgggtttttccttattgggattcccccatgttttttctttaatgcttccccatgttttagaaacagatttgcttacccggaaccttccacactcaattccawatttatcatagtactatcatttgggagtaaacaacatgtaaggggcctacacgggtggaaagcccattcaagaaactgaggatgatcaaatagtagagttgatagtatgtgtataatcccagggaggagtttcatgacggattagaaggtcaacactgcctgatgcagccgaaagatcacattaaaacaggacaggaaggaagtcctggctgtccagcaaaaggtctttagtggctatatcaagagaagcttttacagaagggtgagggtggtagcctgygaacattggattaggagtgagagggactgaaggaagtagaaactcsagctcaggggaaggggagagaatgagcttgaggaaggccctctgatgaagggaaggctcttttctgatgccagtgagttgagcagacttataggaagcaaagaggagtctagggacagacagggattgtccaggtaatgtaggaaacatttgacaaggacagatctcgaataaaaacatgaatgcaatttctgtttcagatgtctcctttgcctgccccatcccacattctagaaaaatatttggtgcattaacagattttggacttcacagggcttcacttttattgtgcttaatatttgttccttggtgaaacrcaaagagacaaactacacaaaaagagaatcatacttgatgaaaaaaatcaatgtttagaagttgctcttaaatcttttacccattgctaacatgggtatttggatgccatttggaacgtattccaggactacttatccatgaaaggattaatgatattggagccaggttcaaagtctyagcaacaagctaaaacctgctctttttagtagtcaggggcaaagcttagtatcctttcttctgaaagctttcgcatgctaagctttccattgccaagccccygggaaggaaaataccagaagtttcactccgatagcarctttttctgagatgcgcctggtgataacattttccagtagggctatcttctgtctccttccttctctgtgtgtaccagtaaagccttgtacaagtctcttaacctttcttggcttcagtttccaaatttgtaaagtgaagataataatacctccctcatagagttgttgtgaggactacatgggctaacgatcagacagaaagcactcattaagtgtgactagcattgttaattgcagtaatagtagttctagtagcaggcttttccaggttataaggattaaagatacgctcatgttacctaagttaatggtgcattattttaagggtacaccaaaaagtaagaagaatgggaaactacttaaccagcacatggggtgcagaagcgagagcaattgtgttttctttttttttttttttttttgagatggagtcttgctctgttgcccaggatggagtgcagtggtgagatctcggctcactgcaacctctgccacctgggttcaagtgattctcctgcctcagcctcctgagtagctggggctacaggcatatgccaccatgcccggctaatttttgtacttttaacatagacgggggtctcaccatgttggtcaggttggtctcgaactcctgacctcatgattcactggcctcggcctcccaaagtgctgggattacaagcgtgagccaccgtgcccagccccaagggaattcttacagcctgacaggtttggaactctgagtctctctgtgtgtctgtgtctctgtcactccaccatatgtttagcagggttaattaatttgcccaagatcacacaattagtagatgattatgcaagatttgaaccagttgttattcattggaatatgattactgtgtaagttagcatgagaatattgaaaataaatgtcttgttagattcatttattttttaaaaaattcctatgtaggtcgggcacagtggctcacccctgtaatcccagcactttgggaggccgaggcgggcagatcacctgaggtcaggagttcaagagcagcctggccaacatggtgaaaccccatctctactaaaaatacaaaaaattagccgggcctggtgatgcatgcctgtagccccagctrcttggtaggctgaggcaggagaattgcttgaacccgggaggtcgcagtgagccgagatcacaccactgcactccagcctgggcaacagagcaagactccatctcaaaaaaaaaaaaagtcctatgtatacttcttcacatcaatttaggcaggctttatttgttaacttttgttggtagccaacatgcatttaaactacttattattgtcctaatctaagaaaaactgagaaatggatgaagttggtcctagggtatcccaaagcacagagtgttttattctgtccttgggacagaggtttgattcaaaatgttttttcggaaactagccttgaacacctaattttattaatattctttttacactccawccctcctggaaaaggactggaccccaattcccaccattgcttttttgggacccattatcttccttagcttcctatgcatctacagggtagtctgggcttcacttcctcagtgtccctgtatgaaattaggtggatatagattagtctgatgtaggaatatcacactgtactaaggtttagtttgtatgttattctctcaagtaactgatctttcaatccaactaaacacttcctatgtgctttaaggtggtgggaattacaagcatagcaagttatgattggtcacggatttctttcctctttaaatggtgacctactgcccattgtacctactcaaagcaactttctttaggaaaaaagaccacagtctactttcctaagcataaactcagttctcattccacctctaccacctgcaagatttgttaggcttaagcagtcccttaacttctttgagtgtttgttgccttgcctacttcattggaagtaaggctctggaacagggaaggtttgcctccataagactaaaakttatgctaatataagagactagcaaaatgggagacatattcagctctcttcttgtggggaataccttgcccttgaccaaaagccttgtcccagaaagagccgtgtgggtgttggctttgtgyccaacatgtggctcctctgccatgattgatggcttcatttaagaaacaggttttaggattttttcccctaaaatcttattcctgttaattatcatggatcaactttaccttagctcgtttaatacacagtcacctggtataaaagcatgtgaaaacccccagggatcgtaaccacatttatgcattgagaaaagagagtgaggccaagattttgagatgtgttcaaatgcaagaagcttttaaaatgcaaagtattctaaaactgttgaaagttgaagctaactgttgttcccttgttgaaggtaaaaagtaaagcatttttaggaaagcacttytccttatgtgtctaatatttgggaactgcataggagaacagtttaataggaaccctgatattgacagtaagatatattcttaatgtagtaaccagacccagggcagaatttgcaaacccatggtaggcatacaggtggctgaagaagaatcgggacagcaagatctcactgagatgcaattccattcctccatttgatacagattaagatttctgaaaaagaccatcctcctaaaccctcatggactctgcagataatatgaggccagaaaatgartaattcccaactcttgctatctcgttactggccagtgtgtctggcttcgctgagtgtgtgccttctgaagcgtaccctataattattcagcaggtatagtccagttcgtcctacttactttagcaagattacctttcttttatttttcctgtgaaaatccttctcttccttctttcctcctttgtctttcctctttgttaactttttaaatctaaagtgccttgaaaaacttgtttacatagtagtaagaaggaaaatgttgacttgtgctatcctgggaaccttgaccttcctgcattatggataaatcatttccctgcaggtggaagtggaaaattgcagatagaaccacattgactcacattctccttctacttccatttgagtgagcaccaagtatgcatcacgacttgagattataaagttggcttaatgatgagacaggtttctcagtcgggttttccattggctcgaagttcacaaggcagttgttgcttgtctcagagtgtccttaggtggactacatctgaacccttggcgttattatartgcagattctagctgtgctcaaaccaatgaatcagaatctcaggagggtggcgctcagaaatctgcatggttgatcagttctttagcagattcttatttttgtaygctaaagtttgagggtcaccactggagagattccagaacagggcctgcaagggaattgttcaaagtttgctcaagttaactttgttgttacagcattagcttgaatatcaggaggttttgtatttaagttctctaaaaaaagaaaaagaaaaaaagagaacagtctcaatatataaaaggaaaggttttcatatatgtgcccaattataagtatcttgagtattctaggagtctaaacagaatgyctttagatcatccttataacgatcctgagactcttttgactgttttgagttgaagacaggtaataagaaagaaatcaccaattaatgcagaaggaaataaatttctgtatataataatattcacatttgccatgtctcttttaaaaagtccaaataacaggcagagcgcggtggctcatgcctgtaatcccagcrctttgggaggccaaggcgggcagatcacctgaggtcaggagtttgagatcagcctggccaacatggtgaaaccccatctctactaaaaatacaaaaattagccaggcgtggtggcacttgcctgttgtcccagctactcgagaggctaaggcagtattatcacttgaacccaggaggtggaggttgcagtgagccgagatcgcgccactgcactccagcctgggggatagagcaagactccatctcaaaaaaaaaaaaaaaaaaaaaaaaaacagctcaaataactttaccgtacataactttaccatacatgtcctctagtctcttatcatttcttcatatgaagaataatttatactcattgatgtaaattttgctatattttatacaacaaacatagtattattttaatattgcacatagagaaaaatacctcttcccctcaaaattagaagggttggtatttttattcaggcttattgatttaaaatacctgcttgatccgtaattcaggccatacgatttcaccaaaacaaatatcctaatagttgtcatcttgaataactgtttagtgcacagaatgtagtctcatttattaagaagtgatttaagagattattacttctgcatctatcacactaacatgaccaactctttagtaagggaagagtaagggaacttattttatatctagatagaaattttattaaggatacagtattaggattcatasgggaaatagtggatagatcacaagaacgaggctctttctgagccctgcaggaaagaatatttgcagaacaataaaggacatggtggcttcctggagaatgttggccgaagactgagccttacttctggaaaaggctcagtgctagagccaagtgagcatcgatatgccaatacaggcaagaaaatcctgcaagaggcagacttggttcttaggtcggaacaggctctgcttcagaacttgatccggtacccaattcgtttctgcttcagcttctttttctataaaatgagggtagtacttatcccatgagggagctgttatgaggataaatttggctttattgaatgtgcatgattcctggaacccataaagatgtcaaatttagaagcctcagagagatttcctttgctctgtgaataactaaatttggttagctggggtggggtctgggtacttttccttgtgaagaatttttccctcattctggtcatctcctcccctcctatagaggcaccatatatttttcttgtctcaggtacctatagtgataaaacaccctgagctgaaaggatcgctggatagggcagtctcaatacaaaagaatgtggcagaagctcaggcttcagtgcacatcagaatagaagcttcatgagggcagaggcttttgtctgctttcctcattgcagtatccccagaactttgagcaagtgcacactcgatraatacttgaaagaataaatcaatgtcagacatctgggcttatgtctcatctttctactgttctcaactaagagattctcgtcattctacaactttcctgagcctgctctccttctccarrtattcacccttccaggcactgactccayctcccacatcrgagctttttcttaaagtaaataacagtcaacaattaatagcttcataactttggaacagtgcagtgtctttggtttaagaagcattgtttccatcctccaaactaaaataaattttgagaaaagatggaratggtttgggactggggaagaagggaatggaagaagtgattatttgagggcacattaactatttgtacaaagtagaatatcttagttaaatttggctacatagcaagcaggtatcattaaatggatgtctgttagaatcttgattttcaaattaactagatagtcagcgttagttagactgaggaagggtgattacagtcctatgtcactgagggagaatggtgaaagggcaagagaaggctggcaggtagagctggaatttgtctgccagcaatagaccagtggttcccaaatgtaagcctgcaacagaatcatctggagggcttgttttttgtttgttgttgttgtttgtttgtttttggttttgtttttttgagacagagtctcactctgtcgacaggctggagtgcagtggcrcgatctcggctcactgcaccctcagccttccaggttcaagcgattctcctgcctcagcctcctgagtagctgggattacaggcrtgtgccaccagcccagctaatttttgtatttttcgtagagacrgggtttcaccatgttggccaggatggtcttgatcccttgacctcaygatctgcccacctcggcctcctaaagttctgggattacaggcgtgagccaccgcgcccagccaggagggcttgtgaaaacacagatagctgggcccatccctagagtttaggattcagtaggtctggcggaggcctgatagtctgcatttctagcttggccaggggatgttgatgttgctggtcccaggaccacattttgagaaccactgcaatagagrgtgtgcatgaaratacaacaacaattacctgatggtccttagcttagttcagttgtcccccacaggttgaagcagtgttcaagggcaaacaaaaactttctctctcagccacctccataagttccatagtttatttaacaaagcaaactcacaaagaaggaggaagttagractgctccatttccccttatagyaaaggcatgtgtatttcayaactgcaatcagcttgaatagcagaggctggaaggctctccatgtctttactgaagtcacstcactaagtcacacagacatgctgctaattcactgccttggccagcacatctgaaaataaatagcaccattataggccctttcatgaatatacagcatgtggcctctaaattggccaaggagctrgctatgctgggacaaataacttagataaatcacaaatcagagtggagaaatgaggtgtttttaatcaacagcatccaacaatgtgtgttgagtttaactgaatccaggtagaggagggagtgggtgcaagagctcaaagtatgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcctcagcctcccgagtatctgggattacagacatgtgccaccatgcccggataatttttgtatttttagtagagatggggtttcaccacgttggccaggctggtctcgaactcctgacctcaggtgatctgcccgccttggcctcccaaagtgttgggattacgggcgtgagccaccatatctggccctgaagagactcttaagatactttcataatagtttaaaaagctgtatgtgtgtttacaatttctgtcataaatctatggtaaccacagcacaaacattttagaaaaagaaaaaaaaaaacaactctmggttgagtgtggtggttcatgcctataatcccagcartttgggaggctgaggcaggaggatcacctgcatccaggaatttgagaccagcttgggcaacatagcatgacccatctcgacataaaattaaaaattaggtatggtggtacatgcctgtagtcctggctactctcaggggactgaggtaggaggatctcgtaaktcctggagtttgaggctgcagtgagctgtgatctcgccactgcactcagcctgggtgacagagcaagaccctgtctcaaaaaagaaaaaaaattctattttcccacctctctaacataactgtgaatagtagtatttccttctagtttttaagtacactatttaaaaacatggaaggttttcaaataatgtacttagatttaaatgcatttttaagcttatacccatataataagcatagtaactaacagaatgttctttggagtcagatagtcttgggttcaaatcctccagacatttccagccctgagtttygcatttgttaaatagggatgataaacctggttcatagcattgctgtgtggattcactgaggtgctcatcaagtgctcagcacagagccctgtgtcatgtaagcactcagtaaatagtggcatcattttctgttttcacacacaaaaaatgagtcgaccttctgcaatcctaataatcagtaagttcttcttaatggccagaagtatacctatttttagtctatgcatttggcaaaatttcattccacaaattgtttggtggtcccaggagctgctttcaagatcttctctgaccagcttgtcgagagcttttgttatctgtgttttcctcaaagattagactcatgaaagatgtgtgaaagccaaaacaaaggaatgaccactggtgctcagagtgagagagattggtttagttgtttagccaggctatgtggctttgttcccagaccacagattataaccacaccattgtgggcaccacatatagccattttggtaaactagatatgggttgctagggacatgggcaagaaaccatgggtggggaggtgtggacctctcagccctgccctctcaagcctggccaacttcacatctgcaactgggactttgtttctgttccagacctgtttatccaactgccaacttgacagccacttggagtcctcatgagaacctcaaacttagtatgcccaaatgaaattttcagctcaccagaaggtaaccatactgtcttgagtcttacagttaccctgtaaacaaagggattaactttactagatagcaacttcctgcccataaagttaagaaaagagcccctcaatgcaaatgttggttttgcttatcaaataaatggattcttggttcttcaggatagttacagataacaatgggcagaatagccagtaaattcagtaactccttaaaattgttgaaagtattttgtgcactttctttatatcgctgcttagagtgttaattggtaaaatactctgaaggactaatacacaaacactttcacccagcaattccaattctaggactttattccacagatatatttatacatgtatgagttcacatgtacagttttctgaatttttttgtgctggcagaaaactagaaacaacagaaatgaatgaaagagactagttaagaaattattgcccagttttatagtagaatacatatgcagctgtaaaaaaagaatgagggaattattatgtatttatctattaagtgaataaagcaaaatgaagatcaccagcaaacagataaagaaattgtggtattcatacagtggaatactcctccataataaaaaggaatgaacaatgggtgaacactacaacatagacgactctcaagtactgtattcccatttgtgtaaataaaaatgtgggaaagaatgtatacatgtatttgcttataaactctatatgcacagaaggaaacacaagaaattattaccccgggaggcagagcttgtagtgagcggagatcgtgccactgcactccagcctgggcgacagagcaagactccgtctcaaaaaaaaaaaaaaaaagaaattattacctagattgtctatgcagagggaactgggtacctggcagacaggagtaggagggagacattgtacaatatgcttttttatactttttatatttaaaattgcaaaatatcttacatgctcaaaataaaaatagaatagcttatataactatgtctaaatattacatgtagttttcttctctggctattttctttttggtttttatataattttttaaaatccacttacttagcccaggcacataaatggaaagaaagatatgcttaaaattatgttatttgcaaaaacaaatatttagatgttttagagctagtatgtttttgttggtttctagtttagttctacatggcatcagactagctactctatatgatttctggacctttgcaatttgttaagatttgttttatggtcggggatatggtcaatatgtaaatgtttaatgtgtgcaagaagaatgtgtactctgaagttaggcatagtgttttctgtatatgtcaattagcacaagtctgtttatcatgttcaagctctgtgtatctctgggtttttttaatctgcatgatagaacagaagtatgtttgaaacttttattgtagttgtggatgtaatatttttcctctacttttgcagttcttgctttatatattttgagcctatattacttggtacatacatatttagaattgttgtgtcttcctggtggattgccctttgattatttaggaaatgtctctctcttcggtaatgcttcttaaagtccattttgtctgatagtactatagctacctcagctttcttttggctaggtttcataactttttaaattctttcactgtcagtctttttatgtccttatatttaaaatgtgtcaaaagaaagaaggagaaagaaagaaagaaagaaagaaagaaagaaagaaagacaccgcgatttacctatgttacaaacatgtatatgtaaccctaaacctaaaataaaagttaaatataaataaataaagtgtctcttcatgaaaactttcttagcatcattagtcattagggaaatgcaaattaaaaacacaatgagataccaccacatacaacatgtctagtataatggctaaaatgaaaaatactaacaacaccaagtattgttgaacatatggaaaaactggaacactgattatgggagtatacaaccaygttgtaaaacactttaactggtcatttacccaagaggaatgaaagaatgtatccatataaagatttgaacacaaatgtttacagcaactttatttgtaataggtaaaaactgaaaacaactcaaatgtccatagacagatgaatggatttaaaaaaaaccatgttatatccatacaaaggaatactcctctataataaaagggagtaaactactaatacacagtgcaatatagatggattgcaaaatgattctgttgaatggaagaagccagaccaaaaaaagagatatattgtatgattctatttatgtaaaattctmgaaaatgcaaaggatctacagtgacagaaagcaaattagtagttaccaggagacggagggtaaaaattaagaaggggcatgaagaaacttttttattgtagtaatggtctcatgggtctatacgtatgtcaaagcttatctaattgtatactttaaatatgtgcagttcattgccagctaattatactcaatctgtttttaaaagtaaaatgtgcttcttataagtaacaattttttaaaatgtagtctgatgacctttgtcttttaattagagaatttaatctgtttacatttaataactgatataggcagggcryggtggctcmcgcctgtaatcccagcactttgggaggccgaggcgggtggatcacctgaggtcaggagttgaagaccagcctagccaacgtggtgaaaccccgtctttactaagaatacaaaaatgagccgggcgtggtggcaggtgcctgtagtctcagctactcaggaggctgaggctggagaatcgcttaaactggggaggcagaggttgcagtgagctgggattgcaccactgcacttcaacctgggtgacagagggagattccatctcaaaaggaaaaaaaaaaaacctgatatatttgggtataaatgttcaatcctactgtaggtttttttttccattttgcccacttgtttcttgttgctatagtcattacaacaatacrtgtttgacttattagaatcctagtattaattagtacttttaccatttcccagatgatataatatgggctttaaaacacatgaaatccgtttacccctcaaaccttttgtgtatcattgatgttttaattctatgtatattttaaacttcacattattatcattattatatttatattgyacagtcactatcatttagatttacttatgtttacccttttgrtgtatttcaatgctttcagcacttctgtgtttccctttgggattgcttttcttctgcctcaaaaactctccttactatttattttagtatggctctgctggtrataaattctctccatttttgtttatctggtaaaatatttttccttcattacttatgaagaatattttcactaggtagaaaattctagattgttagttattttatttcagcactttgaagatgtcattgcattggtttgtggatttcactttttcaattgagaagttaattttgttggttgcattattacactttgaagataatgtgtcttttccctggatgttttaaagatttttctctttgactttcagtagttctactatgatgtgtctaggtttgatttcctctgtattgattctgatgggcatttatagaactttatgaagctgcgtctggtatttttgccagccagtatttctttaaatattacttctgctccagtttcatctctcctcctcctttgggatccagcttacacaggttacatctgttactttatgactcaacacacttttctggaaagactctcttttctttaaacacaagacactaaatggttacaggtgttcttttaggtgattatgctgcttcatcagcagatggtgattatatcaagaaggaaacttatatgatgacatataaaagctggggagaggagatgtctctgaagacagtgagaartccttctctagtcttgctgctggaaccctcaaacacttaagtcatctaataaacattctactgtcttcagaggaattttctmagtgaaagggatttgggacacccctgtgaggaagaaacataagttccatgccttccwaataaggggcaaacttttctttgtagtcatgtttccacctgttgaatccgttttatggaagttgtacagttatggcttgtctgtttatgagaagagatagagaatatgagaaacrataaaacctgaaataatccattgtgaggccacaggctgaagaacttacaaggaatttattctagactttatggctgaaaatatgyatgcatatatgtatatgagtgtatggagatacagttatggatagagatctatagatatatgtgtagatatatagatacataaagtttgctacagaaattcattttgtacacttttaaaagtgcactttactaaaagcatccaagaatgcatctcagaaaaagccttagatttcttttatgtggtcaactccaggaactactcactcttgagatagatgtgtgttttcagascttatccatgccatgcacaatgatctaaccctttgatagctgcatcattcaaagtcagtttttctacatgcaacaaatttttaaaccttgatttttatttatttatttattttgagacaaagtctcgctcttgtcccccaggctggagtgcaatggcgtgatctcagctcactgcaacctccacctcccaggttcaagcgattctcctgcctcagcctcccgagtagctgggattacatgcacctgccaccaagccaggctaatttttgtatttttagtagagacggggtctcaccatgttggccaggctggtcttgaactcctgaccgcaggtgatccacccgccttggcctcccaaagtgctgggatyacaggcttgagccaccgtgcccggcctaaaccttgatttttaaaaaaatactaccctgccctaaccttgtaacttaggaagtttggggagaggggtgtgtaacaacctttcactgcttatttgatgtaaatcatttctagtcctgaaacaatggctattttgcaaggtttaattatactgtgtgttgtggttgcatgcataggtacacccacaaatgtctgtcattaatacgtatcactagctttgtactttacactgtatttgtggagtgttttacagtcgttcgttaccaagagtaaattatatatttgcttttctttaccccacccctttcactattgtttaaaacatgtcagattcaggaaaacctcaagagacccaaacctctttcaatacttatagacaaagtttttttttccttaaatcagttttaaaatccatccagccattttggctgccggccataccagcagataatgaaagaattttccttgagggtcaaaagccagggagaagccttccagggctgtttggtttcctagcacagctgctggagtagctcgtggtgctgattgatctgcttggagattcttgtgcatcttcacctgttagagctggaaagatgctcaggactatacagcccagcccttctggtttacatataatgaaactaaggcccaccttagtcaactaatgtgcttaaactcaagcaaatggcaaatggcaaaactcaggactctgtcaatgagttttcattctttttctttattcttctagacacatattttataaagaaatgaggcagcatgatgtttaaaatacttaaagtgagaatgagaaaaactgatgtctacatatcatgaaatggttaaaaagtttaacgtgcattgtcttctccattagaacttcttttackaatttttttctcaaaatctggctcagaaatcttgttttaaaagctccctaaacattcctaggcagaattagtaacgccttcctctttgctaacaaggaactgtgcatattcctgtaatagaatacttaccatattatattgtaagtattaaattattcatctgccctcctcccacctacccactggatcaggcttcccaggaacagcaacagagagcccagcaatttgtgtgttctcagtgtggaatgaatgaatgaatgaatgaatgaatgaatgaatgadccaaccattccttcacagtcttgcactatcagtgaatcttatgctttattgaacataaaaatcacctggaattgctgacttaaaatacagttttccaggctataccacamgagatgctaatacaggactggggtaggtccaggaattcgaatttttatctaagtagctgatgacttaatgcaaatgatccagcagccacactttgcaagctctacgctatgattagttgtggtttgtagtcccaattgtatatcataattatctgctgatctgaaaaaaacatagagcttctctacccactccttaccaccartccatcaccaccattctgactccttagtcacaatgggtattgacattttaaataaatcccaaggctcccttccgggaraataaagargataatatttataaactattttgagttccttagaagaagggtatcttagctcattaaggaaatattatcatgatataaatctaacatcatgaaacttatcttggacatgtcaaatttggtctaagaatcaaatgtagaggaaaataaaacccacacacagtacctgcatggaaacggaacctgtgcaaacacctgctttggctgtgttcctttttgtggagacagatgtcccccttctctaggaccagggtagagatgaagaaggttgatttggacattggggtgctatatgttcttttgggactgaagttccatattaggaaacttaatagctgacatttacataacttttaaacatcccaagtagtacgctctgtctgcacactattttatatgtatgcaatttgtttgtttttgtttttgttttgagacagggtctcactttgtcacccaagctggagtgcagcaggcatgaacacagttcactgtagcctcaacctcccaggctcaagcaatcctcccacctcagccccctgagtagctgggactacaggcacacaccaccatacctggctaatttttgtattttttgtagagactgggtttcaccatgttgcccaggctggtctcaaactcccgagctcaagtgatccacctgctttggcctcccaaagtgctgggattacaggcatgagccactgtgcccagccatatggatttttttaaaattatgaacttacataacttcacaggagacagacctgaatgaggtagttattaaactactttctgactatggaaaggatttctaatccttgtagtatatttccacgtatattgttatactgttgtgtgtttgtatttagttgctcatactattttttactgtagcttactttatatgcaggtttccatgggtcaacctaatttatatttttgtcattttaaatggaaaaatgatatcccatatattttgtagtattatttgttcagtgttctttccaatgtgggatgctttggttatttctaattatttgctatcatgctatcatatacagaattcttatgttcatttctgctcaaaattatatttttgtttgtatgaattccacggtgtatatttcccaaagcgagatagttagataaaagagtaacagcagtttcatagttctggttgcatattacagtattactttccagacacacagagccaatatacaaccccaccaggggtgtgaggcatgctggttttcccacagcttgaccaacatgaaattttatcattccagcctatttctgctagcttaatatgtgtgtagggcctcactagagatattttattttgaagttcttcaaatgwtatgaagcaattcttttccacgtggaatgattcactattttcattttaaggacaaaccattcgttygtatttgacagttttgaagtgacaggtttaattgccttctgtataattgattctgtagggagagaaaataggagtgctattaggtattgggttaggctcaaagwgtcaagraagaagattagttgtgtagttctgaatttggaaacttgtatgtggacgactggaacagaaataccagttgaccctgtttaagaagggctagagagcaggaacattctgatttcatgatgacaaaaatactagagttttgacataggacaacagatcttgcttcaaaatgaaagcaagaccctatccttcctgcctctttgatcctctcacagtgccactttctttcctgaacattttcagatattcttatttcagatagaccactctggtgtataataggaccagttttagagtggccatgaagctaagacatgttatttgagagctcttaggggaagacctggacacagcagtcgcaggagaagtcagtcttatctgtaaaaaggtcagcttgatcacagaaaaagkctttggcttggttgtgttggccctccatggcttatgatcctctttcaagtaagcaaataaatgattgcagtgttggtttgagtcctgtggtgccaaacacaagacacattgttgctcatgcaatatagacctttgttttggacagtggtctaatctgctggtttttaaaacattggtgactgtccaacttataattaaaatcagtctatcaagcacttggagacaaaatctgaggttattctttcattcctagttgtcacactaattttttgccttcacttttgtctctgtagaatatttacacgtacacctatctatatctatttagatataatttatatactacaaaattcacccatgtgtacagttcagtgatttttaatgtattcacagtcatcactacaatcaatttcagaacattttcattactccaaacagaaaccccaaactcattagcagccactctccatttctctacaatatccccaaccttaggtgaccacaaatctactttctgtctgtatagattttgcaattctgggcatttcatataaagaatcatagaacatgtggtcttttggtttagcttatttcacttaggataatgtttccaaggttcatttatgttgtgrtgtatataggtactcttttcctttttattgctgagtaattttccattgtgtggatatasaactttttgttaagtcattcatcagttgatggacgtttggattttttccattttttggcctttatgaataaggctgctrcgaacattcatgtgtaagtttttstggggaagtgtggttgtctttttttttttttttttttttgcaacagagtcttgctccgtcacccaggctggagtgcagtggagcaatctcagctcactgtgacctccgcctctcgggttcaagcaattgtcatgcctcagcctcccaagtagctgggattacaggcacacgccaccacacctkgctaatttttttgtatttttagtagagatggggtttcaccatgttggccaggctggtcatgaactcctgacctcaagtgatctgcccacttcagccccccaaaatgctgggattacaggtgtgagccaccacacactgccagaagtatgttttcatttctcctgggtaaatacctttgagtggaattgctgggatacatgggagctctgcttaaatttttcaggaactgccagatggctttccaaaatggctgcaccattttatactcctaccaacagcatatgcgtgctccagtttctccacatccttgcaaacacttgttattgcccctctttcttgttatagccagcctagtggttgtgaaatggcaactcattgtgatttgatctgcatttcccatttccctcrcggstagtagaatacttacttcctatcctagtttttccttatacttttaaaaaattaaataaagaaaacgctgtagaaaattaaggagcacaatgtattcttgcagctacagcttcctctggggtttcacacttccttgcctcatcatgtaacgggccaccactaggatgaaggtgctccagtcttattcttccaatcttctctccatttgtcattcagaatcctgggaaagagagacacttgtcctgccgtgagttatgtgcccactcttttgatttgtgtttctgcctagacagygcacagcatgagtgttggcatcttgaaaggaaactggggtgctcctgagggagaatagatgccaaagttgggacaagagcccagtttcctgcctttctaggtgtaactcattgccaaggtcgggagcaaagcaaaccatgtaggaaacctcatcatgctgggtagttaataagtatgccctagcacacgtkttcacagagaaaacataatacgcttcatttgtaatatttaagtattacatctaaagttacaatgtttaaaaatttatatatacccttgttggatacaaagcatgtttaaaatatgtgacctcatttgatcctcagtaatctctgttagtttctaattatattcagtagtggtattggtattgtatgttttggcctcattgtggtttaaatacacttttgtgaactagcctgagaatccaaccaccaacacaatgatgtaatgagaaaacgtgctctgagttccaaacaaatggctaacagataagtgctcagaagtcaacctttttgtaagctggggtatcactggccagcagtcacatgccagcaggtgtgagtagacagtggggaacaatttcctctcatgtgtatggctccctaaagtgttggctgagcattgtccacatgggtgatgcaaaggatcactgaactaggagcagttgggaaaaaatacaatcattgggaattcctgtagcatcgaaggtgcctacagggaggtagaagtattcatacaacagttctctggtgttctctgttgtagcaaccagtcagccaaaagggttcagctgcttgaaatgagaatggctggatcaaaatggcagctcaggatttaaaggattctagtcagataccagacatcctcacatagagaaaactctgaatggctgggggagaaggagtcaaatgccctggatctttttcttgggcctcaaagtcctccttctgtcatcatccttccagtattgggcaggacctgactgcaggcatcatggcctctgtgaacttctcaagggtatgtattatcygacaaaaactacgatgtccactaacaggccactgaaaaggtatcttagtcagttctgctcattgcccagccaaggcctrcgttttataacatgatatcaaagattgcatctaaaatygtgatgatttcctaaaataatcatttcatttagatttttctattttaatccaaggtattcttcagyggaaataaggaaacagtttactctcccaccaaaccttggccagtaccatcgacagagcataagtacctctggcttcccctctcttcaactagtaagtatgagttccaggtttacttagcgattggtcaagtgcaaaagtgcccagggtatgtgtttgcctcctgttccttagatcttcctaccrtcacctcacattctccagtcaccagatcctaactctgtgacygtgtctggacatcagacaatatccctctctctctctgccaaccggtacttagggtacataatagaacctctgggagctgtggttttgatgtctctagactaggtgggcttccaggtgactcagtctcatccaaattatggttcatatttgggggagaagggctagcccaaaaacttaccaccatttgtagtatgcatttttttggaaaagcatattccaaaatctgaaatgccaagttacagacctcctttttgtaaaataattttcttgctagtataatttacatataataaaattcacacattttaggtgtacaatttggtgaayttgggcaacttagagtcacttaacctttcctcagtcaagatatagaacacttcttttatcctaaagcgttccccagcgygcttttacaatctcctctccccaggccacaccctccaactcacgcaatctctgaytcacttctgtcaccataattttgctctatctggagcttcatatcctgttacagtatgtacaaaccttctttttttgagacagggtgtcagtctgtcacccagcctggagtacagaggtgtgatctcagctcactgcaacctcaacctcccaggatcagatgattctcctcccacctcatcctcccaagtagccgggactacaggcgcatgccaccacacctggctaatttttgtactttttgtagagacaggggtctcgctatgttgcccaggctggtcttgaactcctgggctcaagcgatcctcctgcctcagcctcccaaagtgctgggattacagtgagccactgcacctggccctaaaccttcatttttaaaacacatttcctcttaaattgaagattgcctacatttttatatcaatgccaattgttgagtgtgcctatatgtgttatattatttgagcactaaatgccagatgtgtgccaagtgagataaatctgacaaatgagatggtttgtaaaaccagsagtgaatattcacttcctctgtgagagagctccagccctcctgtactcacttcctcacacagcacagcagcactcttgctggttctgctgcttatsttgaagaggttaggttactttttgtttctasttattacttcgaaaccacttctgccttagaaattttgtaaccttccgctcagtttccggtaaccgccattttgtctcctgtaacaatttacgcgccgtgtaactgtgaatctttcaaaggtatgttttactggagtgatttctggttatttcagaaggataatttgtgttgcgtcactaatgaaatagtagtacgaaaaaacctatagcatcttttactgcaggaggtaactttccatgccattttttcasaaaatctacttatgacttcagtggcttgctagactggcctttttatttgtacttttcctgtgtttcagaattgcagagtataataaaggcatgtcaagtgcatattgtgtccattttcaggtatattagataagctttacaccaagataaattagatatgcttattggtttaatttgtgctaatatatatttaattgaaaaatcaaaaaaawttttttaaattgactgaagttgtattccaaaacatgcaaaatttagtttaaaatagattggatacacttttaaattttaaacaaggtagagggtttagtgctttgcttttttaaaaagtaaatgaaggctgcagctttctgcagtagttgtcttgggaagtagtgtggacatcactcctaagagacgttaaggaagtttagctaacaggctttaaccctttctctccataccagcttttactcttttttttttttttttgagatggagtttagctcttgtcacscaggctggagtgcaatggcaccatctcggctcaycgcaacctctgcctcctagttcaagcaattctcctgtagttcaagcaattctcctgcctcagcctcccgagtagctgggattacaggcatgcaccatcacatctggctaattttgtattttgagtagagacggggtttctccatgttggtagggctggtctctaactcctgacctcaggtgatccgcccgcctaggcctcccaaagtgctgggattacgagcrtgagccaccatgcccggccaccagcttttactttaatgccacagccttaaattttctttcaggagaaattattttatgtaaagttacaaaggaaaataatgcttaatatctgtaagcattcrtttggtaagtttgctgcctcctcagtaagttttgatgaaagtgaattttgatgaattactaccttagccgggtagtgacgttaacatgtggcttagctgtccattttctaagatatcaagaaaccagcaacaataagtaaaattgttaaattatgcaagaatcacatgttcctacctgtcatcatttagtcttggttctatttgcatgtgaatattctttagaatatattactcccagttattccgctttacttttctgaatctcttttcccatctcttgacttcaacttcagtatatggctcttgttccttctacctggagaacggaggcatgtggaagcccagaggattgaattcttttttttttcttttctttcttttctttttttttttttagatgaatagtctgcttaggaaatccatctccataatgtttacctggtatcgtgttgtaatgtcagaatgaagtggctgttcttccccttgagtcatcgtcccgaatgaaggttccccaaaagaaatcatcaacttacgtggtgatttccttttacctttaaaaaaaaatttcttttcatggaaagataatggaacatgtcggtaagattcatttctaggaaggcaaaggagtagtttatcatctaaagactctcaacctaaagctgttttagaaaactttccttaaaatgagaagccgtaggttttcgttgcattattttggctaattgaaaaataagaccaagtgcgttctgaccttcgtttctcttacctttatttttacaaccaccatttcmatggcccacttgctgatacaaatgattgtttaattttaaaaagcatttaattgaagtcaagttatttagaacctaatcatttacacgtctttgttgttgctgctgttttgcaagagtgaagagcttggagtcaggtgaatctgsgatgargtacagttgtcatttattagtcatgtaatttgtgacaagccacttaatctctctgaagacttcagtttcttcatttgtaaaattggcataataatgctgtccctagtagggaatatagaattatataataggtcctttgtatatattggctagtattgctctcttacgatttggcactatggagacactgtgggagattaaaagaagatgatgaataaaaggtgacttcagctctgaagggctttatgatccatttgggagaacaggtaatgtagaatatactggcttcaaaagtggcaggtgtttagaagagaaaaggatacatgatgtgataggaggcaaaggcttgattgagaaggctgagaagacttagagtaagggttctcagccctgactggacattaaaattatctagggacaattcaatcagaattcctgggggtggggaccaagcatcagtattttaaagttccctggggactttaacttgaagcccaggttgagaatcatttaaacagctctgttatttatttatttaaaattttaatgtattttttgagatggagtctcgctctgtcacccaggctggagtgcagtggcgcaatcttggctcactgcaactcctgcctcccaggtccaagctattctcctgcctcagcctccccagtagctaggaatacaggcgtgcaccaccacaactggctaatttttgtacttttagtagagacagggtttcaccatgttggccaggctggtcacaaactcctgacctcaagtgatccacccacctcggcctcccaaagtgctgggattacaggcatgagccactgggcccggcctagttttacttttttttttgtaatggaatttccctctgtcacccaggctggagtgcagtgatgtgatttctgctctctgcaacctctgcctcctgcgttcaagtgattctcctgacttagcatcctgagtagctgggattacaggcagctgccgccatgtctggctaatttttgtatttttagtaaagacggggtttcgccatgttggccaggctggtcttgaacttctgacctcaggtgatccgcccgcctcggcctcccaaagtgctgggattacaggcttgagccactgcgctcggcccatttaaaaaaactttaaaggtagacgtattccaaatggggggaatatataaagaaaggtaacacttattttgccctgtgtgctttgaatttcagaaggtgtagtaagcaaagaccacttactaaccctacagatatatccttagaaaatacagtggtttctgtcataaatctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatgataaacttgtcccaggtctatttgacactcctaccaaaatcctttgtgaccagggctagaaggcagctgtggctagtaaataaccctgtgtgtagactcacttattggctttggcattctctattgccacagctgtgtgaatagattaaccagagaccctctgstgccagccacctattcaggcaaacaagtctataatcagtacctctgttaaaatgaaactgtaatatactattgtcttttcatttatttatttatttatttagagacagggccttgctctgtcgcccaggctggagtgcagtggtacaatcttggctcactacaacctccgcctcccaggctcaagcgattctcctgcctcagcctcccaagtaactgggaccacaggcgcaccattgcgcctggctaatttttgtattttttttgtagagacggagtttctccatgttgtccaggctggtcttgaactcctgagcttcagtgatctgcctgccttggcctcccaaagtgctgggattacaggtatgagtcattacacccggcctattttctgattgttcaaagtagaagccaggcacaatggctcatggctgtatgtaatcccaacaatttgggaggcagaggcaggaggatagcttgaagccaagagttcgaggccagcctaggcaacatagtgagaactcatctctacaacaaagttaaaaaraaaaattagccaggcatggtggcacatgcctttagtcccagctacttgcgaggctgaggcagaaggatcacttgaactcaggagttggaggctgcagtgagccatgattgagccacagtactctagcctgggcaacagagtgagaccctgtctcagaaaagaaaagagaagagaggagaagagaaagagagaagagaagagaagagaagagaagagaagacatacaaaagaagagtaacatacaagagaagagttaggagaccctgtctcagaggaaaggaggggaggggaggcgagaggacaagagaagaaagagttaggatctatgccctaaggaagtaaggaggatttgagactgtgtaggtggttaataaccttaagctacatattttatggagggaaaaatcctatttttaaaagtgagaatagaacaattttgaagtgaaatggaatgaattagctggaccataacggctctgactgaagaaaaggatgtaaaaagccacatcctggatatgtaccaaacaccatggttacatggcatgtttgtatatgtaacatttatttaaaaaaaaagtctcatagcttagaaggcatttatttttgttatgtgtataggcttctgtgcaataaagcagccttttttattttacagctcatgatgacttaaatggttaattgcctgataaatatggtcctcttttattcttctgattctgttgttcttttgcacttcatctttcaaggggttgggctattcttaggtttcactgattgcactggaagggacatgacggaaaatgaagatctcaagataattttcttgcaaattcacaatggaagataaaaggaaagagtggcaggcattctgcacacagagcagacgtttctttattgtcattgttcagcagaggaatcaactcagccttggtgaaactagagtgatgcccatggtggcatgtcagcatctccctcttagtggcatcagtgctagattgttgttgttggaagcaggagagtgtttagtccataaagtacagaacttcgatatcacagaagctagaagaactttactgccttcagcttcgtttaaagatagtagagagcttactcattcrttttagaaatatgtattgggtctctatgtcaggaactgctggcacagcagtgagattgaagatacaacagtgaatacaatagagggcctatcctcatagagtttgcctttcagaatgagggacagacgcagacaaatagaaaatgtcgattgtgtcagggagtattgagggctttgaagaatgaaatcgtgacccagaagagatgcttttagattggatcatccgtgaaggcctctatctagaaaggagacacttgggcagaattctgaatgaacttgacggacatctgaaggaaaaatattccagtcagaaggaacagtacgtgcaaagtccccaaaacttcaataagtgacgtgctccagaagcagcaaggaagcagaatgaggcctgaacagagtgggcagtaggaaatgcagtcatagagaaagcagggctgggtcacaggcctcagagactgtagaacattggctcctactctaagacaggaagctgctgtgagcattgaggttgggcgtggaaccatttgactttttatgaggatcactctggctgcagtgtggaaaatagactggacgagggagggcagttaggaagatgtcacggtaactcaggaaagcaataccggtgctttggacgagggtggtggcagaagagaaagtgagaagtattctggatatatttcagaagaaagtggataggattttctgatgggtgatatgtagagtgtaggagaaagagaagaagcaagattgactttaatrttttccacctgggcaattggtggactggaattgccacttgcagaagtgtggaggtatggaaggtatgggaagagcagattgccaggaaarttgagttagttttgaactcattgtgtttgagaggtctgttaaattatcaagtagtgatgttgaggtgtaattggaaaagtcaacctggaatttatggcagaagttgaggctgcagatataaacttgtaattttaaaaatgtatatttaaagccatgggagtgaatgagwtcatttgagattgaatgcagattgagaagagatttagaattgaactccagggcactgcatagcaggaggaaaacctagtaaaagtggtatctgtaaamtagaggaacgaactgtcacaatttgcctggtactgaggattttctcagtacatgagactttaagagactgggacaccctgagacaattggttgccttccatgggaagaaagtatgtcaagagggagagagtgaacaactgtgtccaataaaccaggactgagcaaaaaccattgaatttggcatcatgaagtcttaggtgactttgacaaggcttgtctgttgtgaacagccaagtaaatgtgaggaccactctccaaaaggtaaagaaacatgcatgaggatacaggtgcgccagctggagacatcatgcctcttccccgtccccaccaggagtggcgtgaagcctccccagtgctgtaacgaggcagccaggtcctgtgtgactgcacatgtgacttggggcaagtcatttaacctctctgttttcactatcctatttgtgaaatattgtttagatttgtgstttgagtcagctatctgtatactacactgtgttaggagctatgtagattaattttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctagtctactgaccagaagtctgaaaaaaacaactaaaaagaaagactgmataagccttcactagagaagtattgaaaattgcttgagggaagtgacggtttctttagcctagtgtctgtaggaccccagtgtagtgtttgttgaatgaatgaaaggaggcgtatcagtcaggttcactcagagaaacagaagctgtaggaaatccatatggatgtgtgtgaaggtattggcttgcctactgctggtgtgtggctaagcgagcttaaaagtccgcagggcagatagtcaggaaggaaatattcccaacagactgagctcccttgggcacaagctgaagcctggagtctgaactgccagagagcctctaccttcttagaaaaggcttcccactggctaagtcaggcccacccaggggaatctctcctttgattaacttaaagtcacctgtttagggactttaattacattggcaatagtcccttcacagaagcacctaaatgactgatkatgtaactgaaaaaatgtgtgtgtatgctacaaaatggctgcagtctcccttctgtcctccagctcttgcaggagaactctcttgtagctcaccctgtctgaaaacatactggaaaggaattcaaggaaatgtagttcagcctagccacgttgacacatcatgaagccgtcacaaaaggtaaagcctggtttaggagcatttgcatttgcagtcttaagtatttttgtcttatttttcaaaaggggttgggcacggtggctcacgcctgtaatcccaatactttgggaggccgaggtgagtagatcacttgaggccaggagtttgagaccagccaggccaacgtagtggaaccccgtctccactaaaatgacaataattagccaggcgtggtggcgcatgcctgtaatcccagctattcaggaggctgaggcacaagaatttcttgaacccaggaggtggaggttgcagtgagccgagatcccgccactgcagtccagcaacggagtgagactctgtctcaaaaaaaaaaaaagttgttttggtttttaatttttgattttttcttatgttattacatataacgaatgatatgcatactctgaaaaatcatgacataaaggtgaccttgaaattactttgatgttcatttaaactagtctttggtctccactggctaggagaccacatatagcagaacagcagagaaagcaaaacagttaattttcatgtttggcttttgagcttccagggacccaagtcttgccttgaaccgatcttaggaaattcctcattccctacccgaccctgtttctaaactgcatccctgctgaaatgcaatgccactgtaactctctccaatatttgttttcttctttggcttaccactagatgtatgtatatatgtttgtgtgcctgtgtgtgtgtgtgtgtgtgtgttgactgcctcatagtaaagcctactcttgagattaagactcctgatagtttagagaacagaaatcttttttagttcctggttattacttgaatttgcaagaggaacaactgctaggaggcctagttaacagtagttagggtctccacccacttgccaagggcaagactagtttacaccacatttggaatgaccagtttcctcccactttagtttcagtgtagaaagagtaggggagacgaactattcaatgtcagcttgggtgtagtgccagaaccgtactcagtaatgctgtcattgctgttggtgctyaccagctcttcagtactggaatagcttcagacctcgagagtttatgactttatcatcaactgggtgtgttgcccttggcacattgccacacagtgcttaatgatgatatatgttctttatcaaattccccccaccaaataatggcattatttacgtgtgagaaagttgcacatttcaccacctcatggtttattagagtgcaaytccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttttttttttttggttttctagagacagggtcttcctgtcactcaggctggagtgcagtgatgtgatcacagctcactgcagcctcgaactcctgggctcagtgtttctcccayctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggtgtgagccaccttgcctatccaacatgacaagtattrttctctggcaggaagtgaaattttttctcactgatgattgcacacaaatgtcatatctccatgaggcttctactcactagttttacggctcatgtcaccttgcttcaaactatgcttcagtataattttgaagtgtatatttccattgcctctccttgagtaattgatattcttcacaataagtttacatttattatcacttttatttacttactattattactctgagcagccaatcttatgagaagctcagagtggaacgtgtgggtcctggtaaatatattatttgactcacttccaaacacacttaatattgcctggtgttttgattatttcaaaatatacagatttcttgaaaggcctgcaaaaggaaacaatcaaaattatagcggttaagaatgtgagtctgccttggtttgaattccagatgggccagtccctagctgtgtaatcatgggaaaattattaaatctctagcctcgctttcttcatctgtaaaatgagcatacaggctgagcatccctagtccgaaaatgcaaaattcaaaatgctccaaaatctgaaactttttttgtgcctccatgacgccacaagtggaaaattccacacctgacctcacgtgataggtcacagtcaaaacattgtttcatacacacaatacttttttttatttgtataagtttaagtggtacaagtgcagttttgctacatgaatatactgcatagtggtaaagtctggacttttagtgtctccatcacccaaatagcatccattgtattcattcaggaatctagcatccctcaccccctcccatcttcccacctctccaagcctttcatgtctagcattctgtgtccatgtgtacacattatttagctcccacttctaaatgaaaacatgtgatatctgtctttctgtttctgagttttttcacttaagataatggcctccagttccatccacgttgctgcaagagacatgatttcattctttgttatgactgaatagaattattcaggcacaaaattattaaaaatattgtttaaaattaccttcaggctatgtgtataaggtgtatatgaaacataaatgaatttaatgtttacatttgggttccatcccgtggatgtctcattttgtatatgtaaatatgacatgatatgaaaaattcaaaactctgaaacaccaattgaactcaatttgcagtaagaatgcatacctcacagggttatagtgaggattgaatgagacaatcctagtccaatttctttgcacatagtaatgctcaataattattacttaaatgggtataaactttatagtaatgaggttggggctggaaaaaatgcagtttcataatttcctatagaagtcatwcaatcctgactctaaactctgtattccatgtggtggttgggtggsgtgggagagtcctctttatcctgtggggttggtcctatggaggtgtctgtggcagattggcagatgcatttgtcttgtgcatagatggtgtctgttgtttcctctggcagagttcaccagtgtcctaatgcaaacttagtcctcatctggctcctgcacaggctgatctctggctcctttagcccctcatggttcctgttgtttcattttcagagggacccttgtaaggactatagtcctctcttcagctgacyttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatgtaagtcagcaatctcattactcggtatatagccagaggaatataaatcattctascataaagacacacgcgtgtgaatgtttattgcaacactattcacaatagcaaagacatggaatcaacttaaatgcccatcaatgacagattggatgcagaaaatgtggtacatatacascatggaatactatgcagccataaaaataatgagatcatgccttttgtgggaacatggatggaactggaggctattatcctttgcaaactaacgcagaaatagaaaaccaaatgctgcatgttctcacttataagtgggagctaaatgatgagaacttaccaacacaaagaaaagaacaacagacactgtggcctacttgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaaggcagtgcaagtaaagaatccaagatatttgttttgttggtccactggagggtagagatagagaaaaacagtaacttccccaccacccccaacctcccttgggctgatgactccaaagactgccataaatgaacacttcatagagctgctattaatatgacacaaatctacttgatctaagggattcttttactttcttagggtggtcattcctaagtctttggatttcacagaaaagaaaatatattttaattgaggactgacaaaggttgccaactttttatcaattataagaattgtttttataattaccatcaatttctattatttcttttactccccctctttccaactgtggaaggtaaaattgaagagcaaagaacacttatttcaaagtgagtaaatttagctatatgaaaactcagcagattgccctgagtttccttgcgtagctgcagtccagtggaaatttcttccagaccagcaccagtcgccccagtgacatttagaaatcactgccctggattgtttcagccaccgaaacactcggtgttcactgtcagctatgattatatatgaagtgctttcgagaaccaatgtatagcataacttaggccaaaagaaacactgtgcctaaacastcagccaaggagtgttgagtttgcctggatttctggaaaattgtctccgttccctagttcactgtatttgggtaarcaaaacatggcctcggagagcctttgcgggagaaattataaaaattcagcaaagctttgtgatctcattttggatctcctcaggattcctcatcaagttgcaattaaggagagaaaaattccgccttggggtgggattttaattactcatsatgttatgacttgactttctgtgctgcatttttttccatatcactacttctgtgtttgacagctcctccaaagagtcgctccgttttatgccaggagcgaagtacttactaagtcaaaggaaagcaaggcaaacatctactattgcctttgtgcttttaccagaaaactgggtgagaacctccttttccttttccctgcccctccagcctcagttttatgaccctgtggakccagtgractttgaaggacttctgatgacacacctgaacagcctggatgtgcagcttgcccaggagctcggggacttcactgatgacgacttggacgtggtgttcacgmcaaaggaatgtaggactttgcagccctctttgccggaggaagggtaaatagttttctaaaatgtagatgtgattgggattgtcatgattgttttcaataagtgggtaggggagatgccttcaatctgaacttaaaaataaaataaaattactcaatccattcaaatgtgtgggacagctatatgatatcatcatgtaagtatagatagtttttaaattagtttggccagagattttgaaaagctatgtgaagactaagccagtgcaagggatgcaggaggaccaaatgaaatgctcaagaggaggttaaaagtgcaggctctggagccagaccacctggctgccagctcagtgaccttggctgtcacatgacctcccaaatcctcggtttctccatttgtaaaaatgtcaagatttttaataataattactgaaatgccaccatccagaagcattttaattgcttacagttatgagactggatcaagttagaaacataaggtaaacccacattyattgagcatctactatgttctgggtactgagataaaaagatgaataagtcaaagtccctcctttaaagaaagtgtcatgcagtgctaaaacagtggggagagctctgtagaataaatatgtgaatagctaattagggcttgagtttctatagttggctcttctatatgtttataggcttgggcattagtttttggcatcaaactaactgtggaattgtagctaaatgaaacgcctgttgcttctaaaatgtaaaaaaaaatgtctctttggaggtttaggataaacttttatttacatttattttaaaagccaaattaagattcatatcctcctggacaggttccatcttctcatcttccccagaaggtcccagaaagaagatcctgacacacagcccctgccctctttactctgagatattctagttctattttggattttatttcatcacagtttaaggaggttggatgataatgggctggtattattgtgaaccgttgctctcttgttcagacagtcctcactcacataggagaactgaccatatgtgtagctctgatgttttaaaaatacacacttcccaggaaagaaaaacattgtcatttttgggaaacatactcccccattttcagtccatttattcaggtatgactttagtataagttaacacctactatttcatctttagtgaagaatcatttaatttattcctttatgtaaaatttatggatgtttccaaatatggtcagaatcttggaaaaagctgtttaaaatgcttacagtagccagtcaccgcagcttgttcctgtggtcccagctacttgggaggctgaggcaagaggatcacttgagcccaggaatttgagttcagcctgggtaaaatagtgagaccctgtttcttacaaaacaaaaacaaaaaacagtacaatgaatttagaggaaggaggaggtttttttttttttgaaatttgataaggaagataatttctttacttagcatcagttttttagtatactgttgccttgtcaaaagaatttataggtaacatacctgtctgatgtctttaagacagcctctactatttcagttgttgccaaaaagtcttctgtataattaaggcaggggaaggtatcatcatcacaccagagtaaacaatagctgactcctgttgaacaacctgtgcctagcccagaactttatgttgagctgtgatggcgtggtagtgaaaaacatgaacgctacaggtgagctgcctggattcaggtccctgctccaccacttgctgtgtgacttggaacaagatccttaccatctcatttttctgcaaagtgagaataatagtaatgcctgccctatggtgctgattgagaattaactgaattaatacatataaagtgattgcctcagtgcataatgcacagtaaatgctacctaagtgtaaactattaatatcatatatgcgtcttattgtgtgccaggcagtcttctaagcactttgcacactaaccgatttaatcttcatcaaagctgtctactaaaaggggcactcttactactctaacagctttaaggagaggaaactgaggcacagaagggttgagtgactggcttatggtcacatagctataagcgatgaagctgggatttgggcaattagggcccagagactgcatgtgtaacctttacaatattttatctaatactaacagcatgtctctgttcttacctccttatcacagatgagaaaattaaggcttgtagcatttaagcctgtttatttctggtactaatgcatttgcaacaatagcaaaaagctttgctacaattgttatttttgatttcaagactctgaagcacttgaagagtattgctcatggtgcattccttaagtagacatgacaggaaccaactgaattaatgatcaccaacaaaagccagtgtttgcaatttcatcaaagcataagacaactgttctttttcctggctttcaaaaaggagaacacgcgtgtcctaacaaggttacacatgcataaaaaatatgtccaaattaccctgtcagagataggtatttatacttattttccttgttttgtattcgaatacagctagttctacctgtcttgtgtctgaatgccttcggggatagttataatttaacatgattctgtataataaagaaaacccacaaagcaaaaaaatgccaacatgtttgtctcatcaaagtaaaaatgtttattgccccaggaatacttcagacatttggaatgattgggcaagaacatcctaagcattctcactgataaggatttaaattcgtgtcatgttccttgctcatgattaggggttgttttgttgttttacccagtaataacgtgtttatttcattttctacctcattagggttgaactggaccctcatgtcagggactgtgttcagacctacatccgtgagtggctaatcgtgaaccggaagtaagttactttttttccactttttgtatataaatattaattttatattgctagtttttaaatatttcttaatactttgaacagttctaggtttacagaaaaattgcatggcaaatagagttctcatgtatgccttccttatccccactccatatcacacacacagttccccctattatgaacatctcactttagtgtggtacatttgttacagtagctgagccaatatggatatgttgttattaactaaagaccatagtttacattaatgtttactttttgtgttgtatattctatgggttttgacaaatgtgtaatgacatgtatatgcctttacagtatcatacagaattgtttcactgccctaaaaatcctctgtgttccacctgttcatcctccctccctggcaaccactttcctttttyactgtctccataattccaccttgttcttcaatgtctttttgtggcttgatagctcattttttttattgctgaataatctttcattgcatggctgtaccattgtttatttatccattaacttactgagaaagaaagttctattttaaacataaagaatagactgcaagcttgcccaacccctagcccgtgggcaacatggagcccaggatggctttgaatgtggcccaacacaaattcataaactttcttaaaacattatgaggtttttttttttgcgatttttttaaagctcattagctattgttagtgttagtgtatttgatatttggcctgagataattcttcttccagtatggcccagggaagccaaaagtttgggcacctggaatagagcctttttgttgtcttctaattctgatgaattcccagggggaaaaattaagtgaattgaaacctggcctcagcttcagaggtggcattcgagtttatgaccaagaaataaattacttgctggccttccagtaagggatctttctctcctggattaatcaaaccttctgtgacattgttctgagctttttctctccatgccatggacctggacagcactctctcatgagaaacatctatgcacattgaaattctcagcctgcatgggtgtacmtgttggggagtgagatgtggactctctacagattagggcacaccccactagagacacgtcacagaacctttgacaagacattagtagtttaaaattctgatagcctcactcctcctatacctcagtaagaattactattctatggggtaaatgatgaaagactttgaggattgggttttatctagctcctggaagggtgccattgagtttgtgctgaggttttctggagtaatgtcaatatgcacacattttcagcagcagaaaaagagaaagcattcattattaaaagttattaagagaaagttagatgccaatccatcatctgttctaaaatgaatggaaaacaaagtttgctgggcagtcagataaaattatggtttgctgataataaataaaagatttcagaacaagttgttctcaagtttttaaatgctatcattagaggtactttctggacattaaagatctaaaaaaaatctgagaaggaacaaatagaaagatccattttgatacatttggttttcagatttattttctatttcgggcttgtccactttttcatttctcatggcaatgcacgcttcttggagtagtgatttttcttgatcttgcacaaatgtaagagaaaaaaatgactctttttggaatactcgttgaaattttagaaataattatgaaacacaaatcactcagtttcactctagacagataatcatcatgaacatttgatgtctgtcctttgaatagtgttgggtttttttggtatatatttgcgtgaaaactaaataagattataatatcatttttgtaacatgcattttcagttttcacagtaaagagtgattctcttcctttgctattaaatatgcttcctcaatacaatgattgatgattgcataatatatttataccaaaatttatttaaccaattttaatatttaggtgattccttccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgcygggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaaaaaaaaaaaaaaaagccaggcacggtgctcatgcctgtaatcccagcactttgggaggccaagacgggtggatcacctgaggttgggagtttgagaccagcctgaccaacatggagaaacccagtctctactaaaaatacaaaattaaccgggcatggtggtgcatgtctgtaatcccagctacttgggwggctgaggcaggagaatcacttgatcctctaaaaatagctaaactgggaggcaraggttgtggtgagccaagatcgcgccattgcactccagcctgggcaacaagagtgaaactccgtctcaaaaaaaaaaaaaaaaaaaaaaaaaaaaagattattgacactacatgcatgaatcctcaagaatattagatgttataatttatcaacatttccaattttatttgataaaaggttgtcttttttttcattttcttttactattagattaggcatctttcttctatatatttcttggccattttttatttttcctggtgctctgcttattcgtgaaatttgtgcatccctattaatgtatttgtctagtctgatttatttttataagcactttatttgttaaagatattaacccttgtctaccatgtattaaaaatgtcttccccartatgccttttgtcttttaaagttgtttttaattttcaacattcagaattatttatgtcattaaatctatattaatatttttccttatgtttaattttggcatcatgcttaaaatttgattcacaaacttattattattttctaagagtatgggattaaagcattaatccagatcattagccacttgactgttgcttctgttcccttatgtgtctccatttgtttttatcttttctacagaagcaatggttacccatatatttattatatgcaagtttttgcatcttgttcccctaaaaaagaaaggaatatgtgttttaattttatgtttggcaacattctagggatgggattaccattggcccagttctctgcacccctgtgtaatggagcagttcccttcttaacggtcacctagtggacagggagaagtgtacaacttcagaactcattgtcagtttctggcaagctttcttgtagaaaagttgcatctctttctatccctctgcctcattctcttgcactctgaatctaacactctgcccatgaaaactaaaattcctagcacacactcctcccagggatcattctgtctctatatgcacctgtcgtattttatctgtggggagaatccagtacactattgccagatktccttcatctcccaacctcacacagtacatttttagcttattgttttctgtgagttgtatctgtattgttttagaatgatggtagaaggagaaggacaaggagaaggtggtgattcatataaatgaaaccagctggaagctgtgatgctttcatagataagccactattatgaagaaggagacttcagatttctgtatagacactgaccagggactcgtgggcaggaaggtgtgcaacaccttcttatctttattcagtgagttcccctttggggagacaaagtttggtacatccttctctttccagctccatctgatccacagaggttctgtccagattcaggcattaagttatctcttcatttggatgagtttccagtttttctgtgtcttcataagtggtttactagaaagtcggaggaggatgcaataggggttgctggccatttgttaattagtgattaattatttagctctcctttaattggttatgtgccaaatcatgtatgattgttttgaaagaaatcaagtaatatggaggtgcattaaggaaaaggcaaatctcatgcctcactacttaccagtgtcctacccttcccttaactcactcttcactgcgtaaagcccagctgtgtagcttccagatcttttcataccctcacaaaaaatatttgtctatttatatttttcacataaagatatatgtattaatgtatgtacttatatattacaaacatttctttaaaataactgtccatgtcagagctatatcccattctactgaaatgctgcctagtattcaaagggtgaaggaatgtgtcataagttattgaaactaaatgaccattttggttgtcaccatttttcataattgcaaataatactgaaacaaacatatctgcacatttgccccatacatgtgtgtgaatatttctgagggtagaaatgaagccagtgtacatggtatgctctgataggtactgccaaattcttctccagaaaagtcgtgctgtttcattccattaccaactgggcattaaactggcgtgttcccatattcttgccagtgctggatattatttattaaaataaaatttcagttcctccagtcttcttttagttattattttaatctggaagctattacacctactttctgaatacagtttcctatcaccaagtttcctttccttatgtgttctaaaatcccagttaaatatgcacttaaccatacaaccgtaagtcccactcttgagtatttacataaaacctatgtgcaaatacagcagtttagcagttttatttgtaattgccaagactgcatagcagttttatttgtaattgccaaaaactggaagaaaacccagattgtactcagttgggtagtagataaacaaactctggtaaatccatacaatggaatactactcagcagtgaaatggaacaaacaattgatatatacaacaacatggatgaatctcagatacagtatgctaagtgaaagaagccagacaaaggccgggcatggtggctcatgcctgtaatcccagcactttgggaggctgaggcaggtggatcacttgaggtcaggagttccagaccagcctgaccaacatggtgaaaccccgtctctactaaaactacaaaaattagctgggcgtggtggcacgtgcctgtagtcccagttactcaggaggctgaggcaggagaatcgcttgaacctgggaggcggaggttgcagtgagctgagatcatgccattgtactccagcctgggcaacaaagtgagattctgtcttaaaaaaaaaaaaagaagaagaacccagacaaaaaagataactgcatgattccatgtatctgacattctggaaaagatraagctacagggatggaaaacaggtccatggttcccagggtctgggagtggggaagagggctgactacaaaaggacacgggagtgccctttgcgtggtgctgggactgtagtgcccatgatgtaaaatctgccttggaccattacattagaagaaatcaattccagttatcccaatattccctccaagtgaaatactttggtagcatatataataataattcaataagtattagctattatatttattaagtagtacctatcagaaaacatacttatattagcatgtcaaaggaatgaacacaaaattctctcccatatattgaacgcaccatggaggggggacctgccttcctctggaggaccatacttagtgaagccactttgccttataaggacatgcctttgttatccagaaccaagcagtcaaacactgatttagttagctcctttatttctcagttatctcctgctgatattacatttctccataatatctagagataggcttttatgtccttgctagctgtggtaatggttttgaatcccacttagggggcagaggagtagagtaatggccacttgtgttccctcccaccctcatcattctacagggcatttgccactcaagtactgtaattgagacatttaaatcatacaaataatgctgcccatgaaggatagaggaaatttttagatttccttttaaacctaacagagaaagattaagttacataaaaatgtaaaatacatgatctccagtacattgaaggaaatgtattttcttacttgaaatgtttgtgttacttagactggaagatttattaaatgatttccattctatcactcatgtttacagcaccaaatttggtgtccttgttctaaaaacaatagtacttttctccccatgacttttgaaaatgattactggtttactgattagcatggcgccatgtttgcttgtttgtccaaccttttatctgcatattttgataatgttgtgtggattaatatttgatgacatcctttgggtgatattaacgattttaagctttatttcttctgtcattttctctaaatgaaccaaagagggataaacttcagaatgtttttgatgcctggtggagagctgaactcttaagaaattaaacttgtttacatactatatttattcttgccgcagagacagtgaaacatttcatgagtgttatgggcagcatcataaaagcctttagactttgtttttcatctggggtgattaaggtaattctgaaggaaggttgagctcaaggagagctgagatatcaaggaatggggtatcatctgttttattactccatattttactcccagtgaagtggtaaacaattaaaattcaaacacatcagtgcatataattcagttactcccagaacaccataaaaatgtttccctgatcaataattgcttattatgacatgcatttgttgtgctagctgtcaaggtgcttagctatttgctttctaaaagtatgaaaagcacgcccggctcatcagcctatgtggtaacaaagagcaatccagctgtggatgtcacagagccactcttgacctgttgtgcatagactccctccccacaaatccaaacccactaagactctccaggctctgttaacacacaccagcctggttcagcttggatgccctcctcacaccatgtgggttctgattttccatgccaggcagtccatcttaaatggatgcatcctcaccgtgtttgggcttcaacttcctattctggacctcctcggctactccctaccccaaggcatggagggctgccttgttctgatgcaccttatgattttagcaccaaattgtacaggaagggagagaagggaaaggagaaagaagatgtgaaaggaaagagagggtagggaagaggaaaaagaagatgaggaacacgtattattttctaatcctcacaataggtcctcaaaatgagcaacatttccccctatttcatacttgaggaagctgtgactcagagagactaaggcacttgcccaaggtctcttagtacattaaggagccagcgtctgcacccagttccttctgactctagagcctggattctgctggctgcaccacactgtctttaaagagaacactctcaaaacrtgcttggtctttggattgtctcaaatgtgttagaatagtgttttaagaaaaggaatgcagatctcctgggaagcaataggtcgagttcatttcatgagaatcatttttctagccattggcctacttccccatttttctcctgtctgcatctaggtgcaacaggaacttggctttatttgactccattgccagggtggggtaatgaagctgggactctcttgtagccagcggcagtgagccagcagtctcactgcctacccagtgatggttccttctgtggccagcacttctggaatgagtcatctttacatgtttgccaacccttgtcctctcctccccagccaggttcacccttgctgctgtcaaggagctttgagactttctgagatttttaaatggggaagtagatgttaaacctagtatgaggaagagagggaaagtttgctctggtttcaaacacacagtcatagaagatgctagtcttaatgctttccatagcaaaaaccctgaaggcttagagtgtacacattgtgaactgaacttttaacattattgtgtaactcatttgttaatgcctatttgtcattgactgtggggtccatgtgaaaaactcccacaaacactctaacaaaatggaagacagaaaagaaagcaagcatcatttgtgtacaatagccaaagaacaatagccaaataaatttgatggtctcaaaagttaagcatyttttgaagagaaaatttgattttagggccaggtggggtagctcatgcctgtaatcgcagcactttgggaggcagaggcgggtggatcacctgaggtcaggagttcgagaccagcctggccaacacggcaaaaccccgtctctactaaaaatacaaaaattagctgggtacggtggcgcatgcctgtgatcccagctacttaagaggctgagacaggagaattgcttcaactcgggaggcggaggttgcagtgagccaagatcatgccgctgtactccagcctgggtgaaggagccagactctgtctccaaaaacaaaaacaaacagaaaaaagaattgattttgattttttcagatacagtgcatgaactttttatcataaaatattaaagctggggaaaatatcttagaattcacctcatgttcatgctttaccctgtgaagaaacagaggcacagagagaaataacttgaggataatggaaacaagcacacatctgtaagtgtgtgtgtgtgtgtgtgtgtgtgtgtgtgtgtcagagagagagagagagatgttcccttgtaagtaaacactcttggaaatagccgcattttattataacacaaaaagtaatgctaaagctgatatagttctggttgctaagcttcacacacaaaaggtctttaggtagctgcttcctaatttttatttctgtggcccaaaagtctccttgtaaaccttcgtgtcatgtcatactaaacctttgacatcaataccctttaaaatgtacaggtccttaaaaaaaaaaaaaaggcaaagggcaaatactaatgtgggaaatttgaattttaattaactgtttgtttcaatgttaggataaattaatgttagataaattctttggtaatttttccccctaaaattggatttttcaagaaacatcactggttcagtatattgttatttggggtagcataattttaggcgataacttaatatttgcatatatttgtcactactttgagttggtttttgtcccctgacccccagccaggatgttagatcacacagatttttttttctttgagcccttagggagagtccaaaacagtcacttcatgtactaggaaagtttacccagtcagcacacacagatatgttgttgcctacatttatatttgtgagagtgactgttaagaaactagcaggtttatraaatccgtgtgagaatttctctcaaataactgttaatggacaatccagcaatcctcccatctcaggctcccaagtagctgagactacaggcaggtggcaccatactcggctaattttttgtgttttttgtagagatgcggtttcaccatgtcacccaggctggtctcaaactcctgggctcaagtggtgctcccgccttggcctcccagagtgctgggattacaggtgtgagccactgcacccagcctgtacattttccttgaaatcgtttttggatgtttagtcttatttccttattcagagttcacctgtttattttttttttcatttccccaatttagcctgcgtttcacccagccctagcaatataggtttgggtcagagaaattcaagcggccaggggatgctgaagatggcccattatggccgggcgcggtggcwcacatctgtaatcccagcactttgggaggccgagkcaggcagatcacaaggtcaggagatcgagaccatcctggctaacacagtgaaaccccgtctctactaaaaatacaaaaaaattagctggctgtggtggtgggcgcctgtagtccaagctactcaggagactgaggcaggagaatggtgtgaacccgggaggcagagcttgcagtgagcagagatcgtgccactgcactccagcctgggcgacagtgagactccgtctcaaaaaaaaaaaaaaagatggcccattgtggtaagccttgacttgaattagtcaccaagctagtcttatctcttttctaggctaattcttgttttttgtttggctcaaaacaaattgtttgtcttcagaacacaataaaatccagggagagtgtcctgttcttcctacagacgtcactgggacatcttattctttaattaattcagtcaactaaaattggtcaaatacctgctctctgtgccagagttataaactttgtatttgtataattgctagtagctctcttacatttcttactttatctatctggcatttgatctacctaataccttccaatatcacctcatgtccctttaccagcttggtggtttttctatagttcaggaaatcaaacaaaatggtgtgtgacctggaggtactagaaaaacaatagcaaaccaactccaaagccagcagaagaaaasaaataaccaaaatcagagctgaaaaaaattaaaacgtgaaaatccatacaaaagatcaatgaaaccaaaagtttgtgattcaaaaaaaaaacaaggttgatagatcactaactagattaataaagaaaacaagagagaagatcgatccaaataagcacaatcagaaatgacaaaaatgacactacaactgatgcctcagaaatataaaaaatcctcagagactgttataaatacccctatgcacacaaactagaaaacgtagaagaaatggatagattcctggaaacacacaagccccctaaaattgaagcaggaagaaattgaaatcttgaacagaccaatartgagttctgaaattgaatcagtaatacaaaacccaccccaaaaagcccttaatcagatggattcacagccaaattataccagatatacaaagaagagctagtaccaatcctactgaaattatttcaaaaattcaaggaggaaggactcctctctaactcattctgcaaagccagcatcattctgataccaaaacctgggagagacacagcagaaaagaaaacttcaggccaatatccctgatgaacatcgacacaaaaatcctcaacaaaatactacaaaccaaatccagcagcacattgaaaagttaattcatcacaatcaagtaggctttattcctgggatgcgaggttggttcaccatacacaaatcaataaatgagactcatcacatagacagaattaaaaacaaaaaccacaggataatctcaatagacacagaaaaggcttttaacaaaattcaacatcccttcatgttaaaaaccctcaacaaattaggcattgaaagaacatacctcaaaataataagagccatctattattcaactatccacagccaacatcatactgagtgggcaaaagctggaagcgttcctcttgagaactggaacaaaacaaggatgcctactctcaccacttatatcaacatggtactggaagtgctagccagagaaatcaggcaagaaaaagaaataaaagacatcccaacaggaagagaggaagtcaaactagctctgtcacagtgcaggcaatataattctgtacccagaaaacactgcagaccctgctaaaaggctcctagaactgataaacaacttcagtaaagtttcaggatacaaaatcaatgtacaaaagtcaataacatttccacacaccaataatgtctaagttgagggccaaatcaagaatgcaattccatttattttatccttttgaataaaatacctaggaatacagctaatcaaggaggtgaaagatctctacaatgagaattatgaaacacactgaaagagatcagaggtgatacaaacaaatggacaaatattccatgctcgtggataggaagaatcaatattattaaaacagccatagtgcccaaagagatttttagattcactgctattcctatcttaattagcaacatcattttttcacagaattwaaaaaaaaaaacctattccaaaattcatgtggaaccaaaaaacctgaatagccaaagcaatcttaagcaaaaagaacaaagccggtggcatcacactgtgtgacttcatactacactacaaggctacagtgaccaatacagcacagtccaggtacaaaaacagacacgtagaccaatagaacaagataaagaaccagaaataaagctgcacgcctacagccatctgatctttgacgaagttgacaataacaagccatgaggaaaggtctccctattcaataaatggtgctggagcaactggctagtcatatacagaatattgaaattggacccctccytttaatcatatacaaacattaactcaagatggattaaggacttaaatgtaagacctaagattacaaaaaccctagagaaaaaaactgggaaatactattctggccattggccttggtaaagaatttatgaataagtccccaaaagcaatggtaacaaaaacaaaaattgacaagtgggacttaattaaactaaagagcttctgcacagcagaagaaactatcaacagagtaaactgataaccaactgaataggagaaaatatttgcaaaccgtaaatctgaagaatgtctgatatccagaatctataaggaacttagataattcaacatgcaaaaaacaaccccatttaaaaatgggcaaaggacatgaacagatacttctcaaaagaagacatacatgtggccaaaaaatatatgaaaaaatgcttaacatcactaatcattagataaatacaaatcaaaaccacagtgtgataccaactcacaacagtcagaatgcctgttattgaaaagtcataaaatagactgggcatgtggcttatgcttgtaatcccagcattttgggaggctgaggcaggaggattatttgaagccaggaggttgagaccagcctgtgcaatgtagcaagactgtgtctctacaaaacatcaaaataaatggaaaaaaaaaaagaaaaagaaaaagaaaattaactgggtatggtggcgtgtacctatactctcacctactgggaggctgaggtgggaagattgcttgagcctaggaattcaaggctgcagtgagctataatcacaccactgcactccatcctgggtagcagaacgagaccctgtctcaagaaaaaaaaaaaggcaaaaattaacatgttggaaattagttcagtcactatggaatgcagtgtgaagatttctgaaagaacttaaaacagaactaccattcaacycagcaatcccactactgggtctatacccaaaggaaaataaattgttctacaaaaacgacacatgcactcgtatgttcctcacagcacaattcacaatagcaaagacatggaatcaacctagatgcccatygacagtggactagataaagaaaatttggtacatatacaccatgaaataccacacagccataacaaagaacaaaatcatggggktttttttgcagcaacatggatgcagctggaggccattatcctaaacgaattaacacaggaacagaaaaccaaataccacatgttcttatttataagcaggagctaaacatcgggtaaacatgggcataaagataacacggtagacaccagggattactagagaagggaggatggaagcaggtgtgggttgaaaaactgcctattgagtaccatggtcactatgtgggtgacgtcagtatcatgcatayatcaaacctaagtgacatgcaatttacccatgtaatgaatttgcacatgtatcccttgaacctaaaataaaagttggaaaaaaataaaagataagatatcccgtatcctcaataaaaataaaaatggcgtgtttgtgcacttgactttgtaacatgttttccaaagatgtctttgagtcataaaaatgggaaatacacatgttggtttctctagtcatcacttgacaacttacatgttttacctttcttatgatggtctgtctcatttcttcagtgacagggctagacattctgttttaaactcttcccacagctgtatattattcaacacaactttaacagagttcatagagtggagattgaggatgtttgcaaagttaaatcatttatttttattttttcttaaccatgtcccgcctgctttattcattattaagaacattgatgtgaagattaaatggttttctctatttttatcttcaaacgatctctatttgtggcttctgcacattgctagatttattccagccacttacactagggtcatagtttagcttcagctcggagccaaatgccccacagctgaaatgaccgcacctctgaagtggcattttcccaggccatgcctccctttaataatgagccagccagggggtaaatttgtatctcattacaacagagccttgtattaggcctggagtataattaaatgtgaggaattataattggttccctctttgaaagctctctcagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacgcttccgaaacagacgtttgagtcggaaaccttggagtgcagtgaacccgctgctcaggtatttmctgtcaacaaacatggttaccaggttactgggctcttctgcccagggcatgctgtcarttttacaaactagaataaacgrtagacgcatagaaagtttgagtaggaggaactttaccatctgagtcagtgattttttttttcaaacttatttgtagctgtagaaattggtgttcaaatgaaaacccagaaacccaatgattaaaatagaaaaaagtggaaaagctctaactgcgggacagagacaycttgggcccatccctacgacagttcctgcagagactcttggtgcccctaaggcaaactacagagtaatgaaaagctctatgctgaggccagaatacctgcattctcctagtgattctaccatgtactaactctctaacttcaagcaggataattaaacttattgggcttcagtttcctcccctgggaaacaaggatggtaatactaactcatgaggttatttgagtattaaatgagttaatatccataaagaattagaataatgccaagtacacttagtgcctagtcaatgctggtcactgttattgttattgtcattattctttttcttttttttttttgttgagacagagtctcgctctgtcgcccaggctggagtgcagtggcacgatcttggctcactgcaagctccgcctcccgggttcacgccattctgctgcctcagcctcccargtagctgggactacaggckcccrccaccacgcccagctaatttctttttgtatttttagtagagacggggtttcaccgtgttagtcaggatggtcctgatctcctgaccttgtgatccgccygcctcggcctcccaaagtgctgggattacaggcrtgagccaccacgcctggccagttgtcattattcttataaagtaattacagtttaaaattcaagttaaagtgtacatcttgtgaaatgaacttttaacactattctgtaactaattttttaaatgcctggggtcatttgaagaactccagcaaacactctaacaaatagaagacagaaagaaagcaagccttcatttgcataaaacggccaaagaacaatagccaaataaattccatgtttccaaaagttaagctctatacacctatgctcacagcagcattattcacagcagccaaaaagtagaagcagcccaagtatccatccataatgaatggataaacaaaatgtggtcgccaggggctgggggagggaggagtaggaagttattgtttaatgggtagagtttcggcatcccaagatgaacagcattatggagatggatgctggtgatggttatactgcagtgtgaatgtgtttaacactactgagctgtccaacctgcccattttatagatgagaaaaataaaattgagaagaaaaaatttgttcaagtttgcacagaacttcttgtaaactaatatagttttcagcttccatgtgtcttcataatacaggaatctcaccatgctggaaatgattcgaggtttttaaataatactaatttttcagacaaggtggtccccctaaagcaaagcccactacttacttggarcttcacagtagaatcagccatcatttccagcgctaaatatgacaggcttactgagggatagaatacctggatgctctgctctatgggagatttaaggaatttttcatcagtaattttgactgaattccattttcaccctacatgctgaccaattaaattgttcctcttaatgttagtcagatagaagccacggtaggtatttcagcagaagaaatttaacacagggaattgattaaaccggttttggaggtctgagagaaccaaaagggaaaaatggaggctatcctaaaatcgtcattatgggaaacagcacaccagcctggggctggggtatacggcagtggttctccacttcagcttcatcagaatctcccagagggtttgttcaaatataggttgctgggccctgtctgctggaatttctgattcagtaggtctggagggtgaacctcatactttttaattagcatttcctaagtgatgctgatgctgctggtcccaggaccacaatttgaggactgcaggtctaggggaagatcttggagttgtcagaacgtagaagctcagaagaggagcctgagagcaaggactgaaatccctgagaaggtactgcccagctggtggtgttgtctcaagatctcagagggaaaaacctcatgaagcctggactcacgcctcacaggaggagaaattgcccggctggtgctggtaccttcaaggaggtaagataagggtgattctggaagtaccaaaagaacctgaaggctagaaccagctgtcactacgaaggtgagaggaatagcaagaggaaggagccaggccctttgacctccttgaaccatccggtaaccctgtagtgctccctattgacagaacctaaagggagcagcagacacagcggaaatatgatttgctgacctagcatcaaagaacaaggcataaaagggtgaatttggagcccagaaacaataggtgaagaccagcgtacgcacaaagcacacgctttcctgcagcatactagcagagaactcaagtcactgtgttgtgtgtggttttttttgtttttttttttttttktttttttttttttgagatggagttttgctcttattgccaggctggagtgcaatggcatgatctcggctcactacaacctccgcctcccaagttcaagcgattcttctgcctcagcctcccgagtagctgggattacagacatgcgccaccacgcctggccaattgtgtatttttagtagagacagggtttctccatgttggtcaggctgatctcgaactcctgacctcaggtgatccacccaccttggcctcccaaagtgctgggattacaggtgtgagccaccgcacccggcccactgtctgtgtttaagagccaacttgatcatatgatccagcagtctcactactagatatatgtccagaggaaaggatatcagtatatcaaagagacatctgcactcccatgtttattgcagcactattcacagtaaccaagacgtggactcaacctaagtatccatcagcagaagaatggataaagaaaatgtggtatgtatacacgatagaatactattcagccataaaaaaatgaagtcctgtcatttgcatcaacatggatgagtctagaggataagtgaaataagccaagcacagtaagactaatactgcatgatctcacttatatgtggaagataaataagttgatctcatagaagtagagggtagaagtggtaactagatgctgggaaggatggatggagaagggaatagagaggttggttaacggttacaaaattatagctagataggaggaataagttctagtatttgatagtactgtaaggtgactagaattaataataatttattctgtgtttccaaatagctagaagaaaggattttgaatgttcccaacacaaagaaatgataattgaggcaatgggtacactaattaccctgatttgatcattacacattgtacacaggtattgagatattacactgtattccataaataggtacaactattatgtgtctattaaatttttttaaagagccaaattgtacaaaagttgyttgttttgaaatattggaataatactcatcatggagagaatctcagactgcgagatgacagcaatgttttcaattccactctcattcttgtgcaccttcttattgagtagaatggtgaggccacatagctagatttataaaatttaaacaagtatatgataagattccttggtacacgtagattttataaaaattagattatattatgcataatattgcaaaacttcctttttcatattagcaatatactgtgattatctttctcttccaattaatacgtgttctttcttttttagagacagagtcttgctctgtcgcctaggctggagtgcagtggcacgatcttggctcactgcaacccctgcctcccaggttcaagtgattctcctcccttagcctcccgagtagctgggactacaggcatgtgccacgacacccggctaattttttgtatttttagtagagacggggtttcaccatgtkagccaggatggtcttgatctcctgacctcatgatcccccggccttggcctcccaaagtgctgagattacaggcatgagccaccgcacctggccaggttctttcttttaatggctacataacattctattttatgaaagttccaaaatctcttaacacttcctttttgggggcatttagtttacttctattgttttgctatcacgaacagtgtttcagagatgcccttgccctcacattcttgcacacttgccagttataccctacggataaattcttagaagtgaaatttctagattaagggatgagtaatgttagatttttttacttatatgtatcttgatatccttttaaataaatttgggaaattaaagtcattttccttaaactcttataaattttaagaaaaacaaaagtattaataatcgaagtgttaatattgattatttctagcacattcagtttggggaaaatttatgatctagtagagtagtacttttgtgaggtagatgtcacaaaaaatgtgtagtatggagaaattgtccagtagtatgtccatttagtagaattttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaagcacaccgcagccaaaagtggacacagcttgaatagcaaattttttcctttttgttgttgttgcttcatccaataactgttaccaaattcccgtagaaaagtgttgcccactcccacatcgacctttggaagcataacattcagctttggtgtctatacacaatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagaatcacttgaacctgggaggcagaggcagcagtgagctgagattgcgccattgcactccagcctggccaaaaaatgtgaaactccgtctaaaaaaaaaaaaaaatccaatctttcctattggctttattaaatacactttaactttagaagcttagaagcacaataattagaactggcctaactttaaaaaaaattttcacaaagaaattagtaacttgtagggtcatttgtaatctttttctctgttgatttttacagttttaaaaagttaatacaataatttatttacttattttttgagacggagtctcgctcttgttgcccaggctggagtacagtggcaccatctcgggtcattacaacctccgcctcccgggttcaagcgattctcctgcctcagcctcccaagtagctgagattataggcactggccaccatgcccagctaattgttttgtatttttagtagcgatggggtttcaccatattggccaggctgatcttgaactcctgacctcaggtgatccgcccacctcggcctcccaaagtgctgggattacaggcatgagcccaatattttaaaaatagtacattattacagaagctagatgtgcactttaaattattatcagaaaattagtatgacagacaaattctatggttgtcccatcatctgggcctgtgacattcacacctttgtgatgttcatccccgactgtgggtgggacctgggacttgcttctgtcaaaacaatatggcaaagcatgagaggatgtcacttgtgatcatattagatagcagccaaaatggattaaagacttaaatggggccgggcgcagtggctcacccctgtaatcctagcactttgggaggttgatggcggcggatcacctaaggtcaggagtttcagaccagcctggacaatatggtgaaaccctatctctactaaaaatacaaaaataaccagatgtagtggcggacgcctgtagtcccatctgctagggaggcygacgcaggagaattgcttgaacctgggaggcggaggttgcagtgagctgagatggcgccattgcactcaagcctaggtgtcgcagcaagactcggtctttaaaaaaaaaaaaaaggtaatcatacctcactgcagccttgaactcctgggcggggttcaagcagtcttcctacctaaacctcccaagtagctaagactgyaggtgcacgccaccatgcctggctaagttttgcttttttttttttttttaagagactgagtctcattgtgttgcccaggctagtcttgaactcccggcctcaagcagtcctcccaccttgtctacccaaggactgggattaaaggcataaaccactgcacctggcccagtctcctttttgttacaacttcctccagctctgttttgctctggtgtgagacatgagcatggttcattaagaggcttggcccccccagccccaggaaagaacaagccaacaaccgataggaatgtagtactgtttttagtcctttcctcaggactggtttgtctgcataagatgagtaactacctgcttccaggtgagaagaagacatttaattttagagtagtccagccaggaagctgagatgtcattcttatcaaatccgcagtttcttcagaagacttgaggcctggctgagattctgtagtcccaaattggagcagtcttgagacatccargattcttcggttctcattttagacttgccgtctctctcacaaagacccactgttttctctcacaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaayaggcaggccragctctttgccctttacccatcagtggacgaggtgggtgccactgtttccatactggagwatctcagtgaagactctgagagtcatgtggacaattrtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaagaaacaggatttgaggaaactgcataaaagatattctatccatccatgcctctaaatatttgaaattcgatccttggattaagtgagacaatcagagagcctgatacccccacccttctggattgtgtttgctaacctgcccttcagtgagctcacgactggtcagcaaggaggacaataaaggaaacagcagtcatgagataggatatcacgtccacatggaaatactattgttgacattgacctactcaccatctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaagrccacaaagtctcaggcgggaggaatacgytttagtgacctatcgcactgcacagtgaccagagttaataataatgtgttacatatttcaaaactgctttaaaaaaggatttttaatgttctcatcacacrcacacaaaaggtaagttggtgaggtgatagatatgttaattagcttgatttaatctttctacaatgtatgcatagatcaaaacattacttgatttaatctttatacgatgtatacatagatcaaaacatgacactgtaccccatagatgttcacaattactacttgtcaattaaaaaataaattaataaagtatgaataatgtgagcaatatcatcatctcctttcctcagattaaaaagcaacaattaggctaaagagctttttcaagattcaacagataaattaaattacaaaatggggccctaacccgctaactacaaagttcgtgttcccttgtttatgtatctacatacatatgactacctggtatgttgggacacataactgaaatccaaatatgatatttttaaatatcatgtaactttttagtttccatccacgacattaagactttttaccagatttgtcaaaacatattaaatcagactgatttggcctttactttccttcctcttcctctcagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacrtagcctggttttagaggaactttgttttatgatctttgaaacaatgcagacactccattgggactgaatgttataatctgggagcaggcctaatggggcctgcttttattgagtagagagaagtgcttcgtaattagtgttgcagttatttgtaaactggcgtgtctaaaatgcttgagggcctctataccagccctttaatattttgaagctgttgtcacagaaattgcatttgtatttataatttgtgctttctccaaagaaagttctatggaagaaaggtaaatttctgcctactctgacatgattacaaatgctggttttttcgatgacacaatcagatttttaaatattatcattacttgatttccctgtaaggaaagttagaagagaggtaaactagtatatccaagttatggctgagtctacaggagaagcaaaagttggacttaaccaccaagcttctataaggcaagttctttccctaattcattctgagtctacaaaaggcggttattctacaaaaggcattctatgtcaatccctaagaaagattccactgatactccaaattatagaaaagtttgctgaggctgttggttacaagtgacagaacccaactaaaaccaattcagaaaaaaaggctaggggagtacttcttggctcacctaagaaaatcacaggtaggcaaatgtggagttgacctctggatccattgggasagtaaatgaaagaatatcatctctctcatactgtctctttctctctcattatctctttcattccgttcatttatatatatttttaggatgatgaaaacaagaggtatcyattaatgtttcacatttccactttctgtttgcttgggaattagttgccatttcagttagctataaagcctgaggaaattcatatagcttagaagagactkaggaaatatatcacccaaatgtcatatgtggaccttgtttggatcttgatttaacaaaataacagtaaaaacaaattgagacagtcagggaaatttgaaactgacaaaaattatttagtggcaataagaaattattaatttttaggcataatggtattgctgtatgtttttaaaagtctttatcttttaaagatatgtactgaaatatttatatatgtatatggtctctgggaagttgcttctatgtaatccagtattgagcgagaaaggtggtaagtgggtaaatagatgaaaccagaatgcccctgaattgaacttgttgaagctagatgatgggtgaatggttcttcattgcattgctctctcaacttttgtgtatgtttaaaattttcccaatgaaaatcttttttaaaaggatttcaaaaattagaatctagaccaaaggcagtcccagaaatccatgagtgtctctaccttcaggttgttttccagttagggagatcttccctttagatatgtctgttccaatgatcctaaaaggtccagattgccctgagcgagtaggcatcaaaacaatgtctcctctgaaataaactcagccattccacccagcaacatggccaaccgccgtaaccacaaggaatggggaccacagggagaggttggagtaatgatgagcttaccacattgatcattccatcaaagtgggtacatatttaccargaaggtgactttactgctatttgcaagaatgttaagcttgctgtggggtattcactggaaagctcccaggaaaagacagtgagatgtgaccctgttcttyggacccttgcgatsggcagagcactcaccrgtgtttggaaagcatactgcaagagtgggaattactgttttcaaggatttgcactacttatttttgcatacatgaatrtaattaacatagaatgatagttcagatacagatgttaaggttacaataggggcttgatatttctctttaagtgtttagtttctgtgcggtaaaataaacaggtagagctcttaatttgtcattactaaatttcatatacctagcactttaggaagctctaactgcataagcctgtctagaacttgtcaattcaaccccaagtctctatcatctgtttaagaaaacagtgaactgagaaagtgactctgtattataggatcaatggtttacagccttaagtgaaccattctgactcagatttcaaatctgaaactcacatacttactagtaaagcccttgacaggagaaatattgcaaatgtgtaattagagtgggcaaaaaacacacaaaaacatcaacaataggtataagattttgcaatgccatctggtggatgttactaagccatatccatgttcacatttccttccttcctgcytcagtctctttgtcttgaatgcttgggtttctaaaaggagaaactgttttgctgcaaatgctggctttgaggttgggggttggaagagaaactttcttataaaaggcagagtgttagaaaaaaagcaaatctaagttaacttgagccgtggagggtagccttcccttccctgggttaactctaattggagctccycacagaattcastaatgatttccttacgatgtgattaaaaataggaggatgctgtggaaatacgtccagtaccagaatgtcccaaggaacacctgggcaacagaatattggtcaagttgctgaccttgaagtaagtatcaacaaacacactgccacygctttgagatttatcttgccttttacatacaaatgttgtrtttattatcagagcttgaatcaaagcggagctcccaaaatacgtytaacagtgggcagctgtggagtagtagaaagggcacgtttgagtccattcctggattttttttctaccaacttcttgatggtcattcttctacaatagagaaggcaaacacacgtgtctactaaagttasgcaggtaaggtcattgagtgaaatgacctacattaagaaaaatagcrcttaagtcagtggtgtgctggagtcgactgtactaactcgtgagatctgacagtgcatatctcttcctgggttcggtgaagtcacattggtaactttaaattggccatggcgaaagtatttacaatgtagaaatcagccaatgctacacgtttgcaccaccctcagcacccggagattatttgtaaaacatttaccagtatgccactgttgaaacacaatgataaatgcaactgaaactcagtgccaggggacaatagggagtggtgaggactgtagtaaactatgttaagggggcactcactgctagcaacagactcttgccatccaaataaacaggcccatttttgtcaactgtcttttctattttttcaagagaagctgaaaacccagatttttctgcataatataccgactccctaaatatgttctcattccctttataaacaccatataattaaaacacgactacagtctggtttcatcttgtgggccaattatttgccacatctacttcaaagtagttgcatccaaacgtttcaattgtatactatgatagcaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatrcctctcttcgtctctgcagactgctattttcaagaattagttctccttcaaatycacagatgaaaactttaaagttgtacatattttacctaagcaaaactacagaagcgtaacatttatttatatactattagatgggtcatccatctctcaaagtcacttcataggtcccttcagcggcccctggtttgcagtgagaaggcatctggattctggatgtaaggctgggtttcaacccctgggaacttccctgggattttgagttcttccctataaatgaagttgatagaccttatggtctcaaaattcctacctaccacaaacttctatgattctaacgcatagcctctgccaacttcttctgcctcagaaaacaagccagcaagtctgctcacacagctatgggtggtctcttgatattatagtctcctcccgctggccagttctaccagagggtcttcagggccttttgtacggagaaatgagcagcccataaaccagctgagtgtcaagtaatgggcacagaaaagcaagctcttgcccttgcaaaccaacctggcagtgggagcttcctcatctgtctggttggcgggaggactgagtggaagtggctcttcccctctgcattgtttaggaagccytcgctattgtctgagggacacacctgccccgacaggatgcatcatcaggctacttttagatgcagcgactatgtcatttgagatggcagaaattctcctctatggtgctcatagccaagctttctagacctctccagtgaatgagaggcagctgttctcacaggtgggaaaacatggtcactaagagagatatgtgttattttaaaaaaatgttaatggaggccaagtgtggtgactcacacctgtaatcccaacactttgggaggccaaagtgggaggatcgcttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacagccctccgagtaactacttagagtaaactagaygaaagaaagaaacaaattcttataggtaagcctagaatgtgacagtatgaatagtaaaaatataagggtaatattaatggcaaatgttttcccatttacattgatatgtaggattctattcataatactacatgttttagcccctgaggaatttgtttaaagttgtagacatctgtaactgtctctgtattgcttttcagaaatatagaaaccctcaaagatacagagagaattagggtcctgccaattctgcaaatgtttgtaacagaaaaaaaaaaaaagaatgacaacaaagtatttttctgttttgtgttttaaatggagaaatattttaagatttaataccatcttatgaaaagtaatctcagctcttaggagtcttcttgatggtgaaactttaatgtgcagaaaatttgcccaggcagtttcttttaaatgcagattttggaggaccttccataacaatctccctcaagagattctggttgagtaggtctcaggtgggatcaagaaacctgcatgctggctaacttcttttgcttcaaaatgctagattctggggactacacttaaagaacaaacactcacggaaaaagcccaggttctgtgatcagagatggctgggctcaaaacctgaccgaacactcacggaaaaagcccaggttctgtgatcagagatggctgggctcaaaacckgaccgaacactcacggaaaaagcccaggttctgtgatcagagatggctgggctcaaaaccggaccgaacactcacggaaaaagcccaggttctgtgatcagagatggctgggctcaaaacckgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcccaggttctgtgatcagagatggctgggctcaaaacctgaccgaacactcacggaaaaagcccaggttctgtgatcagagatggctgggctcaaaacctgaccgtgccagtccctaactgtgtagactttggcaagttccttattccctgggaaccttgctttcctggtgtgttaaatgcagataatatctgcattacgctgtagttgtgdaaagagactgatgtgtggaaagcacttattataacacaattttaagtctttaataaatgtcaattctctttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaaaaaaaaaaaaaagaaagcccccaattaatgtgcaattacctaataatagaaagaataatcatagaaatcctcaacactgggcttttcggtggtaaaatgtatgtaacataaaatctaccatctttttttttttttttttttttttgagacagagtctcactctattgtccaggctggagtgcagtggcatgatctcggctcactgcaacttctgcctcccaggttcaagtgattctcctgcctcagcctcccgagtagctgggattacaggcacttgccaccacgctcggccagtttttgtggtttagtagagacagggtttcaccgtgttggccaggctggtcttgaactcctgacctcatgatccgcttgcctcggcctcccaaagtgctgggattacaggcatgagccactgcgcctggccaaaatctaccatcttaaccatttttaaggtacagttcagtggtgagtacattcacattgttctgcaaccatcaccaccatccatctccaggaatttttctcttcccaaactgaaactctgtacccgttaaacaataactccttattctccctactccccagcccctggcaactcccattctactttctgcctctatgaattttactactctaggtgcctcatgtaaggggaatcatgaagtaactgtctttttgtgactggcttcttttactcataatgtcctcaggttcatctatattgtagtatgtatcagaatctccytccttttatggctaaataatattccattgtatatatgtagcatattttgttatggcctcatatatgtatctgttcatggacaagtgggttacttccaccttttggctattgtgaatagtgctgctacttggcattgtttttaagatacattcacacacatcattatacgtgatcctcacaacaaccaggaaaatggaaaggcaagcatccttaccttattttgcagataaataaatggaattcagaaaggcgagtaacctgattagggtcgcagaattagcagatggtggaggaggaacagagtccaggtctctgcctgggtgccctgggagtctgccatgattccaaattgcctcatttccaaaggcgccatttgagcaaataaccctttttgtctgtgctcatattctgtccaaatattcttctaaaaagtcctcttttgagacaaagctatccattgatgaggacatcctctcacacatacctggagacaaaacatgactttattgacatgatgtctgaggtaatggtggactggggcccttttcctggtgctctctgcaggtaacatccaaagccatgggacatcaagctgagaaacttggaagaccttcaccagtgttccatgtgcacctgtaatgtccaccaagatactaaaggcaaataatgcaccaggattatgctttgggattcaccgtttcgaggggaattggcaattagggccaatatgagggctcatctttctagctctcatggggcccaggcacctcagtgtttatctgctgtgctcaagcccctccctgacctcaactcagcaactccccagtaatggagttaggaagggccagacattcatccccatcaaaacccagccttcttctgactgtcccactacaaatctaaggaaaagyaattgaacttttcttttgttgccatctgaaaagccccattccttagaattgaataatacagattctatcctttaaatttttttatttcaatggctttagggtaagtggtttttggttacatggaggaattgtatagtagtaaagtttgagattttagtgcacccgtcacccaagtagtgtacattgtacccagtatgtagtttttttatccctcatccccctctactctcctgcttctgagtctccaaggtccattataccactctctttgcctttgtgtactcatagcttagctcccactaacatacagcatttggtttccattcctgagttacttcactcagaataacaacccccggctccatccaagttcctgcaaaagacattatttccttctattttatggataagcagtattccatagtgtatagataccacattttctttatctactcattggttggtgggcaattaggttggttgttggttccatatctttgcagttgtgaaacagatactatctagcaataaaatgtgaaatgcgaacaagtccattacctcagacagaaagtctaccctctgaaaacacagtagttacaataagaaggtgaatcacactaaaggtccattcagcccactctctcttgcagtgagtgagtgaatgagtgagatattccaaaaatatccaccatgcttttgtaatgtccaccatgatctcaaatgattaggaatttttcacaaacctcctatatttctctattaatatcccagtgcgattctcatatacttggagttttccaaatatttcgggaaactgctcatatttttaaccagtttatctatctaggtgttttcagaaaattcaaaattatctaactcaaagccacatagattttcctctctttctatggtaggttcgagattgaaattgagcccctgtttgccagcattgccctctacgatgttaaagaaaggaaaaaggtaagaaagcaaagaaaaatccatccctaaggmacatatattgttcatgattctttgcatgtatgtttttaaatcttcttygcagcaagaacctatcagatttgaaagcaaatgatctttgatgagtccagttctgttgcctttgcaatttttcaagcagtggtctgagaatgtaatttatgatctttgaagaattttagagggagaggctactggaggtgctggcctggttggaatagagaaagaatgaaatagcrcatggggttatgtataaaacaaacccatttaaatacatttttaacaagcttggatgygcatgtaaagcttcctcagtttgagagttctttgcactgtgaaataggctcatgactgaagggcatcttacatggtagaggtctcaatttgtcacagagttcagaccttaccaactgtaatgtgcttttaatgwaaacagtgaccaagacctctcgtgtgtttttaatgtttagtcattttgtgactcctagaagaggacagcaatagcaaatccagagtaggatggacacttctgcccttctttacccataatcattctgtatttaaggaaacaagcatctcctgcataaatattaataatcactgagatttgtaggataggttaactgctaaaacaagcagaacccartctcagtggtttaaagcagtagttctcaaacttgagcatgcatcacartctcctggaggacttgttaaaacacagattgctggacctcacccacagagtttctgattcagcaagtccaggtggggcctgagaatttgcatttctaacagtcccctgctgatgctgaagctactggtcaggggaccacattttgaaaaccgctggcctataagcaagaagttgctgtctttgtttctttaaccatccagggtgggaggagggacccctctgttccacgcagccactcagaaatacaggctggcagtggctcctccatcttcagtatgttctctccccaaattactcttgtcactgccattgctgcccytgaagaagagaaaagaaggatggaggaggcctggaagtttgatacattgcttctgctaacaattcactggagagaattgagtcacatgatcacccctcattgcaaaggaggctggtaaatgtagtctctgcctgggcagccactcaccactaaaattctcttggtgatgaaggagagaacccaaccatacagtggctcttaagtaatacgacactaagagagccaggagcactgttcacatcatgctcttgctcagaatcttcactaagattcattccctacaaccaggctttcttcatgatggcattcctctaccttctttccatccatagtctatgcagagtcaagctagaccgctgactaagcttcccccagccgttcaagcctctgagatatttattcatactctaatctctccctggcacatcatcaccttccacccctgcctatcagaatcttctaaggcccatccatctccagtgctgcttccatgaaaagttgtccttgtcacccaactgcaaatggcctgtcactctggaacttccacagtgcttctttgtatgcatgtggtgacttgtattttgcttttactgtagtyagttacatgtttaccttttccctcacctttttttttttttttttttgagtcagggtctcactctgttgcccaggctggcatgcagtggggcgatcttggcttactgcaccctctgcctcccgggttcaagtgatccatcctcccacctcagcgtcccaagtcgctggaascacaggcacatgccaccatgctggctagtttttgtattttttgtagaggcagggtttcaccatgttgsccaggctggtttcaaactcgtgagctcaagcaatgtgcccgccttggcctcccaaagtgctgggattacgagtgtgaaccaccacacccagtccttccctcattcttgattgtgaattaattgagagcagaggtcctcctcttctgtagtgaagtaactgatactcaggaaataccggcgggttaataaacatttaaatgtttcaaggaacatctctcaaatggctccagaatacctagacattgtgacaaaacatttgtcagatttatccaggagccactttcctaaaccacatctgtgattattacacttactccttcagcaaaatttctctstggtgtttttactcctttktaacrtgtttaaaccatgaatgcaacaggtctaacttayatttcacttygctgctcatttacagatctcagaaaattttcactgtgacctgaactctgaccagttcaaaggatttctgcgarctcacacgccttcagtggccgcatcaagtcaggcgagatctgcagtcttctcagtcacctacccrtcctcagacatctacctggtagtcaaggtaattcagtacgatctgatttgcccaatctgatgttttcattgctgtgttgttcccagcacatgtttggggtgcacgcaatctcagaatgtgtccacatatcctctgagattcactttgtttccttctcagtttaccccttttccgttctaagtaaactgtttcagatactagaaagactaggttttggagacacacagacctaggtttgagtcctggctttacaacctagtaattaaatggcattggcagtttcctggtctttctgagactgagtttcctcatctgtgaagtggagataatcacactgacctcagtggatagtcatgactacagaataaagcttggcacatcttgggcacccttctcctaattaaggagagttccctcagtgacctggtgcaaagaagctgctgtggagaaaggaacaaaatctctgggctagagtttcctaaygatgttyatgttgctctagagatgcatagttacgtgttcccaagtccagcctcttacaagctgaagcgtgggctgtggttttcaagtttcatcctccttttttttttttcttcttaccatgtcacagactgtctctaatgagagttgaaatctatggggcaattgtaagtagaagagcctttcattctaggctatactctttgctgttgtaagaaaaccagatcctttctctgtacaccaaaatgactggttagaaattaacaaacatcaggtattttacctaccttaggccagataattggtcttattgattcttttttttttttttttttttttttttgagaggagttttgctcttgtcacccaggctggagtgcagtgtcaccatgtcggctcactgcaacctccacctcccgggttcaaacgattctcctgcctcagcctcccgagtagctgggattataggagcccaccaccccaaaccaggctaatttttgtatttttagtagggacaggatttcaccatgttggccaggctgatctcaaactcctgatctcaggtgattcacctgtatttggttcccaaagtgttgggattacaggcgtgagccactgtgcccggcygtaaaatcattgtaaaaacaaaacaacaaattcaggtgtctgatttcatgtgcccccagcctcttaggtttggaacattatctagttagtacagtgttttatgtctgtagtctcagtgatcgccccatgatctcatggattccaaataattcaggtagctttgaggtcacttaacagatggcaaatgtcttttcactctagcttctttaacaccatataacaaagattatgagaggttactgtagcttgaggggaacttatttaagcttatagaagtatagttaaaattatattgctgaaaagacacttctattgttgtcaaacttcaatgtgtctccttttcgttgcaatattacttagacatacaggaaaattaaagcccactatgatagccctgtaggtaagttcacaattctctgtcagcctaggaaactgaagaagccaacactagttctatagagccaaattttatctcaaactctacttcccagtggatgactttctcttgattaatccgtcatattctgccaagtaacagtggttacccattggttcctatcacttactaaatatgttccaaaattttcaaatgtataaatgtgttcatttggcataacaaacatactaaagtgtttggataggtttaagaaattgaaatctactcagcaagacagcccctggttggctttctgtttgcttttctttatcgtaatgccatcattgttgcttctttccctttaaatatatagtaaatggtgttaaactatttagcacatccaggcagacattatttggtaagaggggcttcwttcttttttgtttatattcccaggccgaacatcagggtctttactgtattttaggtagcatcatctagttcaggtgttgcatataatacggctttaagggattatttccgcttaaaagtttaattcaagattttgtgaaatttttttttaaaaagaatttgttttacaatcaaggaaagaagagtgaaaatgggattgaattggaaacttttcaaaaattgtttaaaaattggtatgccgtgcccaatttaaatatttcataagttgcgatgggcctatccttatgtargggccacatagtttgagaaaacacaaagcagagagcctagcactttagaagtcttgcagatgttaaatttcccatcttaaagagtttacaatccagttaaaraaacaacttggcattcaaagaaatgggttcaaattcctattttgctacatttgctgtgtatggtagcaagtttagtctgtcagtctaattggacaatgatccctgtgcctgagtggttttgaagaaaattgaaataatgtatgtaaaaacacctaccctgtacctgacataccataattaggtaaacaataaatggccatgaaatatgaaaaaaataggtatgccaagtgttaatcctaccccttctgaatagagcagaaagtagtctgttcccttaagaaaagttttaggttaatctgataggcttatttgccctactttccatggttatgaggagtcatgcatttcattacacacttttgcataaatcatgagggaacaaacaataggttctcatgtcggtctgcagctccttctcatgaagtacctggagttctccttgcccactgcagccagggcatagtatctgctggtctggtcaaatctgacttctcctgcttcctgtatgttccatgatacacactactagtgcatgaagccgtggcattccccttccttgcttcagggtcctaattaagaagttcttcatctctgttcagaatttattctaaagaccacatttttaatccattcacttcatggaaaaattagcttccttccaatttgttctacaagctcctgactatgagcttcaggagaatgggggcagtgtttatcgccaccttatctccyagctgctaccatatagaaggtactcaacaataagtaaacgattgctgattagcaggaatactggtcagtttctagctcaagtgttacgtgcttatgttttcagtgtggtgcatctctcagtgggattcgccttctcttcatgctgtggcaatggsagggggttttgaacttctttgatgagaagagagacttcctgcttggagtcstccctgaagcagatattcattgagtagcctcatgctgcttcctttgaaaccccataaatgcccctttatcatgggtattgttaaatactttgtgcctaacgcacagcacctattaagtatgtgtcccttttgtactgtgttgacccaaattctttcttcaaggatcatctcaactgatgggactaaatccactggttttactcttcaacatctaagttaaattttttttgagcagagagttaggaaatttcaaatttctccttgtctttcttttaaatatggtgcccaaatttatgacaactggccagccagtcactttacctgaagcaagacagaagacacttcattcattcttattaccagcattcattcctatcaacagccagttagcaaagcaagaagctgcacatcccaatgcttttgagtttctttccaagtctgttaaatccagagaattagccctrataggaattacaagggagacaattacagataatttattcggttcagtcattcattttgtggaaggttttagtccctaacccaactttcacagagaccatatctcttttttacattgtaagcaataataaagaaaatgagttttccacttcctacgtatgtctcctgggttttgttttataaaataacttttattgctgtttttattatatacataatacatgtttattgtttaaaatagaaaatacacataagcaatgggaagaaaataaaaatcacacataatcccaccatagaaagwtaactactattaacacttgctgcatttgctgagtatctactgtcacccttttaatatgcctttatgatttgttaaataaaattgtatgctattctttatataaattttttaataaaaaaatatgtatcacagatagcttcctatgtcatcaaatattgtcataaaatgtaattttgatggttgcatagattcctttttatggatgtaatttatgtgccttattttaatattctttttattggtagattgaaaaagtcctgcagcagggagagattggagactgtgcagagccctacacggttatcaaagaaagtgatggtggaaaggtatggtaatttgagtgttgttaaatggagacatcttagaagaagcaggtattttcagaagtgttacacaaatagttaatgggctttagtccctaatgtgtccctatataagacactactacattttaattaaataaaagaggaaaagaaaactggtcaccgatgatgacttttttttttttttttttttttttttgaggcagtgtcttactttatctcccaggctggagtgctggagtgcaatcayggccccctacaaccttgaactcctgggcttgaatgatcctcccccttcagcctcttgagcagctggtactacaggcacatgccaccatgcttggctagttttttatttttttttagagatggggtctcactgtgttgcccaggctgctctcataattctggcctcaagtgattctcctgcctcagcctcccaaagtgttgggattacaggcatgagtcaccatgcccagcctgatgatgattttttagagaaataaatccttgaattttctaatgttgacatacagcaaggtctgactgcataacttgattggggcaaggccaccccctgttgtcttcattctgaggctctgactcagctggttgggaggtccgtggagaccccaaaactaaacagtgccagagctctcctggccttcctcaacagcatgggccgctgccctttcaggtatgcaaataactgggaattggctgccactaccatgcattatatatattcattagcacagcataggtgttgagcctatgaaaaggatatcttttctcaacagcaatttgcaaagattcccagtgtgatttttaaaacatggccttggccgggcgyggtggctcacacctgtaatcccagcactttgggaggccaaggcgggcagatcatgaggtcagaagattgagaccatcctggcyaacacrgtgaaacccygtctctgctaaaaatacaaaaaattagccgggcatggtggcacgtgcctgtattcccagcttctcaggaggctgaggcaggagaatagcttgaacctgggaggcggaggttgcagtgagccgagatcgtgccactgcactccagcctgggtgacagagtgagactctgtctcaaaaaaaaaaaaaaatagcctttctggaataagacttaccttattagtattgtactctacagactcataaatgtcaagtaagatttattgaactcaaggcattttttttttwaaatctgtcttttattctgaactcagaaagaacaccttggaagtattgtaaacttcctaaggagttgttaggaagctttttagaattttttggagttttccaaggtgacttttggagaaacaggttcacttgggagcttggtagatgatatactaaacttgatttcaagattcttttatgcaaatccaagtcacatagctagccaccaaaagaattgataatctgatgtaatgagtctctttttgttttcgttagctaaaaatgtattttactaattaaatgtagcctttttgtaaactcctcgttttttaatctttatttccttatcagctagacccaagtgcatcatttttctgcctattcactgtttttattttttagtgggaagatatgtttttactctttttaatcagtagggtttggattttggagatggctgtcatattcaggtcagaggcagttgacttggtgctgatgcttgtttcagcttgtttctttccattttcctccagagtaaagaaaagattgaaaaactaaaactccaagctgaatccttctgccagcgtttggggaaataccggatgccctttgcctgggcacccataagcttatcaagcttcttcartgtctccacccttgagagggaggtaactgatgtggactctgtggttggtaagattttcacctgcagtgggaaagggagggctccccagtgtgcgctgcccaggtccacagcttactagcggggactgggggcacagtgaggtgtgggaagtggggaggcagaaggagataaatagaatgaaacactgttatgactggattacgtagatttggacggtgatctccaaaagaaattatcacgaacattggtgaagattaagtatactcttatagtaagattttctagatggtatgacactttaaaaagctgatttttgctagccacccgctctcaaaagtaaaactttaacaagaaaatgtagtaaccatctgtagtgtgttaagcagagacaccatggtcgactcctaaacctaaaaaaaaaagcctctgttacaaaggcttcaaaaagcaaaactcaacaggaacagggcgtggtggctcacgcttgtaatcccaccactttgggaggccgaggtaggcggatcgcttgaagccaggagttcgagaccagcctggccaacatggtaaaaccctgtctctactaaaaatacaaaaaatttgctgggtgtggtggtacacgtctgtaatctcagctactcgggaggcagaggcaggagaatcgcttgaaccagggaggcgaggttacagtgagccgagatcaggcctctgcactccagcctgggcaacagagcatgactttgtctcaaaaaaaaagaaaaaagagaaaaactcaagtttcccagcaaaatttccagttcgttaaagtttactttgccaagtgcaatgaaaaaatgggcatccaaagaatatttactgttttagtttatttagcatatttctttttcgtcatctcacccgtgatctgaatcattcattcctwcactgcttggtgtagaaattttcaaaagggttgcaaattttcaagtagacctgcccatatcacctgtggtggggtttctctttccctaaatgcttttgtatccaccaaatatagaagtccatgttcacatcttttcatgcattccttaagctaaggcttaagccacttctgaaatactaccttgagcagggaagtggaggaaaggacattttgtgattgctgctgctattttggagttactggtacataatcaccagtcagaactcctgggttatttctggttcgtcaataacaaacctcactttaccacatcctgatcttcctgccacagctttctttaatgccgtctatgtagacccaagtaacttattgataagagttatgtatagagcttagagggcacacaagctaggtaattcaggatagggcatgctgaggcctcaatcatctctaggtcaaggataacctgacaacagagactgattcttaaggagcaaccagaagatgcaaagatgtcatgtattatactgaggcagaatggcaagtttaggtgggtagaggtagcaagaaattctaattcaacatcatggtaagaattaaggataagaagatactcaaagacgggttggaactgctctagttctaagcaatttgattatttacaagagaacccatgagtttttgcaatataaaagcaacaagatctccacccaaatcccaaaaggggataagaaacaactgggcaaactatcagggtcccagcccaagtttgagtgtgatttggggttctaattcccattgggcagatcacccaaggcagaaactcagtcttgctgcctggtccacataatgagagcagaggaatgctgggattcagagtgtacacaggctgaccccagcatgtttgggtcacaatcacaaatgccttcaggggcatttgagtacatgcctctcccagtggaatgcaaatatagaaataaaagaaaagcaaacactgtgctgactaaataaagcttatcaggagaccctgttctggctatagctctggactcttgccgggtggcatttgggctaccctaatttccatgtgggaggggcccatggctgctcctggcctctctcctctggtcggaggaggattaaggacaccaacaggaggactaagaaaggtaggggccaatggaaggacattttcattcaaaacaaggatggccatattcagtgttcctgatcagtgactttaatcatacatattgtgaagttaataactgctgtgtgtttgaacagaaaggcatactttggagtgacaattgtttttcttaaagggagaagctcagtgggtgaacggaggacattggcccaatctagaaggctttctgaaagagccctctccttggaggaaaatggggttggatccaacttcaaaacctccactctgagcgttagcagctttttcaagcaggtatctcttcacattayagtgtgtctggatttttccccatactggcatgggcactggaacccacaggaggaggatacgtagtgattaagagagcaaattagttaagctcactctcttagttcattttctgctgcttataatagagtatctgaaactgggtaatttaaaaagaaaagggatttgtttctttcagttttgaaggctgaaaaatccaaagttgagggcccacccttggtgagggctttcttgctggcggggcctctctgtagagtcctgaggtggagcacggtgagcagctgagcatgctagctcaggtctctcttcctsttcttataaagccaccagttcccctcccatgatgcagattaatccattaatctgtgaatggattaatccagtcatgagggcagagtcctcatgattcaatcacgtcttaaaggctccacttcccaacactgccaccatggggaccaagcttcaccatgagttttgaaggggacattcaaaccacagcattcacaaagcctcaatttcattagccagaaaacgggaacaatagtacttaacttcatgtggctagcaggaaggtcaggtgacatgagacctgtcaagctcttcttagagtgcctggaatacagtaagtgctcaatgaatgttagctattttaactgagagaagggttaggttttgttccttgtgatacmaactatcctatttgaactatcttggccaatccattcattatgctatgacaacagtctggctgggccatctccttcccggtggatctcagggtttcttggcctggctattcatgtgcaagtttccactttcactactgcttgatgtgcaagtttccagggctccctgcttgctcagagagggtgwccattccagatggtactctttgttagctcagtaaacatcaagactatttaaaaaaataaaaaacttcctagacttgtcaacggtatagagacagaaagtagaatgacggttgccagggtctagggatagaggggtggggagtcactggttaaagggtacagagtttcagattttttttgcaagacaaaagcattctggaggttggttgcacaacaaagagaatgtgcttaacactactgaattgtgcacttagaaacaggtaagatgggccgggcgcagtggctcatgcctgtaatcccagcactgggaggccgaggcaggtggattatgtgaggtcaggagttcaagaccagcctggccaacatggtgaacccccgtctctactaaaaatacaaaagttagccgggtgtggtggtgcacacctgtaatcccagctacttgggaggctgaggctggagaattgtttgaacctgggaggtggaggttgcagtgagccgagattgccccactgcactccagcctgggtgacagagtgaggctccatctcagaaaagaaaaaaaaaaagaggtaatatggtaattttatgttagttatattttgccacacttaaaataaactcgcttggtctgactctgttttggaaagttttccatagctacgcagtcttcgtggagcatttaaaggggttacattaacaaactgaaatgcaaaagggatgctgagggcgcctgtgcaccgtgccacatcatagaaatagtaaaggtctgaaaaggtttctattcagcatacatgtacccttcccaatcttatgaccttggaggacaaggtacttaactaagtctggatggtctcactgggaataagacatatctacccacttaccttactgggttgttgtaaggattggagatcatgcatgtgtgctcctgacccatcttgggcatatgtgggggtggacagcatttatacttaaccttgttcgagacaaatgtgaagaaaatgagatggaaagatgctttctccaccttcgaacatttgaagaagaaagtaaacttattctgtattgttccggggggtaatactggcatcagagggtgagagttatcggggggaagcttttggcctggttttctaatggtcagacgggcttccttagaatgcagcagatgccccatccccagaaggactgataagaggccgaggcacagtgagtcacagtgattgagaaggatttaacaagaagtggagctcagtgatttcagagctgtctataatcctaatttctatgaaagacttgtgagaataaaacttaaaggtaaaaatcttcccagaaatcgtttgtccccaacccaagagtcaaaggtgcatctacattaactctgacttttctcttggcaggaaggagatcgccttagcgatgaagacttattcaagtttttagctgactacaaaagatcatcatccttacagagacgagtcaagtcaattccaggtgtgaatgacttatctttatcctctttagctgtgccaaaactgcttatcgttagacacagtctttgtctaatgccagaatttataaaatcatgtttgccaagtgaaatgtgagattttgtgttaggggttaagaatctgaattgttctatgtctttggcaaacctattaatgtttttttaattttcttaaaggattgatttagtaaacaaaccttgtgctttagatctggtttctcagataatgagataattgtttaaacagaggagcccctttaatcaaataaaatattatacttagtattaaaaaagtaaatgtgagatgctttggtagaaggcaaaggcatcttccttatcctcactcggcagccctggaggtacttctgtagcatcctcaggtccagggaagccagtttgtgtttgtttttgtttttttgagatggagtcttgctctgtcaccaggctggagtgcagtggcacaatctcagctcactgcaacctctgccttccaggttcaagtgattctcctgcctcaacctcccgagtagctgggactacaggtgcctgccaccacgcccagcttattttttgtatttttagtagagacagggtttcaccatgttggccaggattgtctcgatctcttgacctcgtgatccacctgcctcggcctcccagagtgctgagatgacaggcgtgagccaccacatccggctggaagccaattttaaaactcccaatttttactgctagcaatgcagggaagttacttaacaatgtaaaattatactgtggtaattcaggaaagaactttaaaaatcctctaatccattccttctcattttacaatttcttgctttatattttattttatagaggctaaatctcgaaagttatcatgacacacttttctcaagctgtaggaaattagctccaaaacttttttacagtactatagtttgttcttattttcatgaaaraaacacagtgcaacaatctttcttgattccctcataacatgacagtttctttactagaacattcctattttctctctttaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaaccgtaggtgattgccaaatctctttctaaacatagtttacctaattctctttaacaagaaagggttacttcagatgtaattgtagtttaggattatagtggacatatgttttccagagattaaaaaaaaaatctgctagccattacctttgttctcctctgtgcagagggacatattagaaaaagagcaatgtgaccaaaatgtgctagttgtcaaaaggacaggttttcagctaaagattagctctttccaacagaatttacagcaataacataataatagcacacattccaatagmatttacagcaataacagaaagttctgtatgtgtgccagcagtacaatagccactaatcacatgtagctgttcagcatttgaaatgtggccagtgcaatggaggaactgaaaaattgattttaattaattttaatttaaagtcaagtaactgtatgtgtctactatattggagagtatggagctagacactgaaggcctaacaggtkgggctgccttggtttctgaatcgcttatggtggcacctgacctattccatggggtctggaaggagtgcttgtcaacacatatctgccaaaggcattaatgctcatgcacttctttattttgagactatttcctttaatgcagaaaaggatgccttctataaaaatcatctcttccccaccatccagaaatgacattgttgttttctgtgtttttatataaaagaaatacagtggtactgattcagttgaagtcttcttttatccccagtctccagtcacagacttttacctcacctcctagacttttatcatcatgaaattatgtatttcctattttttctccttttacacacacttacacacacatctgtgaacgctcaatggcattatcttcatattcatttaaaatgtacgcaaatgacttcacactctaggtcaggggtccccaacccccgggccatagaccattactggtccttggcctgttaggaaccaggctgcatggcaggaggtgagcatcgggtgagtgaagcttcatttacagccactccccattgcttgcattaccacctgagctcctcctcctgtcagatcagcagtgacattagattctcatgggagcatgaatcctattgtgaactgcatatatgaggcatctaggttgtgcgctccttatgagaatctaatgcctgatattctgtcgctgtctgccatcactttcagatgggaccctctaattgcaggaaaacaagctcagggctcctactgattctatattattgtgagttatataattatttcattatatattgcaatgtaataataatagaaataaagtgcacgataaatggaatgtgcttgagtcatcccaaaaccatcccctgccccccgctgccaccccagtccatggaaaaattgtcttccatgaaaccagtccctggtgccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttggaaatatcartattgattcatgtaaaggtttgtgggtttttttggggtttttttygtttttttgttttttttgagatggagtctcrctctgtcacccaggctggagtgcagtgacatgatctcggttcactgcaacctccgcctcacaggttcaaacgattctcctgactcagctgcccgagtagctgggactacaggtgcctgccaccacacccagttaatttttgtatttttggtagagacagggtttcaccatcttggccaggctggtcttgaactcctgacctcgtgatccacctgcctcggcctcccaaagtgctgggattacaggtgtgagccaccatgcccatcctgttattccttttaactgctgtttagtattcctttgtgaagaggccatattttattcatttccttgttgatacgcatttaagtctttttcaagttttcagctcttacaaacactatgaagtaagattttttgtctttgcccctctgtacacgtttgtgaaagtttctttaatatatctaaaagtgaaattaccagatcacaagtaatacacatttcagtcttaagttttctaaaattttacatttgcagtcctaacagcagtgtgagagaattcccattttccagttcctcacccatactttccagtatgaygtatgtgggactaaaatgcaaagaacttcagagctcacctgatccaagcattcccacccccacatttccagatgcacaaaattaagacccggaaaggataagtgaatggttccttgaggtcaaaaattacagcgaggtggccagacacagtggctcacactgtaaccccgctgctttgggaggctggaggactgcttgagtctaggagtttaagatcagcccgggcaacatagtgagacccccatctctacaaaacattttaaaaattgcccaggtgtggtattgtgcatccctgtagttctagctacccagaaggctgaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttccccatttaatccttcctggagcagctcttcattttcaatcctcattccttacatctaaacttagtccccacgtctccctcctagaggagataagcattctcaggatgcagtagtttcgattctctattccttagaggaagatgaaggcatgaaaatgtttgcttatggatgctttgtatctttttagaaactttatcctataatcgggaaacaatgcttgtggcattggaagagacttgcatccaatgaattctgtagttaytsaacttcccctcagcatttaatcacccacaggtggcatttacaatgttctctactcgttcctgcaaacattatcccttaattacatcacagtgggacttagagtgcattagtgcactgaacgatccagaaatgtaggagggcaaaggaggacaagtctggacggattacaatggacccaacttgtcatcatgagaaacagacccacaaatacagagttaatcttcttgagctgtactggscactgtagaagtgccaaggacaccccgttagaaatgccaaggccaccctgttagaaaccaggtcttggggaatgacagaagagatttctctccagtttggttgtggccccttctcttggctcacagttyttctctgtggctctcaggccaccatattttatagtctatttaaggaaagagagagataatgaacttggtttggaatcttacttcatgaaaatttcacagaatttaggaagcatcttgtctaaatatcttgttctaaatttttagtgttcttctccagtccttgtgtgctttagggtggttttgattagattgggcttgacagttacccagtcccagatgagtgtcccctttcctgcacctccccccattcacgacatggaaatggaaagaatcgagtgaggtctgaaccccaggtaaaattggcargctgactaagttcgccttgggtgacctcaccttttcatttctgtccattttcctctctttttgttccttgccatctccccatatctcaaaaaacctggaccttgtagcttttctatactggcccccaaaataaaagtctcttttcaagcaacgatctctaaactcatttgctatggtattgataacaggtatggattagtcttatcactcccaagagtattatcattttgggccaggtgtggtggctcacacctataatcctagcgctttcggaggccaaggcaggtgaatcacctgagtgaggtcaagagttcgagaccagcctggccaacacggtgaccccttgtctctactawaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcartaatcctgatcatasctgtatcccttaaggaaatcaaataactgaaaatgaagatctgtggggcagataaattcaggaatatttcttcgtttatagaggattcacctcatgaatttgaaatatggcttgacttataaaaagytgatctacctggagcttgtagctaacacctctgtcgggccaaacaataaatgcttacactgagaaagccaggtttgggatttcaaattaatgtgcccttaacataaactgcagagcccccctgggtggagggaactattacctggttctaatagcagatgttttctggccttgagtgccagtggtaaccagagtcacacattttaggattttggtattgatgagggtttcagctgaatattacttgagttgaactccagttatctttacctstcttaaaggagcagctgccatagtgcctcaggtaaagttggcttgggataggctggcattgccttccagtccccagcctcaccttcctcccacctcttcactgcctcttttctttgccctgccccttcaggtgtcctgcgtggggcaccattcgagttgcattctagtgtattaggttggtgcaaaagtaattgcggtaatgtgtgtgtgctgccccgtgtctctaccttattcaagtttctttaaggaacagctgtagatgagttctggtagaactgggtagtgctcccagaagtatcccygtgggtccgtgagggttgggcattcataaaataaatccttgctctaacgatagagaccaacttctagagccagaagtgctcatcccaggaatgaccaggggctcccaaaccagyggctcgggccctctgcagtgccatgtgcagcctctgtgggttagaggcatggagctagagcagggtcctctgaaccagagccaggcaggacactctgagaaatcacaagcagaaggacagcaattctgaaagcagagcagaacagctggaaaaactgagctgatgaaaaggattatccgaatccaagcttggcgttccttgctctgtgtccagattaagaaaatgctagtggtttgcctaggaacacatttgcascaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggcaatgaggttgtaatgagctgttaagctccctgccgtccctttaactggtgattacagtaaaaagagccacataaagtacgttttcatctctcacttcagcccccgagagcctctgaggtcttgtttatccaattatcagacttgctgtggaggacggtgcttgctgagaacaagcatatcagttggaacatgatttctctgatggataattagctgttttcaggactcctcctattcagctgaatgttctcagaccagaagtctgatcwggcctaacggggatgtgctcccatatcgcagyggagtcttaaggagtactacccaccttctcttctgcgggggaaaaggaatggcgtagcatgcatgcaggacctgaccggaaggaatgtctgcgagttatgatttagtgactagaacttctaaggaaagaaatgaaccagaaataactscaaacgaagtggttaggaagaggggcaggacatggggagtatccttgaaagggacttaatttcatccaaggaaatwggttcccagtttaagcccagttagctctgtattcagagtggatcttctcagtgctaggtgaaggaagggtggttgtgcatcagagtaagtgtccagccccaccctgaagactcccattcaggtggtctgggatggggcactggtggtctgacactctcttttgttcaaaatcaaagcgtccccctccttctcatggaagggaagcttccaccaacccttaatgagttcctgtaccatatggagttgtcaaatgctccataccgggcacagcggctcacacctgcaatcccagcactttgggaggccgaggcgggaggatccattgagcccaggagttcaagaccagcctaggcaacatagcgagaccctgtctctacaacaacaacaaaaaaattagccaggggtgggggtccacacctgcagtcccagttacttgtgaggctgaggtgggaggatcgcttgagccaggaaggtcgaggctacagtgagccgtgatcatgccactgccctccagcctgggcaacagagtgagactctttcaaaaaacaaaaacaaaaaactctgtcctaagtatcagatgatgcggaagcccagtmcttrgttttactaggcttagcaagcagtcgcttatggaacagaagcttttataaacaaaccatgtagttaggaagggcagtggcagcccaggcaaaatctagtcatttgaattagccaaggaacggagacaaagacaaagtgaatttctggtgctagttgcaacttggtctcgataataaatcaggaacacaatccccacattcctaatgccttgctccaaaactcagcaatcctcctatttgtaagaatgaaaaaattcaggagrgaaccaattgcctaaggttatgacagcaaagctaccgttccagtataatattcagccactagaggacacaattcactcactttctagattcagacacacgactacctttttcgttacaaaacatatgaagtcgtgatttatgaaagtaggacacatattgtattttttgcccttgaagtgcaagaccaggaaaaactgaaaagtattgcagcatcctccgagatcactgttgtcattttttcgcaaaggattttattctagcctgtcagtttctgcctcctttcattagtaagtcctgaccttagacatctggcatttttttggaaggtgtagtggggagggggaccaagagatgcatcccttaatgtagctaaagatcgaaatcttctcattttggggagagttgcttactatacatatttacacattcaccaattttgtctcatatgtaaaccacagaatgtgccgaattttcctagaatcatggttgaggcaggtaggagtaaggaggtgctgtgtacattagtgtcactgattccaccgttcacaactccataccactctccttattttatactcttgagtccacagtgctttggtgttacagcccatatagaacggtcctacctaaaagtcctgctgtcggtttaacagtgacgagtgtcatttttccactgtcctttacatagaattcagcaggaagcttcatgaggcaccctgtttctacatgagttgccctggttggtggaggcagaagcaatggagaagtggtgatgaaattaagtcaaagttaggcttgcatttgactstgatcttgaatagtttgtctagattagagggagcacctaaaatccaaaaagccttttgtctttgatttctatasttttgttagttttacaaattattatttaaaatcagtcctttgaagtggcttsttctcttctgaygggacagctttgggaaactgtttagtcttatttcttttgctattgggaagttgtgggggacgctattttgcagctttttcatcctcagttctgacctcctcatgtgctttacagatgcccccaaaggtcagcattcatccacctttcactgagagtgtttggccatctctaaagcagaggtattttaacagctctccttaatggatgtcctgtggtttcaggcctcagacaggctgcccttgggccctcagcagaagtcgggaatcgtcttatacttccagatcgtcttwtactcaggcaaaatatgagatgctgtgtcagggtttcccaagggaagaaactgagtgggaggtgcaggtaaaccccacagtacaaaataaaacagagctgtgagtagttgaaaggactgtgttttgacagcgtaataaggtaattgtttaaaaccatggctaattcatcagatgtcatgtgtcttttatagttaaaagatgaaatttctttacccactggtgtcaacaacagaaagattctaaaactttcaaaaaatgtgccagtcctggctgctttgtttcatgttctttgacaactttcaaaatgtaaattgagattcatgcaactattaatggaaatataaatatcatggcttcataaggataaaattagaggagctcaacataacggctcattttaatgatttctaaggggtttccatgcccaggctaataactgtacatttagcaataagmaaatctcaaagcctatttcttatctttccctagaattayagcttttaagcccaagctggtcgttccttttataccactccactcacttgataggggtgacatgggctgagctttctctcctatcagggctcaaagacaagtttagcagcgtttctaaacttctgtcaatcagctcacaggacacagaccagtttcgttatccyattaacagatttacatttctgttctctggaagtgtcagttaatgtccttaaaggtaatatacacaaatgtacacaatagtctctgaatttttctcagaagacamactcaraaaccttagaattctgattcattctctttggctcagacttggatgaatttgcttctcagagtagggacatgaaaattattcttaatttatacttmatgtaatctgtttcttctttctccctccgccgccctccaatagctcttctgagcttgtttgttcttcccctaactcccattgttgaaaacatggcctcccctcattctcacctttccaggaatctccttgtgctcctcaagttcggctcatcgcaaacttggagttctgttttctcatgcccttctttcattttcttcttttaagagacaggrtcttgctctgtctccaagattggagtgcagtggtacgattctagctcactgcagcctcaaactgctgggcttaagtgatcctcccaactcagcctcccaagaagctaggaccactgctgtgtgtcaccacaccagctaattattttatcttttctagagacaaggtctcactctgttgcccaggctggtcttgaactcctagcctcaagcaatcttcctacctcagcttcccaaagcactgggaggtgccactcttcttgtgttttttacctttgcatttatttcctggttacaatacttttaacttaatggctgctgaactagattctgccaatgtacgtgccgtccaggacacgttcatgccactttaattttcttagaacatcaatgagatagtcttactagggagagataaagggcaggggtttggttttctggcaggttttctttcattttaataacgagccaacccacggaggaaggaattgattgatggctgcttcctcttttgtaaagaacaaacatcaaattagtggtttgtcctcactttgcggataagcagaataataacacctgtgcctctccctgcattattttgaaactaatataattttgtttggacagaacgtagatagcaaccttaatggggaggaatgtggaagaggaattactgaagggggaccagtcagcctgtcaggcagcaactctggtgccaaagaatggacataggatcagagctgtggacccccgtcctgtttgtaaacttcctgagggtggcagagattcataccctttctcccatcaggacaaaaatcagtgtgttggagctcactcaggaaatgctctttgggattggcatgggaaggggatgaggccgattgacaattagcctagttcactgggattttgttgtaggagctgggtggtggcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattasagctgcccattggcaaatcaggtactagtttttgttaatcacattgcagtcttccttcactgtttcttcccctggtcccrgaattamggctgggctccatttgacaagttatcttctgtgcaggtagagcagcaggctgtgttagctcacagcatctactcagtaggcatggaaatatccactgaatgggactgagaaagtggaatgggaggggaacgtgtgaagaacaggaagtttgcctctttatgtccaaagtctgtctacttagagcaacaggatggtgatgatgctttctggttaaagatgtcatggcaacagtcttccctagacagctctctakcaatagccagtggcatgtaaaccctgcatttttgcactgtatccagtgtttgcaaytcccttgtagaactttccctgaagtcagcaagaaccctgtgagaatcaggatttgtctagaaatttagcatttacctaatcaatgattctctagacatgtcagtacctccaagtgattcatatgcatgtttggtgggcgtcgagcatgtggcagtttggagaaggaagtggagaatgcagcagcagcaggagaaatgtttgatgttgctaaacatcaaccccacagcaagcctagaactcggggaatgggaggcatggtgcgggtagctgctgacacacagctctagagatagctgcctgcaaagctggatgggactccaggcaataggcttcagggcctaactgctctttcaaggtcactgattgttacaggagccatggtctgcagcattgagcatggaattattattactattaagcatgatcctcaccgtgatgctcttggggtggaacaaaagagcccagagagaatatgcttattttatgcaacctctaacgtttcctcccagagttgtgatgaaactgaaccaaactctagcatgagaatcggcatcccaggccagcagccaaaacaagtggtgacacttggccaggcacggtggctcatgcctgtaatccctgcactttgggaggccgaggcgggtggatcacaaggtcaggagtttgaaaccagcctggccaacatagtgaaaccccatctctactaaaaatacaaaaaattagctgggcgtggtggcgggcacctgtaatcccagctacttgggaggctggggcaggagaatcgcttgaacttggaggtggaggttgcagtgagccaagatcgcgccactgcactccagtccagtgacagtgtgagactctgtctcaaaaaaaaaaaaaaaagtgccgatactttatatatctagctctgaaagaaatgaagtctgtaagaaggactgttaaccctcagaatggtctggggatgctacatccccttgtggacttgtcacactggtatgagtgtagggagtgggaacacttcttctcagctccttcctcaccatgtgtcattcagggacaaagggagcaggatatcttccctttgaaaaatctcatatgcctggcaatactcgtcaccctgtgaataatgttgatgcattcacctaaccagtattataagcccctgctgtgtgtcagacactatgcttggtgctgaaatagacaaggaggggactgcctgtcttggaaggcaaatcccagtctcctaagagacactagaaccacaggcaaccatgctgatctatgcaatgacatgtaatgcaactttgtcctgcaaccaccttgagatctttgaaagttctcctacctccaaaactcagacaagtcctctctcttgccaagtgcctaaagcaaggatatgtttatagaggcagctggggcatctggccaatttatttcccagcagacctgctgcttcccctgattccaatactttcttccccaacccaaaccaaggcgtctggcaatgttaaawacatcaagaatgatmaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctytctctgtctgttaaaggaacatgcaggttggttggtgctggttctccatctgacagttctgtctggtggcctcaaaaaaaaagaaaaatacagcatagtccagatttggactatgcaaatggtgtcttgaaacttaacttttaggtcttgagcaaagccaagtattattgaaatgtttattttgtttttatctgcaggaggttttcattcaaaatgtggtgctttgggggaaaaggaagggtgtttgtactaggtactttttagcattcttcttattatctgacctatcacagcctcttcaggagacattaattaatttagttcatataatcaacactggaaccaaggaaaaattatttatacttttagaaattctcatgttcttatayttctttggagattgaattgactccaaagagactattttgtgattaagaatatttttgtggccgggcacggtggctcacgcctgtaatcccagcactttgggaggccaaggcaggtggatcacctgaggccaggagttcaagactagtctggacaacttggcaaaaccctgtctttactaaaaatactaaacttagccagccgtggtgacgggygcctgtagtcccagctactcgggaggctgaggcaggagaatcacttgaacccgagaggtggaggttgcagtgggccgagatcacagcattccactccagcctgggaagaatatttttgtgtggggagtcrttatattatgtccttagaccaggaggtccaattgaggcagaaatttttgaagtaaaaccattttttttgaaggaaacacatatttaaatatcaaagaacactggacgtatacttttaaaaatttacatacttgtgttagttatctattgctgtataacaaaacctttgcagctcaaaacaacagtcattatctcacaagtttatgtaggttacgcaggtgcagctgacctgcttggtctgagctttcgaaaagtgcagtgaggatgtcagcctaggctgccgtcacctcaagggtcccctgggggtggatccacttccaagctcactcawgtggctgttggcaggrtgcagttgctcacgggttgttaggctgagggcstcggttcctcactaagccagaggcttccttaagttccttaacatgttttctcatggggggcagctcacagtgtagcaattggcttcgtcaaaacaagcaagcgggagggtaagagacagaaagcaagacagaggccagggtctttcacagcctaatctcaagagcagtacctcatcacttttgtcctattttgacaaacrtcgtattgacttttgtcactacatcagaagcgagtcactaggtctagcccacactcaaagggagaggatttcacagagcaagaatatcaggaagcagaatcattggttatttcattagaagctgctrgcacagttcttaatgaagctacaaaacattgaactgggaggaatatgggggtaggagggtgacagggagggcaggttaattttgtggatgctgaggacaacgtgcctcatgaaaagtgttcccatcagactggtgtatttctttttcttttcttttttttttttttttttttttttttttttgagacagagtctcgctctgtcaccaggctggagtgcagtggcacaatctcagctcactgcaacctccgccttcctggtacaagcgattcccctgccttagcctcctgaatagctgggattacaggcatgtgccaccacgcccagcttattttttgtattttagtagagactgggtttcaccttgttggccaggatggtctcagtctcctgaccctgtgatctacccaccttggcctcccaaagtgctgggattacaggcatgagccaccgtgcccagcccagaatggtgtatttctaggacatctgcaatgcatcactctctaataaaagaaaaaaaaatagccactccttgacagatactcaaaggtgtggagtcccttactaaaccacactccaaagaaataagcctgcaaaatagggaaaagttgttttttacctagaaagcagattctctgcattttcttattttcaaatagtggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaaggtgagatttgcaggctgtctgaaatgtttcttgctaaagtagttccaatccttcccccatttagaaaaaaatacattcttagtaaatgactttcaggcagaaaaagaaaaccacactggaaataggattctaataaaccaacatggggctctagctggtgaacatatttctgagccatccctatacagaaaccacaagacaaataagaaaaagtaaatccagatcacttagacccttcaaascacatcctgggttccaaggacagtggctgcgagttaggaaagatacatttatccagtggaccttttgactgtcttgtcaatcttaagaaaaaaatgtagagtaaaaaattttggctgggcktggtggctcacgcctgtaatcccagcactttgggagaccgaggcgggcggatcacgaggtcaggagattgagaccatcctggctaacacagtgaaaccccgtctctactaaaaatacaaaaaaaactagccaggcgtggtagcaggcgcctgtaatcccagctactccggaggctgaggcaggagaatagcgtgaacccaggaggcagagcttgcagcgaggcgagattgcaccactgcactccagcctgggctacagagcgagactctgtctcaaaaaaaaaaaaaaaagaaaaaatttggtttgggtcccttcccaccttcccttgcttcatcactttccttaagcctctaagcatccagatcttccccaaagcagtgcttcctagtcagtgattacyctatcctctttttattccttttcttcatgcacaccttcagtccataaatccaagctttttgtaaggagggagggtgagtaaaccaattcatactaaggtgagagtgaattatatataaacctcttaatatattaaatctaccaagcagtgtttcagaaggaaatctgctaacatgggcatcttacttgaaaaaaaatttcagttggttcaacaaagtatggtttagaaatcattttcaatcaggatcgrggagagaatttttttttttcttaaagcagttaggtttccccagcagatttcgaatgcttggatatttgtgattcttttctatgggaatctgatctggataagacctaagaccataaacactctagctttccctttgggtctttgctattgaaaactagttggacttaaacaagtgaagtgggttttaaggatggctcctttcacccatttctaaaagatagcattcttgagggtctgctttatttagcagaaggaatgctggttttccaatctctcactcaaaaggaacttttacttatctcatagaaaagaatgggatggagattaatgtaatagaaaaggtattctacaaatatcatagcagctatatttaatcaattcatgttcaaagatcaattagtagtaataagagttgtgctgtataaaatcaccatatctcatattcaaattgcagatcatcagttgaaaaagcatggattgttttctcactgaaagaaatctttaaaagtggtaccataagagacattaagactggctattgttttatttctctctctctctctttctctttctctctttctgtcatttgatttctgactttcagtggatttttttaacattacaaaatcatagagaaagaatattggaccatttattgtagagtttttaaacaatttgataccattttttttttctggcgtcttaactgcatttgctgtttgtgaggggtgtagaggtccctgatgttcrgagtacagtaccagcgtttatgtgaaatattgcagcctggcctgtggaggacaggggttactaaggggcaagctgctgcttgcgataacacccccagtgcctccttctaatcttgcgccatttcccagggcagacagccttgtggggctctgactggtgccctggaacatgttttaccttccatttttcttgctctgatttctgaagacagaatgttctcttcaacctacacatcaggagttttccttctgttttcctttttcactggttcctttgtgaatttgcacttttatctaacctaaaacattggaaacaggaataaacacaaataatggcatgaggccgtggccacagaatgacaagacaggacacagcaaatgttttggktttttttcacatttatgaaccttcycattctatttatttatttatttacttacttatttcttgagacagggtctcattctgtcacccaggctggagtgcagtggcatgatcatagctcactgcagccttgaactcctggactcaagtgatcttccagcctcagccttctgagtagctgggattacaggcatacaccaccatgcctggctartaaaaaaaaaattctgttgtacagatggggtctcactatgttccccaggctaggctagtctcgaactcctggcctcaaacagtcctcctgccttgacctcccaaagtgctgggattataggcctgagccactgtgctcaactgcttcccattctaaaaagtgtctaaggcagttatagaggttatataacaaggtataaaatttctgagtgaaaggaaaataaggagagagaaataaatctaagtgtgtgtaaggttaatatgtacacagaatgtttattaaggcctttgacagttcctttaaaaattacctgcaggccaggtgcggtggctcatgcctgtaatcccaacagtttgggaggccgaggtgggcggatcacttgaggtcaggagttcaagacaaacctggccaacatggtgaaaccctgtctctactaaaaatacaaaaattagccaggtgtggtggcatgtgcctgtagtcccagctacttgggaggctgaggcaggagaatcgcttgagcccagaaagtggaggttgcagtgaactgagatcacgccattgcactccagcctgggtgacagagggagactccatctcaaagagaaacaaacaacaacaacaacaaaacctgcaaatttgagctgcctagcagccaagcaataaagggaatcacaatgaacrataagattcatatatctgccaatttaaaaacaaaccagttstcttgggtcagtgcttctcaaacttgaatgtacatttgagacacctggtgcattgttaaaatgtaggttctgatctagcaggtccatggtgcatttctaactggctcccaggcaatgctatgctgatgctgatgctgacgctgacgttgatgctgctactcattggactgccctttgagtagtaaaattttagctcactcagaaaaacctcatagtttatttggagtaasatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaacmttttcctgtagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagctttttatgtataaacctgtttcattggtgttgtatcagaattgcatgttgctagtagtttactatcaaaacaacacttgtgtttcaagctgttaaaaaatgaataaaataggccaagtatggtggctcacacctgtaatcccaacattttgggaggccgaggcgggcggatcacttgaggtcaggagttcgacaccagcctggccaacatggtgaaaccccatctctactaaaaatacaaaaattagccgggcctggtagcatgctcctgtagtcccagctactcaggaggccgaggcaggagaattgcttgatcttgggcagtggaggttgcagttagctgagatcatgccactgcactccagcctgggcaacagagcaagactccatctcaaaatttaaaaaaaaaaaaaaagaataaaatagaaacactgatttttctggtattttatacccttccccgaatatccatacccaaggcatttttaagatttccctaagctggaagcaccagaccacatgttatttaaaacatattaagatgtacctactgtattatgtatactttgtatatcattttataacagtctgcaaagtagcaggaaaaaatttttgccttcaggttaaactcagaagagttgccattggctaactgaaaaattttgcatttggtaagcatttaattaaaaatttattgatttcggttttgaggttttacttttcatatttttagagccaataacttctggaatctcagacatttttgtggaatcttaagttgttcatagatcctaggtgctgtgtttgtcatcctgagagcttaaatggccctgtccaaacctcagcctcagctcagagtaggaaattgtcaagcacttggtaactggtaagcaaatggattttagtcactaaatggagcgggaggaatggagtgctccctcaaaaagagcatttcagctggtcacagtggcttgggcttgtaatcctagcactttaggaggcccaggcatgaggaccacttgagcccaggagttcgagaccagcctgggtaacacaggaagatttcacctctacaaaaagtaaaactaaaaaattagccaggcattgtggtgccttgaatctgtagtcctagaaacttaggaggctgaagcagaggatcgcttgagcccagaaagttgaggctgcagtaagctgtgatcacgccacagcactccagcccaagcaacagagcatagactccatctccaaaaaaagaggctgtgacagaggaaggcagggggatgttaatcagagagacatagagactgggagagtctgaaagagaggcagagagacttacacaaattaaagacacagactgagagaaatggaaaaatgaagagaggatcccagacagattgattgacttcccaggtaacatataatatcttacaatcctgcagaatgtttaaagttgcattttaaaaggcactccgtttgttcacacaatcctggtaagaagatcatcttaattagtatcatactttgcagctttcaagcagttcttaggcatcattgcgtttaagacctggctccagccgttttattacagatgaggagattgacttgttcaccttacatttgtagagcattttgcaatttttttgaaggacatttccacccattatctaatcacaagtctccataaatcccatctcccctggtataaaagcagcttaaattacaggtgctactaagatgcaaaatgcagcccacaaaatcagcaaatattttttctttgtttcctccttttttaaaaaaggcgtagatttcatattactactttgtttcaggccgtatattgaagtaacaaaaataaaaccaaaattgacaccaattttatttcgaaataaaatctacttttttcactttcccacatcattttctagctgctaaccttcatgcatattcaatttttgcatatttacagccctgtcaaagataaaattttattttctgcattttcactcaacattatacactgagtattggccatttcactcatctcagtgccactttcaaagagatacccaggaaaagcagcagcaagggttgttcgaccttgaacaactacagataatactttggctctctttgagatttttaaggccctgtaagtaaaatattttcagattacagaaggcttgggattctgtctttatcacatgactgattggtcctccatgttctccttggcagatgtgggtatcagtgacacaatgttttttactcaaaacatggtttagcytaccagtaccaggaatggccgatgcatacgcattctcattgtgaaggtttatttgcacctccactcttcttaaccaggctattttcacagaagaaataaccccaacttcatgaaccctattcccatgacctatttgccaatctgttaaaataatggccaactcaaatgatcagtaatgattgactcaccatgacatcatccatcacctttgtcactggaagcccacttgccttaaagggtgcagcatcttccaactttgctccagcaacttcagctcctcattaaatccctccctgtaggtcatccctgcaaccagttgacactggagctcagcagccagctgataggggccttcactcctcttgtcgagctgctcctctctcctctcaaagccctctttccttctctcctgctggctgacctagaagctcagctaaagaggtgttcaaagggtccagtcgcttaaacaggtggccagtgtgctttctgctataactccttgctccttgagctcagctccaagctgtagaaggccatggragagcacattgatgtcatcttgggaataattaacagggtccggtttttctgttcgtttccttgcaccagatgaagagtaggataaacttgggagaagccaaagtgatgtttttgtaytgtggctttgaatgatttcaaggtcccttggttaacctattctcagcaaargaaatagaagatggtcccaagatggtaagagcagagtgtttggttgataatttgatctaaaagtgaccagactccacaagttaacccccagagctgctcaattacagcagtttaaaaataagttgaggattcgttgctaaatcagtggaaagaatttggagtttccaaaatagtttgtaatcaagaaaagccatctgaggaggccctggagggaaaatcgctgatgattatcaaatgtccagttctcartgcggtggtatatgtgactgaaaaaaaccacttttgtccacatttggggaaagataagattatactaaatgcctggcacatacactggaccttcagttacctagaaaactttcwaaataactttgccataacaagtggcaaattattaaggtcatgggctgtcttctcaaaattacttagataacatgattctctggccagtatgagacscttaatttatcacgtatgaagcatatgagcctgtttatccgttcgttaatcattatttttatctggcttgggctctgggttactggccatgcaggcagatcttcccttccaaaaggaaacgttattattctcttgtattcgtttcttyaaaaacatgcagatttaacaaaacatattacttagcactcttactgatttagaaatatgatgacccttaggaaatgcatctccttaaaagaaattccaggcaaactcatttaacctttctggatgttagtttcctgaccttcaaaaaatgggatrttggaccaaattatcttgaagtttccttccagctgtgtgctcggtggggagtgctggcagtgtggggcaggacactgaatatctgtggtggtgatgtttggatacaggggtgagcaacccctttggaagcaacatgcaaaattgctgagcagtggtgggggtgcatgggaatgggtggcggtgcccctgtattggagtgtaagagacaagtgtggtgagagcagtctggcagggctactactgttatgatttacacagtccctttcatccagctacttcaaagcaccttcacaaactctggctcattattccttcaaacacagcattcaagaaagrttgataggcgccttttaattaattcaaagatgatgaagctgagcattacagaatataaggggattcttccaaaagtatctgcactgcagaggggcatgatatataaagtgttcatcacaggtttctaactgaaacaaggaaatgacctgaacgcttatttttagaggagaccagtatatattatggcatattcagaatatgcaataccatgcacccattaaaatcatgtttattaagaatagtcacattagggaaatggtcataactgaacaacrtttagtggcataaaaaaagataaagctttgtacatacagtatgatgaaaatgtttaatgtggctgggcatagtgacttgtgcctgtaattccagcactgtgggaggccaaggcaggagtatcactgaaggccaggagttcaagaccagcctgggcaccatrgtgagaccctgtctctacaaaaaatttaaaaattagccaggtggtcatgatgcatgcctactattctagctactagggaggctgaggctggaggatcactggagcccaggaggtcaaggctgcagtatgccatgatcataccactgtactccagcctgggcaacagagtgagatcctgtctcaaaaattgaaaaaaaaaaaaaaaaaggtttaatgtgtagargggaaaaggctaaatggaaatgtgttaaagtcttaacggtgatcttccttggagcaatgatatagtgggtggttgctattcttttctttatacttttatgtacttttatgttatgcaaggttgaaaaaatgggcacatattgctttcatagtcatttctgttaagataatcatatgattatgaaagagggagtgtgtgtgtgaaagtggaatggaccaatcaaatagaacagtaggaagacctcagaagatatgacacatgagctcaaccccaaagatgagaagaaccagccatttagtgaatggggaagccctctggggaacagaaggcacgaaggaaggaataagtttggaatgttctaggttttgaaaaaaggccagcatgggagaatgatgaaagataaggtcagagccattgccaagggcaaggtcatgtaggacccatgacgaaaagtttgggaaacccttgtaggggactgacataatttattttacatttttgaaaaatccttctgaccaatatatgaggaacattgtaagaggcaagtgtagaagtcaagatctattgagaaggcgttgcaggggtccaggtgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatactygctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgakgcattctcagtgcacagtaacctgtttatctcgctttgccttgctctttcccaagcacatttttgctcaacgccccctacyttccccatacacttgttaacactttgcagagcactagggctctgtgggacaggctgggaaatgcaggttgacatgccactgttaatacctagaaaattaaggcaaacttgtccctgagagatgtcaggatagcacagtatgraaaggccatgcttatcagggctcttatctgagagaatacagtggttatgagcatgactctggaactagacagtctgggttgaattccccgctctgccatttagttatatgatatggggkgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatsagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataatwattcacttctgagaggaaaaacttctttggaaaaagcaccccatgaatggaagtctcagcatttgctgaagaacttagttaaaataaactctagacctttttcattgattctttatctcttcttttccagaaaccttctctaygtctacccacagaggctgaactttgtaaacaaactagcatcagcccggaacattacaataaagatccagtttatgtgtggagaagatgctagcaatgygatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttctttttttttttttttttgagacrgagtttcactctttttgcccaggctggagtacartggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcarccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtayccaaatgttactgrtaatttgatcctttctctactggtgaacaggtcatctttggaaartccagcgggcctgaatttctgcaggaagtgtacacagctgttacataccataataagtaagtctatttcagcattctaaatatatgccaagatggtttcatcatctcctggtttttccaagtcccstgggtggttcctcctaactatttttataattcagggactgaggggcaaaggaaatccatgccagttccrtgactctgtgttgaagatgtataactttgccattaaccaagactgagagaagaacgtgtcttcaagaatccaatatagttttgacttttccrgaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacrtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttkttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactrgacagaaattactgccaaaaagagtactggtcaatatctactcactgtttagttgcatttgattattgcgagctarataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaycttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggcygaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgmtatatttttgacgcttgctttttaaaattggtattcarataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttctyatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctrtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaatttttttttttttttcattagaaacagtgtcttgctatgctgctcaggstggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctstaagacctacgaaggtattgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagaygggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgayatttccagtcaagttggtctgcattgcttgttagtaatcagaaaagggaattggatwgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtkgagaaactttgcagggggacttgatttgaaactstcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccgaaattatttcttctttagctaataattattgaaaggttcaacttcatgcaccacattctacaaagaagttcatagcctcggtctgaaacatcatgtcttagaccttctggtctgaaacgctggataagaggttctacccataaagagctattcgattgtgtttgtgaatccactggtgracattgatggtataaaaccccatgaggcctgccttctcccttcgcaggacaaccacctggagaagttcttcaccctctgccactccctggagagccaggtgaccttccccatccgcgtgctggatcagaaaatcagygagatggcgctggagcatgagctgaagctcagcatcatctgcctsaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctatttttttttgagactctctgcatgttggaaagaaaaagaaacattaaaatagggttcttaatattayagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgattgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagrgatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccycttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaraaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtckgtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcaracatttttaggttaatctgtacaagaatcagggttgtgcagcacatctcaaatcatagtgtccacaacagtcmcgtgrgcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccrtytacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggygggcggggcaacaccacctccaccccactgcagtgtaatccaaaataaaacatcctatgctgggtgcagkggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacrattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggygcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatatacygtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgyttaccatgatctccaccactccctggtgccttatgccccatctacttctctccaaaagattgcctcctaccccaaccrggatttgttaagaagtcyctaattccaaggcctaatcbggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctsagctttggagtgattaacgttctttagaacagattaagaccattctgacagatgcagcagcaagaccagcatctgaggatttgctgagaactacttagcttgggtagcaaagttttaaagtatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatcacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctaacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactccagcctgggcaacaagagcaaaactctgtctcaaaaaaagatacaaaacattagttgggcatggtggcgggtgcctgtaattctagctactcaggaggctgaggcaggagaatcacgtgaacacgggaggtggaggttgcagtgagccgagattgcaccattgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttayggaattatatactctatacccagtstctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttracagttttgaggagtgatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacaycgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttktaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccmcacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgaagctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatrgtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctracatcacagggaaatgtttattaaacaggcaaggagggaatgagcctccccaagtctccctttggactggatgagggaaagaccaagtgtgggagggccggggcctggtgctgtscactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttatawyatgtgcacagttagaccacctgctagactaaaactcaaccccacgcctctctcaagtgagacagcttcacttsagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtgtcacttactctgtcacccaggctggagtgccgtgatgcaatcttggctcactgcaacctctgcctcccaggtttaagtgattctcctgcctcatcctccagagtagctgggattacaaccgtgaaccaccacatctggctaatttttgtatttttagtatagatggggtttcaccatgttgaccaggctcgtctcaaactcctgacctcaagtaatctgccctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattasggtgttcaaatagctttagctttcttacctactttcttaccagaaaaaaaaaatgagtttatctacgtttattccaggttttrtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgkagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctscaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaraagtgttggtgaataataatagcctttgtttcacagcctaatttttgtggttcttatttagcatttccatgaggagcttgcccttcagatggtggtcagcacyggaatggtgagagaaacagtcttcaagtatgcctggttcttctttgagcttctggtgagattcttgcgcgtttgtatctgtgctcaataggccaagagaagcacacagcagaaaggaattgacrttttgttcactgagttgcccctgctgaaaacctggggtggtttcttgaaatctaataatctctcacccctcccatccttcttccactaaattgtgttgcttctaccatgaaaatctrtcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccartactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataaracccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaackcagcagacaggagccaaatacagcagtgagttctgaaagccttagtgctgggatggttagcctgcccagaatcaggaytggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttaggatttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttacaggagcagaagataactgctggaaactatagaactgtttctggaaaaactgtgctccctcragaaacactgaaactcaagataggaggaacatttctcccacgttctccttactgtagtttcaggaacagaaaagactttagttcgcgtcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtcwttcccccttttctgcattgtacaagcaggtcaccaakmtccatgttgacatttcctccatccccctccgcaggtgaaaagcatggcccagcacgtacataacatggacaaacgggacagtttycggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcrttttaaaacaataattaaaatataactrtaatgwcagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgatcatggttgtgcatatctgtaatcccagcaactgggaggcagaagcaagagaactgcttgaacctgggagacagaggttgcagtgagcygagatggtgccacagcactccagcctgggtgacagagtgagactctgtctcaaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataagkcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtrgcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgrggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcarccaggtgagtgtcccccccacccccacccccgagcgagccacttggttccttctcatataatgtgatgttcgttgccatggcacgctgtcttcttcattactgagwtggcatgaatcctacacatcctgtgttttgcagcacgtccctcatgtctgtgccatggacattcctcagacatgctggtttaccttgrttcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcacctccaccaccaccacctcctccaccatcaccacctcctycaccatcaccaccattagctccaccatgaccacctccttcacctccaccatcacttcttccaccatcatcattgtcaccatcatcaccactacccacctccaccaccaycaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctctatatmtmtatatatatatatacatatatatatatgtgtatatatatatgtgtatatatatatatgtatatatatatatatgtgtatatatatatatgtgtatatatatatatatatagtttaaaaaacaarctactcttgaagtgagtgaagaggaggcatgtcyatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcmtcctctctcagtctgggacaagytccttgagttttttgcaggtactatgtactttsctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcytataaaggttagtcttattaatttgacaaaaamtcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccrgtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttygatctgacttccgagtacygccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccatargcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagckatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatrtctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaataytgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggarcctgtaatcccatctactcgggaggctgaggcagaagaatcatttgagrctggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacamatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgmtatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgsggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctrtaggtgrtagcagatacataatgctaaacatcaggtttgaaattactgtgctgactttagtgactgagaagyatcagtctcttaytgggtaggggacatggggaaatgtcatgtttgacttgacatcacaaaygatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgtttygtttgtttgtttgttttgagacagagtctcactctgttgcacagsctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctgrtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcartgtagggtatagatgtgcagagaatttaactttcttctcccgtgagaaagcagcatsctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccrtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcsctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctscgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttayggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttawgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttcygctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccasctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctataratgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcarttaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgyrgtggcrggcgcctrtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatwtaaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagygagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactstagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttytgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaartgtggacctaactctagaagtttaaaatggccattygctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccrggaacccaagaaactcaggtttccttccatcatagttgtgatttcaccagtgaatgcgacctggctcacagtgcagttrataacacagctctgacccttttagctggacagttcattattaaatctcaagtctactccattgcttaaatccatcttctgattcacatagctcattatctttrtggaataatgcattaactcttctaggctttttgcttgtcyaaatggacatttgcatatttcaacggtccagaaagtgtatcaaactgccaagtgatgcctaatggccctttatgtctcycctagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctrtcagtgtgtttctaaaatagacagccaggggccaggaacgatggctttcasctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccattgcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgakacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacakggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattrtagaacagtcaagtttgctttagtttgtctagattttgatacmttctttggaatttccatttgtggccatgttaataagtrtgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaarcaattctcctgcctcagcctctcgagtagctggaattacaggtgtccaccaccatgcccagctaatttttgtatttttagtagagrcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacraaaggatatacygtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtntgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacascgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccaycactgtccccagtctcaatatgctaacagtctatttggagtgctcagtctcaaaacarttaggaggcagtacaagacaagtgatacataagtgcaaactgtgtggtaaggagctaaatgctrtgkaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccatggaactctagcctgtcccatttgtcttttaactccagctcctagcctgctctatggtagggtcttaattaagtgagaatgaatgaatgaatgttttcttttattcccttagtctgagaaccctatttcyggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctmtagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaacwcctgggctggygaagatgaaaactacagagtcaggtctagatgactccgccatccctagtctctgctgccctctgatccaacccttcccatggcttccccttgcatttcaatgtaatcstaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtragctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacrctatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaawatagacrtcatgttatcaggtattttttccccataaggcttttactaagtactatttcttggaggtcagcacagcttaaacatggaataaaaatagttggactaatamatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtggtactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattatyccracatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgargaaggtgaaaaggaaggcagaagaaactgaagtgtgmgggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcasagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgytaaccaggccagaaggcagacagcttttagttcacaagccaactctgatcagttagtagtggctgactggagaactatgcttaagaatttygagactatrtccaagctctggggaaaaagtgctacagttgattagttatgcctgccatgattacagcaataggaaggagtggcatgtgtgccrcctgtttgtaatccctaaactgggaaggtttcccatttcttctgtttttcatatgcatttcttccatagctgtgagctaggaagaaaatgattcttgacctgtcacatattcactgccagggccagtgctagggtgargaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaamaaaaacacacacacagtaactgctgcaatgccatgaaaacttccttaatgaagacagcctcrcttgctgttgtcrtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcsgggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggarctcttcagcacggtcagtgcccagagggcatcccggggcctggcctcccatactccagctggacttggggtgctggsaacacctggtcttmatggcccagtcagccccacttcccgaggacacgtgccagggtgtgcggggcaggggatgggcccggggaggactttgatgtatgcaaattgcatgagcttcccaagggagctgagataacctttcatcacagtgccggtctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactamaactgcctttctgaatkgctgttagtccctgctaccaaacttctctcctgttttttcttttcgttttgttttgtttttgtttttgtttttgaggcagcgtcttgccttgtcacccaggctggagtgcagtgrtgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctyctcaggatgacataactaaggagagctttttatattttgttcctcaggatcataagagaatgtttggaacctacttccgagttggtttctttggatccaaatttggggatttggatgaacaggartttgtctacaaagagcctgcaattaccaagcttcctgagatctcacatagactagaggtaagaaaagtgattctgtgygcckgacctggtacactttacaaaaacaagttagagtgggtcatcaccaaaaataaacaaataaagagttatggattcatcattgatctctacataaagttttyccctttgcatttataaaaggcaaagtagaaaggtattaggtgagatcatgaggtgatgtaatattttgatagtttttccctaatactctgtgtatgcttttcacagtttggaattttatatggtgaatatttattttsaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccrggatcactgtgctgttgggggaatggtaaaaacggcttgggtttgggtttcctcactttcacaagagggtrtgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataawaataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattraatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaaygagagtctgaacccagagttacaaccagatttcattatactaagtcgtgatttacagtctgaggtcagtgaccccacycatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccrttgctgagtagtattctrttgtgtgactacctcaccatttgcttgttaattccccactggagtgacatttgggttgtttctagtctttgttatgaataaagttgctggagacatttgtgtacaggtttttgtatggacataagctttcatttctctcmtgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccstgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttacmttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcrtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccayrcccatrgttcatcagtttctccattatctaattagattgggtcattaaaataacaagtataacaggcataatcaagttggtgaacaaacacagatgaattgtggtgaatatatacctcrtcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatayagagagatatatattttgtaagagacaggggtcttactttgttgcccagtctggtctcaaactgttggcctcaaacgatcctcctacctcrgcctcccaaggtgctgggattacaagtgtgagccactgcaccagcctgaagttttcttggccttccttmgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggayaccagtcatattggactagggcttaccctgctggcctcattttaacttgattgcctctgtaaagaccctatctccaamgaaggtcacattctgaggtactgaaggttaggacttcgacatatacattttgggggaacacaattcaacctataaaattcagaaaagactctaccccaaaccagcagaacttagcaaatagattgattgacccttaaaagaattscatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggcygaggcrgggggattgcctaaggttgggagtttgagaccagcctgrccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccrttgcactccagcctagacaacargagcaaaactccatctcaaataaataaataaataaataartaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagmggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcagktggcctctctgtcatagctccaggcttgtccatagcttatgagaccagacagtgacttccctatgtttaygtctcatgttcagtttgttttgacaccrattgaagttgccattgaagacatgaagaagaagaccctgcagttagcagttgccattaaccaggagccgcctgatscaaagatgcttcagatggtgctgcaaggctctgtgggagctactgtaaatcaggtaagcaaaaccagaggtggcagctcctytggttcttattatttaggttgtcattatacgtctgcacccttcttccttggggttgatgaggactttgatccatagacaaacacagaaatgttcctacacttarcctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcayrcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttctyaggctacttcagacaagactagatcttcctatcagacttcttagaacsctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattrataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttytcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtaygaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttkttttttcagtacataatacrtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagaytgggggcttaaaaaaattttttttcatatatytttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatasaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgakgctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccaracttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaatawtaaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatstctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccytgagaagttacctaccctcggtttccccagatgtaaaatcggaataataattgtacctctcccttgcagttagtgwcagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaaraggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatyacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcaggggggktgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcaycagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttwtgcattataaaagtttaaagacataaagtaatattactacataaaatctaagttttttactccagctattaatatgtttttstttataaaacatcacatttattaattgctgtgtaacaaactacctcacaatttagtggcttaaaagaaaatttaattattatgcatgtggtacataataatttttgctttcctcatttctactcctgatacttgcctakgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagytgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctrgtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccasgtttaayggtccacaagccagataaccatgatgagttytaaagattttctctgtctttaatgttcttcagttttgtcatgagaagactggatatagctctgttgttgttcattaraggatttatatctctcttcaactctagaaaattaccagctgttatctctttaaatattgtctccctctcattttccattcccttggagattytattagatgtgggttggatcttccttatatctctatgtttyttaaccaawtttttcatatttttttattttttaaatctcattggtgatttccttggatctgtcatacatttacttctccaattatgtctagtctattatttaacctttaacctttccattgagktttttgtcttttagcaactgcattttttttttttttttttttttttttttgggggagacaaggtctggttctgtcacccaggctggagtgcagtggcatgatcttggctcactgcaacctccacctcccaggctcaagccatyttcccacctcagcttcccaaatagctgggactgcagtcacctgccwccatacccagctaatttttatattttttgtagagatggggttttgccatgttgcccagtctggtctttaacttgtgagctcaggcaatccacccaccttagcttcccaaagtgctgggattacaggcatgaggcaccacacccagcctagtgactgcatttttyttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtrcgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaamattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtaygctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgtttycatttcagaacattgtgctgtytgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtttccctttgcaactcatgctttgtgttttgttttgatgacctactcgctcgtaatgttttgtaaggcacttcagagagaagacagatgcatcatcctggcctccatcaaataacactatccaaggtggcacctcttctgcaatgtttaaccctgctagtaatgaacgatgacttagttcggatatttcagaactttttgtttataccatcaggtatgcatgaatttataatctgaaagaggacttaaaataataattaaaacttaccagcttaagtgctaaactttttattttttaggtatttggggaagaactctttttaaagtatacacctaactgctttttaaaatgagtacacatgacatactttaattccatatgtattcccctactctttgggagacactgtgttgagaccaaggtcaaaaaacgtggtcaccgccctccaaatcgtctccgttccctgaggaagatcatatacctgtgtagtagccacagtacaaaacagactagaacacagcccatagcatgtaaccttttcctgactaactcaaggataggccaacacctatggtattagattctgccctaaaacaataagagttagatgctaagttatatagtcctggaccttaactcaaatagccagaatagccctagtaacctagaatattcctgattaaatatcccctgcttttagatacctgttgtccatttgggtttgttttttacagtctcttttgtaccacagtggatacatttgcttcatgagtgcaggaaccatgttcactgctgcattcttacccctagccctgcaacaaacacacaaaagatacccaataaatatttgttgattcactaaatgaatgaatgatgagtaggcctgcttctagaagtgcactgccaataagaatgtaatgcaagccacatatataattttaaaaattctagtagccatattaaaaataataataggccaagtgcagtggctcatacatgtaataccagcagtttggaagaccaaggtgggcagatcacttgagcccaggagtttgagaccagcctgggcaacatggctaaaccccatctctaccaaaaaaaatataaaaaattaaccaagtgtggtggcatgtgcctgtagtcccagctactcgggaggctaaggtgggaggatcgcttgagcccagaaggttgaggctgcagtgagccatgatcgtgtcactgccctctagcctgggtgacagagtgagaccctgtctcaaaaaataatcagcatcataaaaagaaaccagcaaaattaactttactagtatatttaacccaacatatataaaatattatttcaatatgcttccactataaaaaattattttacagtcttttatttccatattaagtctttaaaaatctgatgtgtagtttgtacttacagcacgttgcagttaggactggccacattttaagtgcacagtagccacagggggccactggctaccatattggatagtgccattctagaagctttcagctttttcaactggatgcctctgatttgtggactcagaatacagataaccaaagaagtgggactagtgtctgaagtaagaatgacagggtatgattgagagccccatgagcttacctaggagagaaacttgtggggttgcagaataaggatttgtcaatattggctctagctgttcacactatttctgggccaactcccagatcatttctcaactccagatagttaagtggggagcatggctgcactttttaaagtgatggcacaaaaaaagatattgaacgttggtcctctgattatatattctaaatatgcagttagaaaagaggccttttaagaatccctaagagtaaagcaaattagtatctttgtttcctgaaaattagagaaacttgatatgccatgatagccctcttcattttatttggaaaactcttctatgaaagcttattagagaaaattttctgattagcttcatgcctcccctccttcagcaaggtcaagggtgcagttgtcactatcacataagaatctcataaaaattaaacatgaatatactgcacagatctgattgggtttgtcatgccacacattgttttaaattccataattctattctataaagagtggtttctatgacaatagatcgttttaaaaacaaacaaacaaacaaaatttagagttgtcattggtaattgtggttgcaagtatgctttcaaagaccagaagcttttgttttgctttgaatgtaatttttttcttttttctttttgatacggagtctcactctgttgcccaggctggagtgcagtggcaccatctcagctcactgcaacctccacctccgtggttcaagcaattctcctgcctcagcctcctgagtagctgggattacaggcgtccaccaccacgcctgactaatttttgtatttttagtagagatggggttttaccatgttggccaggctggtctcaaattcctgacctcaggtgatccacctgcctctgcctcccaaagtgctgggattacaggcgtgagccaagcttcaatattcttaaacccaacctcacacagcctgatttaaaaactaaatttctgctaggcacggtggctcatgcctgtaatcccagcactttgggaggcggaggcgggcggatcacgagctcaggagatcaagaccatcctggctaacacggtgaaaccccgtctctactaaaaatacaaaaataaaaaaattagcygrgygtggtggcgggcgcctgtagtcccagctactcgggaggctgaggcaggagaatggcgcgaacccgggagacggaggttgcagtgaacgcagatcgcgccactacactccagcctgggcaaagagcaagactccgtctcaaaaaaataaataaataaataaataaataaataaaaaactaaatttctggccaggcacagtggctcgtgcctgtaatcccaaccctttgggaggccaaggctggcagttcgcttgagcccaggaggtcgagactagtctgacaaacatgtcaaaaccccgtttctacaaaaaatacaaaaattacctaggtatggtggtgcctgcctgtagtctcagctacttggggggctgaggcatgaatccaggagttcaaggctacagtgagctatgattgtgtcactgcactccagcctgggcaacagagtgagaccctgtctcaaaaaccaaaacaaacaaaaaagaaagcaaaaactaaatttctgataatcactaagtttttaattatgaaattactagaggaaatgcagcatcaccttggttgaaaaccatttggagagccgtgcacattcctgatccctaagtccttgatgttgcacccatcttgaggagcagtgctctctctggaccgatgttactgaatccaacccagttcctacttgatgtttgtggcattagcttggcagctagtttttacgtttactatttttactacatattaggagatggcaaattactgatagccaggataagggaatgattttcaaggcattatagctctaaaaaacaattgagaaatcagctccctcatcacttccttaatgcaatgagagaacacgacacggatgaacaaactgttctgttatccaacaagattatcaagagttattagtgagataataaaaaagtatatgtgactgccaaaagtctccagactaaggaccagaagacctggtttcttgttctttcactttctagtcctgcaattctggcgaagatactatactgctctgagcttcagggtttttttcactgtgaaagagggtgcaagttcctccacattcttccaatctactgaggaaacccaatgagataatgcatgggaacatgttttggaaactcaaaagtgctgcccaaaatgtaaggtaacactgtttacaattgacacttccagaaagtttagccagcacccccacacatggcatccgcttctgacaacgttaatcaaaatcaggccaaaggtgcaggcaggacagaggcctgacttaccagaaaataaacgtctggtctattccacttgtagtgccagtttacattgtctggcgagagccaactaccagggcctccgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaagcgggtagaagaaagaaagggtatcagtggaactgagagtgtatacagtggcgcctgaaaacccaacctcgccaggcttccctgtctcctgtgtgcagcatgtgtgcagtgcattcccctggaaggtaaattcgcggagtcccgcagcccacctgtgtccacctagcctgtaagtgccccctgagggtatcaaagcacgcggacttccgcctgaagcaaagccaccgggcggcaagtttccccgttaacaacaacgaagacagagaggacttggcagctgtgacggatctgcaataattaaactgacgttgctgtttagaagcctgggggtcgcctgcagcctcccaggctccactccatcggctccagcgctgcaggcgggccgtgcatgtctctagatgcatattaagcaaaaagtttctaaagaggatcgcgtggaacccagcaattgattaagaatctcaayggccctaatcccctgagaattgaactaagggctccccagcaaacacagcgatttacatggggcctagagagagcgagcactgccgggggcggcggcgaagggcagcrgtggtgggacgggcggggtagggggagttactgagcatgcgcccgggtaggggcgtgggggagttactgagcatgcgcccaggtaggggcgtgggggagttactgagcatgcgcccgggtaggggcgtgggggagttactgagcatgcgcccgagggtgtttcggggcgtccgaagcgggcgtgctccagcctgctcagcagcgagtggttggaaattagcaaagtgagagggtgcgtggcctgagggactcggggaggctgagggctttttttctcaacactgtgaagctcagggaaaggagtagaactgggaaccaagtaaagtaaaatcgtggcaagtgggcatagacctgaaatctccttcgtgagggaacccagaacgtgcagctcaatgtatgtttggaacgaacaggtgaaaggaagcaggaggaggagggagttctagcgaagacttcggagggaagcaacccatcccctgccacaagaaagcaccgccactccagtgggaacggacacgcgtgcacacagccacgagtgaggtttgaaagaggccccaccctccattacacctgtgctccaccgtggcccccagccaagtttaatctcccattcagcacttacttctggaagcttctttccctttccttcccaccactcattggcctttcaccccctagttttttgtctgtgtgtgggactgtcttccyccactccccttgactgaagttccttgagagcagcagccctctttttatcagggaagagatttgaagctcaggacattcttatccaagtaggtgctagccacctgggtagtcaagacagggccctgcacagttaatgtgaatcttgtcataatgccagggttattgttttgcaaggagccggtcatagaacactagattgcattgtcactgggaaataagctcattctattagcttgtttctcagctagcttatgtagaaatttgccacagttgttactgctgggcacctgccctggatctgatcatcaattatatcatctcttccatctgatggactgcacctcaccccttgctttttcagagctggcgaagctgggccaaggaaagcgatagtgccagctgagtggaatgtgcaggaagggaccgaggaggggcactatgtactggagaaaagagatggggtctccaggacaggggtaaggacactagactgagggcacaaaggaaggaaaccacaaggaagtagagtagggaagtggggagcatgctgaggagagaggtc

SEQ ID NO: 10659 - DNA, 13553 bp, Homo sapiens
  misc_feature (1)...(13553): n = A,T,C or G, or insertion/deletion polymorphism (see Tables 1-2)
tgagattacaggcctgatgagccactgcgcctggtctatttatttttatttatttatttatttatttattttgagacggagtctcgctctgtcgcccaggctggagggcagtggcacgatcttggctcactgcaacctccacctccctggttcaaggaatttccctgcctcagcctccctagtagctgggattacaggtgtgcaccaccatgcccagttaatttttttgttttgttttgttgtttttgagacggagtttcgctcttgttgcccaggctggagtgcaatggcacgatctcggctcactgcaacttccgcctcccgggttcaagcgattctccagcctcagcctctcaagtagctgggattgcaggcatgtgccaccacgcccagctaattttgtatttttagtagagacggggtttctccatgttggttatgctggtctcccaactcccgacctgaggtgatccacccgccccggccttcacagtgctgggattataggcatgaaccactgcgcctggcaatctttttgtatttttaatagagatggggtttcaccatgttggccagactggtctcgaactcctgacctaacgcgatccacctgcctcagcctctcaaagttttgggattatagacgtgagccactgcgcccagcctatttatttgtttttaagagatgaagtctcactttgtcaccctggctggagtgcagtagtagcgtgatcatagctcactgctaccttgaatcctggactccagtgatcctcccacctcagcctctcaagtaggtgggaatgcaggcacatgtaccactgtaaactgctaagtttttgtatgtttttgtggagatggggtttttgacttttttgatacagagtctcactctgttgcccaggctggagtgagtgtagtattgcgatctcgactcatcacaacctccacctcctgggttcaagtgtttcttctgcctcagcctcccaagtagctgggactataggtgcacgccactgcgcccggctaattttagtaattttagtagagatgaggtttcgccatgttggccaggctggtctcgaactcctgacctctggtgatccacccacctaagcctcccaaagtgctgggattacaggcacgagccaccacgctgtctggagatggggtttagccatgttgcataggctgttcttgagctcctaggcccaagctgtctacttgccttagcctctcaaaagtgctggaattacaagtatgagtcaccacgcccagcctcttttggttattttcaaaagtcacttttttttatttgagacggagtcttgctctgtcgcccaggagtgcagtggcgcgatctcagctcatggcaagctctgcctcccgggttcacaccattctcctgcctcagcctcctgaatagctgggactacaggtgcccaccactacacccggctaattttttttgtatttttagtagagacggggtttcactgtgttagccaggatggtctcgatctcctgacctcatgatccgcccaccttggcctcccaaagtgctgggattacaggcatgagccaccgctcccggccaaaagtcactcttcagccatttgaaataccagtaaaccccatagggtagaagttatgctgagagttgatgaacaagttagaaaaagagcatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaattttttttttttttaatagatggggtttcaccctgttggccaggctggtcttgaactccttacctcaagtgatctgcccacttttgcctcccaaagtgcagggattacaggtgtgagccactgtgcctggcctctgttagactctttatttttattttttgagacacagttttgcttttgtcacccaggctggaatgcagtgatgctatcttggctgcaacctcagcctccaaggtttaagtgattctcctgcctcagcctcccaagttgctgggattacaggcatgtgccaccacgcctggctaatttttgtatttttagtagagacgggttttctccatgttggtcaggctggtctcaaactcctgaccttaggtgatctgcccgccttggcctcccaaagtgctgggattacaggtgtgagccaccacgcccgggcctgttagactcttgattgccttccccagctattactttggtacatgtgaggccaaagataaattagtggcaactgaaagataaggaaatcttgaaggctgggagtccagatagaaagccctaatgccttccctctcctccactcccaatgcctttttaaaagtgatgatggatgtggcatcttggcctctcagaaaccagctggcctaatggcagggcttcctcactggaggagaagcattgagatcttcaacctaagttctcttactcaggtttctctgtctgaatgtcaagggtaggctttatttccttcagggcatttagtcctggattggtagcttgagtaattttgctcttgattgactccttaaccttccagggctcctctgacctcttccctctacttcccagtgaataccatgtttattagagattttatgtttggtagggggtagttaccatatgtcagtttaaaaatttcataagtttagcagtttgttgttttttttttttgtttttttttttttgagaaggagcctcactgtgtcgccaggctggagtgctgtggcacgatcttggctcaactgcaacctccgcctcccagatttaagcgattcccctgcctcagcctcctgagtagctggggttacaggcgcccactaccacacccaggtgattttttgtattttagtaaagaggggtttcaccatgttggccaggatggtcttgatctcctaaactcgtgatccgcccagctcagcctcccaaagtgctgggattacaggtgtgagccaccacacccagccaagtttaacagcttttgaaagtcttttttttttttaggctgggtacagtggctcatgcctgtatcccagcactttgggaggccgaggtgggcagatcacttggtcaggagttcgagaccagcctggccaaaatggtgaaaccccatctctactaaaaaattacttgggcgtggtggtgggcacctgtagtcccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcrtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttayagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcycagctgtgcctagggcgcccctcctaccccggctgcttggcagttgcagtgctgctgtctcgggggggttttcatctatgagggtgtttcctctaaacctacgagggaggaacmcctgatcttacagaaaataccayctcgagatgggtgctggtcctgttgatcccagtytytgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgtgatccacccgcctcggcctcccaaagtgctgggattacaggtatgagccaccgcacccggcctggcgatactttttctaacctcattgtcatagtggtgggaacttaatcctccttcccttatcctagccaagtctgaactttctgtccttttgtctgcagcgtgtaggatccactctttcctttgtgggaagtctggctcctggcctgcatttctgccttcaccagaacatgcaaagggccatctcaagacccagttacaacaaagtccttacttcaaaaaagacacaaggcaatggttgactgcctaactcaaatgatagacttctgactacttgctgcacgctgaaatgactgtcacaaaataacatgagcccccactcacatttggagtcatggcctctccaattgttaggtccacacaatcccattttacacggaagctcatgcaatgttataaattctgttatctggctagatctttccatgttgctaccaagtgcctgtatctgctgtgacgatgatcttacaagtttctgcctcatatattcaagagtgagaaaactataatttaactggcccttwtgactatgccctgcccaacacttaacgtgcaattaattgcacattcaggcccaggataagggcttgtctttgaagccagctgctgcttctcgggcaccactcaggtccagcctctccatctgttgaccctgctgccaataatctttaattttttttttttttttttttttttttgagacagtcttgctctgttgcgcaggctggagtgcagtggtgtaatctcggctcactgcaagctccgcctwccgggttcacgccattctgcctcagcctcrcgagtagctgggactacaggcgcccgccaccacgcccggctaatttttttctattttttagtagacggggyttcaccgsgttagccaggatggtctcgatctcctgacctcgtgatwcacccgccttggcctrccaaagtgctgggattacaggcttgagcagcaataatctttcaagacagatttggagccatttcctaacgcagtgcaggggactgcagggcctgggtgtagcttccgcttgtgcaaacaggtacccagagacatggtagtgctgttcacccgctgactgtggaccagaggttctggagtcccagcatttgtgttcaaattcgtgactcaaggtccttcttagtctgaaccaactctcaaggacttttcctcttgccctaagcagtgatctttgctgctgctttccccctttgtctgcccttaggtcactaaggattgtagggccttctggacctgctctggctccatcctgagaactcctgaacaggcccacctccctctggttctctctgccccagcctttgagtcccccttggggtgacccaggtagaactatcagcttcccctttggacctcactctacttgtgttgttccttggaactctcaggagtctcactcttgcccaggctggggtgcagtggcatgatctcagctcactgcagcctccacctcccaagtttaagcgattctcctgcctcagcctccccagtggctgggattacaggtgcctaccaccatgcctggctactttttaatatttttagtagagatgggatttcgccatgttggccaggctggtctcaaactcctgacctcaggtgatctgcccgcctaggcctcccaaagtgctgggattacaggcgtgagccactgcgccctgccagaatggaatgttattatattaatagatcaatatttgtgatgaatatcannnnnnnnnnnnnnnnnnnnatgccgggccctgtgggccctgagatggctagcccctgtacccctcctagactgttaacttctggggaagaagattagtcattcataaatgcaatcaaggctcctgagtggccattcatggacgctcacgcctataatcccagcattttataatcccaagtaatccgaggagggcagatcacttgaggcaaggagttggagaccagcctgaccgacatggtgaaacccccgtctctactaaaaatacaaaaattagccaggtgtggtgtcgggcgcctgtaatcccaactactctggaggctgaggcagggagaattgcctgaacctgggaggcggaggttgcagtgagccgagattgcgctattacactttagcctgggcaacagagcgagacactttctcaaaaaaaaaaaaaaaaaaaaatccactcaaatggtaccaaggctttttgacatttgtagacttcaaatctgactcctggaatggagaatagcaacctgtaaatctgggtggacccagattgcctgtgacccctaatgtcctacatgtctcttccccaaaagcactttgctccctcattcattcataatccagtcctgtgccgtgtgctctgccaggtgcctgaagaagtcagaaggacagtatataattatcaaaaaagcatgttttgtgctttgagaataggaaaaaaagacaagaaaaaaattgtgcaccttacactagttaaaaaaaaagaataggccgggtgcggtggctcacgcctgtaatcccagcactttgggaggccgaggtgggcggatcacgaggtcaggagatcgagaccatcctggctaacaaggtgaaaccccgtctctactaaaaaaatacaaaaaattagccgggcgtggtggcgggcacctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaagaataaagaagaggaccaggcccagtagggaggctcatgcatgcctcctggaaaaagtgacagtgaggctgggtgcggtggctcacacctgtgatcccagtactttgggaggccaaggtgggcagatggcttgatggcttgaggtcaggagtttgagatgagcctgcccaacacggcgaaaccacgtctctattaaaaatatgataattagctgggcgtagtggcgggcacctgtaatcccagctactcaagagtctgaagcaggagaatcacttgaacccaggaggtggaggttgcagtgagccgagatggtatcactgcactccagcctgggcaacagagcaagactccatctcaaaaagaaaaagtggctgggcgcggtggctcacacctgtaatcccagcactttgggaggccaaggtgggcggatgacaaggtcaggagatcgagaccatcctggctaacacggtgaaaccctatctccactaaaaatacaaaaaattagctgggcgtggtggcgagcacctgtagtcccagctactcgggaggctgaggcaggagaatggcgtgaacctggggggcggagcttgcagtgagccgagattgcaccactgcactctagcctgggtgacagagcgagactccctctcagagaaaaaaaaaaaattgagactgaaaagaagtcaagaagcagttggttaaagaataagctgatggcgggtgagcaggcagggagtatagtgtgtgagatcctgagatgggaaggtggcattcttgactaagtcagcaacaggaggagcaggttttgggggtaggtggatgtgttcagattcagctatactgcattagacatccagacagaggtatctggggcaggcagttacaagaggcgcagaagaagagaatgttgaaaggcaatggtctagccacgggagcagtagccactggagaggatgaggtcacgtggggaaagtggcaagaaaaagattaggggacctgggcctgaggcctatagattcacaatccttccagatgagatggcagagagaaatagctggggaggaacaaggttggagcaaggagccaagggaagggacagttcctaaagaatagttagctggaacccatgcttctggactgcctgcagtctcggggcagctggaaccaaagctagaaagccatgtgtctaggaggtaccaggtcctattctaggagatgaatatacagtgcccaggagtcacccaggtacttgtgaaaatatatgttccacaacccacctccagagacaccaaagtggaaagtctagggacctagggtcctactcagtgttctaccagctggacctgtgagaagagacatcccacttcaactctcccctttcctgtacagggtcaatgtggcctaggccacactctctggttaggctacaggataggaacccagaactttccaataaactccaacttctctccaggatgcctggtgattgacccctccttgccccatgccacccccaccatctcagtttatgccttggactacgagtgaagggaactttttttggtttcccctgaaattactcagcttcagtaaagggaacttctgaactcccagtatgcctgatcctggctggagaacatttctcctcagactttaagctgtatgcctcctctctcaactagaagtcatttctttctttttttttttttgacagggagtctcgctctattgcccaggctggaatgcagtggtgcaatttcagctcactccaacctgtctcccgggttcaagcaattctcctgcctcagcctcctgagtacccgagactaatttttttgtatttttagtagaggcagggtttcaccatgttggccaggctggtcttggactcctgacttcaaatgatccacccacctgggcctcccaaagtgctgggattacaggcgtgagccaccatgcccggccagtcctttctaactctctcttctccaggaagtttcagagtaaagccagttaagacttcactgtcttcccccaacacacacagacacactctcacacatacacattcttttcattcaaccatgcaactgctgctgctctgactggtacccaccccaccccattgtgaatcagcagctcaaataaacaagtaaaagagtagaaatcacattcagcctatgtgaagtcctggctttaaaagcagaaatggctgcagagcattgcttgcacagaaaacacatacagcatttaggccactgacctaggttcagaaacttccatttcagcagttcttacagaagggctgcttttggggttttttttcaaacattaaatctgataaaattaggtcaggcatttcttgcacaattagcagttgatcaaatgacttccttattctgactcaacgtagtcctaaaaacaacatttaaaacaagtttattttcaggctcagtgcagtggctcacacctataatccaagcactttgggaggctaaggtgggcagattgtttgagctcaggagtttgagaacagcctgggcaacatggcgaaacactgtttctacaaaaaaatactggccaggcaaggtggctcatgcttgtaatcccagcactttgggaggaaaaggcgggtggatcatgaggtcaggagtccagccaatatggtgaaaccccgtctctactaaaaatacgaaaataagctgggcatggtggtgtgcacctatagtcccagctgctccagaggctgaggcaggagaatcgcttaaacctgggaggtggaggttgcagtgagctgagattgggccactgcactccagcctgggtgacagagcaag

SEQ ID NO: 10660 - DNA, 47875 bp, Homo sapiens
  misc_feature (1)...(47875): n = A,T,C or G, or insertion/deletion polymorphism (see Tables 1-2)
ctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcacgctggctgcctcgaatgtctttgcatcaggtggggactgggtagaaatttgatgtcgaggttgcagcagagcagggggttggcatggggccgggggccgggggggcctctgccactgttccctggatggaacagaaagcctaagggggaaacagattccttgggaccagagcccgtttcacccacaagacgcagggtgtgtttgggtggttcaggtccagccctttgtctgtattgggttagaacttcgtttctcaaagttcacggtgctcatgactcactggggcgcttgctaaatgcaggtgcgggtttagtggtccggggtggggcccaggtatagatttcttacctgctcctgctcggctagtgccctggcccggggccacactttgagttgcagggagggagtagaagacccttgaagccccctgtgaatgagggcagccacttgcggagtcctgcctgtgtgagagatgtaccagcgggtgcacgttcatactacagcctggaaagatacagcttgctggcctccccttcctccctgaggggtctgagaggattagctgcccaagactgccaagctggcgactgggggaccaggctagtctgaccatgcccacctccctccccaacaatgcagacagctagggcaggcaggggtggaagatcccagtgggacagcactgaaatgcaggggccactagaagtctttgctgagggctttcctgagagggcgcaaaatacctggccagacccagtgcagcccaggaaccccaggccagcatagcttccgggcagtgaggcctagggagtggctggaaggcccaggtggtggggcctgccccctctacacagcaggtggcgctgttcagccagtcagtcccgccttggccgcagagtctggcctcggcactgacccagccaagctgaccggacctttcccttcccctgaccctgcccccatctcggcccccagtgtccagtggctctatttggtgaggggctggggagagtgatagaagaatgcccccagccttagagcctgtcttcacccacagccactgaacagaagcagaaacgggccaaacaagggtgaagacctgcccaaggtcgcatgggaggtggggacagactggggaccagaatcagggcctctcagcctaggactctggcctccaccacacctgatggctttcagaggttctttgccctcagtggtctcaatggtctgcaaattatcctgtccagtgagcacagcacaggcagaagaaactgaaggccagggaggctctgtggcttgcccggggctgcagccagggtgtggcattggggagggtcttgagagggcagtgctgggaagggctagagaggcactctgcctcacgctccactcaatacctgcagcagccccctcctgtcccggtgcccctgcagtcaggaaggggtctaccctgcaggaccccacactcaggtgtgcccttgggccctagtccggggaagctggaccaccagcctcactggcttgctggattgacactcaccccactttgagccctcctcttcctctgcgaaatggcctgatgccagtgctgtgtgggtccacaggaggccaggagagtcccacggtggggaggacagggctgtaccttctcctgggctggcctctacgcccattacccattaaccctcaggtgccagcatccctctccccagtgctgccttcggtctaccacctcctcctggccctgctcccactcaagggacagtgatgggtgctgagagctgattggaactggagagggcaccatttactgatcactgacctggcactttacctccactgtaaggcagggatactgagtgtgctttatagatgaggcctctgaggacagagggcaggccttggggactaggtggagctggctacaggggacagccatgtctgctgggctagggctgaaatctcagcccctcactcactgtggctcggtagagaagccaggggcacagatgaggactcatctccattgatgggcccccctaggtccttgtatgcaagtcccctgggctactttcaccggcccagccaccttcctgccccagcctctgccccagcgctgcttgggacccaacttcattatggagttggcagatggcagcctcaactcttggctgagcccttgagtctgggacatttcagccacctctttcctccagtccagagatgaaaatccctggggacagttgctcctttgctcagtgacctagtgtaacaggggagatggcagggcctgagctcccttagccaggtcagctgctacagggttaacaggaggctccattccaccccttccaacttcaaggctaccctagagattgaataatctatactcttaattgattataatgcaatggagttggggcgttagggacaaagtacgagtcttcccttctacctccagcccttgctgaccaggacagggacaatgtgtagctcaacggatggtggtgagaacttagatgatggtcagttatgcagtatgtgggatacggaggaaagatccgtgggtatgtggaggcttgtagagaagctggttctgtggctggtcccaggcgactcgtaatgtaaatccgtttctcagaatcgcgtggtgtaggcgggtgtctactttgtccgcaggcaggcctgaccccgggtggaggaggggcagggtggagaataacaattgtcttaagggagtctgcggagggagaaaaacctctggggtgtatcagctggaaaagaataggagtctcagtgtggcccctctcccccctctcagcccagcccctgcgggggcggtgagggagctgcggtcagcacacacagctggggcctccagcaaaatcccattctatatatctaagagcaacagctctgagagcggcccccagagggacaaaacctcattgtgaggcacccgccggcctcagcaccccctcccccaaccccagaactgtcgtggcattgacccttttcggcgggccaccatgggcctgctgactgggccacatctggggctcaggcattggctgcccctcccccacggctggccactgagaactgacagggaggctggggtgggagcggcttccaggcctctcaccccatccccacggggtggcctggcttgtgccccaccctccctggggatgctgcaaggcagaggtgagagtccgaagctggctacgttggcatcttgatctgccagcagtcccccacacctctggcctctgtttagtggcttgtcaaacagtggttgggtggggtaggtttttccagcttttacgtgctgccttgaagggtcccgagaggcttcaagttgagccactctgaagcgggatgattctctaggtctgggattccagaattatccgctcccaaggtttcagaggtccaggattctgtagatttttgtttgtttgtttgtttgtgtttggagacagggttttgctctgtcgcccaggctggagtgcagtggtgcaaacatggctcactgcagcctcactgcagcctcaacctcctgggctcaagcgattctccttcctcagcctccccagtagctgggatcacaggcatgtgccaccgtgcctagttaattttttaattttttgtagagacagggtcttgccatgttgcccaggctggtctcgaactcctggcctcaagcaatcctcctgcctcaacctcccaaagtgctgggattacaggtgtgagccactggagcctgactggattcggtagtttgaagatgccaccatacattcattcaacacatttattgagcacctactgtgtgccaggtcatgttcttggtgttgaagctatagcagtgaccgatacagaaaaatatcttgccctcgtagggcttccattctagagcaagaaggataataacagaaactaaataggaatcttttacatggtgagcaagaaaggcctaggtagggagaactgctttaggtaggctggttggggacatgacatttgagctgagaccaactgctacaaagaagtagccatgtggagacaagcattgtaaacagatggaatagcatgtgccaaggccctgtggcaggtgtaggccttgcatgtttgagcaatggcaaggaggtcttggtggctgttattcagtgagcaatggagagaggggaagagctgaggccagtggtagaggcggggcctgagaaaccagagcaagacattcagatattgttttgagtgcaaagggaaacttagttttgcaaaggaatgacatgatcggatgtatgtttcagaaagggtgatttgggagaactgaaggggatatcagtgagacgagaggctgtgcaagttgggcaggacagagatgtggaggcagtcagtcataagggtgaaggcaggggcacaaggacaaccgctttatcctggacttatatcgagttagaacctccaggtttcattataccagacagggccacggcaaaggagagttcggattcccggggcagccaggatttggctctgaactttaatgaccttgaaactcttaggcagggcggggagcggtggctcatgcctgtaatcccagcagtttgggaggccaacgtgggctgatcacctaaggtcaggagttcgagaccagcctggccaacatgaggaaaccccgtctctactaaaaatacaagttagcccagcgtggtggcgcctgtaatcccagttactggggaggctgaggcaggagaatcgcttgaaccgaggaggcagatgttgcagtgagctgagatcgcgccattgcactccagcctgggcgacagagccgaactccatctcaaaaaaaaaaggagcttttagacctgcattgtccaataccacagccacacgtaactgtttaattacaattaaacaaaatgaaaaaatcagttcctcagtctcaataggcacatttccagtgctcacttgtggccagtgactaccatactgaacaacacagggaacatttccatcatcacagccacaggacagggcttcctggcagtccttaatgcattgagcctcagtttccccatctgtaaaatgcaggtaacaacagcatctccttgataaggtgcctgtgaggagtacatgagataatgcctgtgtggcctggcacataacacacgttccctaaatgcaggttgttattgttgctgagcggggtgtgtgggtggctaacgagagggatgggggctgtctctgaggtttggattcggaatcgtgacatcttgtcccgtgcaagacgaaggcgaggacggcgagggcacacccttccagtcccgaccccacagaggccaagcggcccttcgcccccaccccgacccgggaaggccccgcgcccctcaagcctgggacggtctcgcgtcccccgacccgggacggccccgcgccccgcaagcctaggactgcccagcgctgagcgccgcctgcaggagtcgggagcgtggtgcccgcggccgggctgggcgcggcgcgggccggcagggggcgctgggcgcggcgggcggggcgcgtggggcgggcaggggccgggccagggacgcgcggggggcaagcgcggcggcggaccgggcgggaccgtagccggagcccagccgggactgtcgcgcgggccgcgccggcgatgccgcgcccccgggccgggctgtagcggggccgcggctggagtgtgcgccgggcaggcgggacatggaggtggtggacgagacggaggcgctgcagcgcttcttcgaaggtgagagaccgcgggctggcggcggcgaccctctggcgctgggaacccccggctgatctccccgggaactggggctcctcgctgtgtttccgcctcctctggctgggaccctccttcaggctggcaccagcccgccaagacaggctcccggggctgggagtcccccagcggttaccacccaccgccgctgaagttgggctccccctccccgctcctcaactcgcagcttccttgggactgtgtccccttccaggtccggactcctttgagccttccaggacccggaactttccctaaattgtgacactctcgcccccagcaaacttcccgagtctggggaccctctactttgcttccccagaaccccaagcgggatacaaccccattcaaggcccagacccccggygtgccttctaggaccttccgtacctcttgaggctggaccccagcctgcttcccagaatctgtgacccccgcctagagaccaagaccccctgtgtgcccttctggttggcgccatcccccatgacttctaggagctgggacctccccactgtgcttccatgagggtaggaccactttcgagcctggatccccttggagactgccacctgctttccacaatgctgcctagtgactgctctcctgtttggggctgggacccccctccctagcatgctctcctggggctggaaccttcttgaagctgacatccctgccaccggtcacctctgctctctgagacccttctagtgctgtgaactgcatcccaccagccctctgaggctcctcagcactatgtccccccaaccctggagctgtgcctctctgacctcgccccctcaaagagtgacctcacccccacttgaccgaaaggagccctctggggtggaattgacatacaccccataatatcttcttctgcccccacccctacattggttttggaggtctgctcctccatctaaccaactccctgtcttttcctggacgacccctgcccctcctgcagggccaccactcctcctggtgctgggttctggagggatgggaccncagtgggagggggaggggaagttctggctgactgcctcccagcccactccgcttctcagaacctccctggaacatctagccagaccctctggcccccttttgtgcccctgtctaccaatgcagcgagmccagcccctgccccgagctccctctagtccctaaggccacatcctgctccttggtgcattgagaaccttcccttcatgtgtgaacctatcagggctacagggcagggaaccaaggcccaagtttcaagccccagattcctgtggagtcctgtggaggagagaagcaggtcttccngtgcctcagtttctctccctctgtgacttgggaggcaggaacccttgttcacacctgctggctgagcagcccaggcaggggcacccctaagcctcagtcatcccactccaggattctggacaccccacagacccagaacccaagagttcaggcttggactagattgaatggttgactctgcatcaggtgggccatctgagggtcttaggcagccctgcatctgtcccggggctctggctctccccagacactgttgatccataggagctctcgaggggcctgacgcggtttgagaccttcagggaagaggggaccagacattcgtgcttgcttgggttactgtctggagtgccttgagcctgctaggtacccagaggacccgcaggccaggctcccttgacctccacactgcctgccccaggacgctgggccctgacagagagcagaggggtgggcctggctggcctggactccctggctccctcctgaccatgggttggggggtgggggctgacgccacggcttagccatgcagcggcctggcggggggaggctgcgctactccctccagagagataagaggagactcaagaatgtctgtggggagcaggggaggggtgtgaggctgcccgtctaggagggctgggctggaaacagctcccagcccctgcgatgggggaaggtgtgggtggcccctgaggcctagggtctccaggccacttgggaggggaaggcccatgtgggggacccactgtaggtgtgagagaaggcctgggagtggcagggcctggtgtgcttgtgagtgtgtgaagtgcgagggagcgggaagttgtgcttttgagccgtggctgcgtcactcttgagtgctgtcacactcggggctggggctggggacacctgagctctcatcctggtccccacttggccttggtcatccctctggacagtgggtagcagtccctgtgctctcggctctgggctgggagactgggaaagggttttaccgaaggggctgcagcacagcgcgccccctcacctgacgtggtccccctccctgggcacacaccaagcataggtgctgggtcctgccctgtgccggtggtgggctgggggctaaggcgctttggacctcaggtgggaggccgggacagagcggccccctcgaggctggtacagccgggcccccgtgaccgcccggctaatcccctagagagaggcaaggcagcccagatcggcgggcacagggcctgcagagaggggacccaccgggcaggatgcactggcttccagcaggtaaccgggccatggtataagggggctttggactccagagccagkgcaggcacgggacagggcagtgtctgagaatcctgccaggacctcagagttctggtgcaggctggaccactgagagtggggtgaccgtctgtgcctggcagggaacccccaaagagctcttgccctctttaagtcctttttcctcacctgcaagacaggagggggtggcagagaagaacctcagctctgaagaagctcactgcccagccctgggaaggagagacatgttagagtatgaatggccgagcctggaaggggtgcctgctggccctagattctaggggcacatgaggctcgagtgagcaaccagtgtcccccagaaagcaggtgggtgtgcagggagccttggaggatggagggaagtcgccttccagcaggtgctggaaagaccacttggagtttagtgggcctctgcccggcctctggagccccaccagggctggaggagggaggcctgggatttcgccccttctgaagctgatgggtgyctggactggtgacttccttctctggcctcattcccctcccagggtaagtaagtgggttggaccagagcaggggcttccaatgtgattttttaaccatcaaacaaactcatagtctcctgataggacagatacagtggataatgggggctgggctcctcacagcccctgaagcaccaggatactggtttgaaagccacccttcccggctgtgggatgggtaaggggaggggaatggcgctggctgaggctcagagagaagggagttggccagagttagccagagtggayacctagcccccagctccctactctgccaccagtaccttggggttgagggggctacctgtcagggaccaacatctctgcctccagagggcaggaggaggtcccaggtagagactacctgatgatttggaagagaggactcccacctggacaggaatccgggggctgagctgggcttcgtgatgggggtggcactgtggcccgtgtcagcctgtctctgtctgtccctggtgcacccagggagtaagtagatgggaggggtggccaggcacagggtttcctgagcccaggcaggggaggaaatggtagtagggggtctgactcatccccatgtccccagcacccagtgcagggcaggggtggggggtgggcaggaagtgctctccnggtcaatggtgacaacaatgggtatgtgaacagaggcggcgggggtgggggacgcaccccagaaagcacctctctggagggcctggggtcagtgcaggggtgagaaacaggcagttaccaaccctttggcctcagggactctcctgagactggaaggctggacagagtgctccttggggtcttaagtagagccaaggagggcatttgagggcagaatggccttttccctgggggcctgactccccamttaccaactcccaaggggttacagactggagggccctggcagcagaggctgctgggtaacagcccagcagagctgctcattggctgccacccttggactttgccctccctgataaggaactgggagcagaaattattaactgaatcattaactgggtggccccgccctacccaggcagcctgccttaccttcccaccttcctcttcacggacctagcaccttcctgggcctcagtttctctcattgccttgggtgctggagtatgtggggcctcctctcctatctccaggccttcagccccggctgccacggggtgtgggtacctcttggttgggtctcggggtaggatgatgtaatggttctgtgcattcgccagcgagggcagctggggtctgttcctagctctcctgcttacccacagtgcttctcttggccgtatcagggcaccgctgtgcctccgctttctcatctgtaaaacgggagtgcagttgtaatggcagggcctccgtcccagggtttctggggtgattaggtaagattgtgcctggcctggtgaacactccattggtccatggcaggtgttctgcgccctaccttgaagattactngtccccagggtaggtcagtgcccctaagcttagggggcttgttgancatgttctgtggttctgtgtgcaaggcctgaaccatgacagctctggcccagcgtggcctggtcctggtccctggcacatccagtggggcccgccccacctccccctctgagatttgggttctgttcttgctgccagcaaggaggaggggcttggctgtattgtgacttcatctgctgcacccaggctctttgcacgttgtcttcctggagtcctggggtgcagtggaagcgtgggtgacggcctcccatttctgagggggactgtgaggcaggacaggaaggcgatgatgtgtcaggctccctcaaggtggccacaacagagctgggactggagcctgggtcccagctctgtgccagcctgggatgggcagggaaggggcctctcctcctgacatgctgaggggtggctccagcacgggtggccacgccaggtgatgtccgtgcagcctccttgacctctctagacctcagagccctcactcacatggtcaaggttgggtgatgttagcagttagatcccacgagtgccaaggcctggagtgagggggggaggggcaaagcccctgggtggggagtacagttgggtccggagccccctgccggcctagagtatggagggggctcccggacattctgtcctccctgtgccccaggtcgcatcagtgagggaagttctccctccagctgaccggggtccgtgcagccyccrgagtgcacaaccacagcctctgtctctcctttgtggagtttgaggatcctatctccctccggcctccctcactcccctctcttctccctcnatggctggggcaaggggatccccatcccctgccctgctagcttggaggagggaagttgtgcctgtgacactgagttcactcagtggggcctggctccagccggagctgcttagggagggtctgacagcaggcggggagggggcttggagggaagaagaggaggtgggagctcttcctgggtggccactaacctaacccatgcatgtgacgctgtgcctgtgggcctgggcctgtcgtcgggtcagtgagngtttgtgtacatgcgtgtcctggcatatacacctgtgaagtgtgctgaggtgtgaacatgcacaggcatgctcgtacctcagggcttttgcaccggctgtccccgccatctggaaccttctagaatgctaggcattttgctgctctcgtcatctgactctgctccctagaatgtcagctccatgtgggcaaggcttttgtcccttttgctcactgctgtagccccaaagctgggcactatgcttgcctggcacataacaggtgctcagtaaataactgctgaatgaatgaaggcacacggatgaacgctkgtgtgcgcatgtgtgtgggtatatgtgtggggcatgccactgtgtgtcagtactgtgtatgtgtgagtagggggcaggtggtacgtgatcatgcgcatgtcagtggatacctgactgcagggtgtgcccttacatatatgtgtgtgtgttggcagtgtgcctgcgtggggccacrccggtgtgtaggcacagatgggcacaggtgaccctggtggagacctgtgtccaccccaagctgcagggtctctacctggcacctggtggcctgcctgccctggtccctgtgggagagagtaggaacaggtcgcagctgctggcctcggtgctgttggacctggctttggagcatcttggggctgtgagttcagccttatgttgacctgaggacagggcggcagcttcatggggacttggagtggatgtagccatagcccaagggtggctaaagattctgggtctcctagaagagagggttctccggctgggccagtggctcatgcctgtaatcccagcactttgggaggccgaggcaggtggatcacctgaggtcaggagttcgagaccagcctggccaacatagtgaaatcccgtctctacaaaaaatacaacaattagccaggcgtggtggcaggcgcctgtagtcccagctccttgggaggctgaggtgggagaatcacttgaactcaggaggcggaagttgcagtgagccaagattgtgccactgcactccagcctgggcaayagagtgaaactttgtctcaaaaagaaaggtaaaaaaaaaagagaggggtctctgtaggcagcctgtgggggctcttctgcatttttggtaagaagctgggagagaacaaagactactgtgactcagatcgaagaacctgataraaaaacggctcaagagccccatctttgtcaggtgtggctgctgggcccaagctaactgagatttgatgcggagaggcaaagggttgcttgcacaagcaaacatctgacctgaaggcattttgactaagacggctctggtcacaagttgaagcctgaagcagggcagctagcagttatagattttttttttttgagacagagtctcactctgtcgcccaggctggagtgtggtggcacgatctcggctcactgcaacctccgcctcccggtttcaagtgattctcctgcctcagcctcctgagtagctgggattacaggcacgtgccaccatgcctggctaatttttgtatttttaggagagacagcgtttcaccatgttgatcaagctggtctcgaactcctgaccttgtgatctgcccacctcggcctcccaaagtgctgggattacaggtgtgagccaccgcgcctggccatagatcatattaataaagagagaaagcccaaaccaaaggaggtgaggccactgtgccttgcccccatgtaaactggttgggagatgagccacagcactgggggccctctgtgactggggcgatggggaggggctgccagggcaggcagggaggcagtcgcagaaggctgacccactggaagggatggctggggccgaggcccggaggctggactgtgctgtgcatgtgtaagaatagcagcagagtgctgaccatgcctcagagggacttaggagaaggtgaggatgtccctcggaggctctggagcacgtgtgcagcaaggcggaggggcctgggggagaggggacagcctgggcggaggngtgcaggcaggaaaggagatgggagtcctaagagagatggaaacagggcggttcaccctgactgcggaatggcctcctgggggtcacctcgtttaaggttcactccatggcagggattcgtgctccatctgatggagaaggaagccagggctcaggtcacttgctgagggtcatagccatcaagtgggaagtccacattagaaamcaggcctctttgactctggaggtctctctgggcatcgtggttatgcccaggtgggctgtcccttgactgctaccaccctggccctcagctgctgcctgaagctagggcatccttcaggttcagatgctctgagaggacactcagagcaactggggttgtcggaaataggcctgggccctggtgtcctctgcaccccaggttcagatccaccaagcctggccagcatcctcgggccccggcccaccctacccacagccacgtggctgacgggatttccgccatgtttggggcatgaattgacaagtgcctcattgacggggcaggggagggggtgggcagggcacaagcctcccactgtgccgtgtccccaccctcccccgttccccgggacaatggccgagactcagccaacggccacagctggtgggggggggggcacataagcacaaggaggggcggaagggaggggtcctgggtggagggaccacctgggcccctgcctgctctcatcctgcacctggcttgggtgccctccgttcctttcctggccagctggggtggccttaaggagacgaggagagaagagcggagcggaggggagggggctgccttcccatagtctggatcgcagcctgcctgggaaggggcagtgtctggttcctgttccaggcaggtaataaagggcctaattaatgaggagcagctgaggcacacagctcagcagggcaggggcaggacctggaggggccccaggtagccccggccctggccacagcatggcctggccgaggtccctcactggccacttggctcatccactccgtgaacatttcctgggtgcctgctgtgtgctgggatactatatcccagagagacagaacagggcagcgctcatagcccagtgcctgcccctgtaagctatgggcacatgcccatcctttctgagcctcagtttcctcakctataaaatgaagaaaaagaaaatcacctaccttgtaggttgggatgagaattcaatatgagccatgtaaagtgcatggcacagggctgggcacagagtggccactgggcgagtgagctgtgggtggtgggcgggtggtggacagacactcatcctgcccagcggggtgtgtgtaggcgggaaggtaaagaactgatgaggaattacaacgcccctgcccatcccttgctaaacagaatgggagagtcagagatggcctcttgggggaatttacatttaagacaaaacctaaagcctgaataggacctggctttctcaggcttagggaacagcatggaatggcatgtgtgaaggccttgatgtgggatggaggatggaaaggaggcaagggctgaccacggagaggaggggaggcaggggacctggggaaggagaaaaggctgtcgggggcaggcaggggaccatgtcaggccttggactgccagagggctccgggtgtctccccagcagtgggaagttgttgaagggtttgagaagggaaggacagagatgctggtttgtgagctcatggtgctgttttcgggttattgggccctgggcagcctcgggcagcctctggcgggcccggcttcccttctctcagagaggtcttgaggatcagaacgagccatatggcccatgttccgcttcctgcctggcaggtacccctgcttgggctccagtgatgttctggggctcttttgggagcagtggggaggggcgctcccgagagtgtgcccatgggaccctgcccctgtcctgggttcttgggggctctatcccagcttcggcaagcccccacccttgtcttgtccacctggaaagtctgttagaaatctccagtgtggttcacgggcgggctgggggccgagcggcgtgggaaagagacgacgcggcctccagggcttccaggagaaggtgtggggtcagcgttcctcaggaggccctccgagcccccaaccctcaaacttcttccccacccactggcctccccgcaacgctgccccatcagttccctcctcccncctccttcctccatcctccgtccgcccggaccctggcacgggagggtccctcctcccccaaagcacatctggttctcgttagggtctcccaggatgcctctgcctgaggccccctatcccgagggaggtgggcaggaggattaggggcgattaggagtgctcctggccaggagaggagggggctgggtctgttataaatagcaacaccatgactgcatcagcccatcattcaccgtagattccaagttcaggctcaaaaacttgcagcttcagcggccagggtgggggcgacgctccaggtggggtggggaaggcacagcaaccgccagtcacactctccctcgtggagtcagacccctgcacctggttggaatcctccttgccgtgttgccttgggtaagagacttgacctctctgaacaggggatggtgattatgttacctatctgaacatccccactgtttagagagggaaaatgcataaagcacttagaatcgtccctggcstggtaggcagtcagtgtgagctgcagtcactgtcaccaccactgtctttgtcatcatcgccatgatgagttgagaagcactgggagatactcactatgagccactgtcaagtcactgtctctgtcatggtcagcattctgggctgggaggattgagtaacacaccgcaggtgaagagcctgcaggatgccttgcgcataagaaacttctgtgattaggctgggcgtggtggctcacgcctgtaatcccagcactttgggaggctgaggcgggcagatcacctgaggtcaggagttcaagaccagcctggccaacatggtgaaactctgtctctactaaaaatacaaaaaattagccgtgtgtggtggcgggcgcctgtaatctcagctactcgggaggctgaggtgggagaatcgctggaacctgggaggtggaggttgcagtgaaccaagattgcaccactgcactccagcctgggagaccgagcaagactcagtctcaaaaaaaaaagaaataaagtaaagaaactcctgtgattattaatgtatttgattcacaaaatgcctggcacacagtaggcactcagtaaatgggacccgtggttacrgcagggtggggcttgagcagaggcagggtcctggaacccaggcacacagactggccacgcccagctcgagaagctgctcttgccccggccacaccgccctggacggccattggtggtgcgtggtgggtgtcccttgttcctagctgggcgagctgggggtgggggtcagcaggagggccctggcctgtcgcaggcagcgcgtgactcctaggagggcttagccgctcattaatcacctaagcggggctcagcattcttgaaatgccggctgaggccagggaggggcctgggcggggggctcccggggaccccagggctctggggctgggaagtgaggacggctgttccgaccgatgagcacccactaaagtggctggcacttcacacacctcatctcgtttcatactcaaaacagccccttgaagccatagctgtacatgtccccattgcacgaatgaggagactgaggcgcagagagtgcatgtgacctgcccaaggtcactcagcagggagtggctgagccaggatttgttcctggacctgtctgagctcaacaggagagggcagaccccagactcaggctccagaggcctgtgggaggggccntcctgcctcagtggggctggccagcccgggtcagccgtgtgggtggggctgtcctccattatcggggttgacgcatctcccacgtcagcccccttatcaccccgccctctggctccccctgcaaggtgaccctgggaggggaaaggccggyacctcccccgtcctccctcatgatgcccaagagccctggctgcctttcctctaggggcccctccccttggtggggccggggccagcgcagagggcccaggagagggcggcaggcagaggagtggagctctggcggccatcattccctgctgggaggccggggcaagcccttccttctctaggcttctgcctcctctggaaaaagggggctaagttcccccgcctgtgcccaacagggtgatgggcatatccaatgagggtgcagggagctctcctgattctgatccccactcccgcctgcggccagggcctgggtgcaggagactcccacagccctgtgggcccccaggatatatggtcccactcagccaggcctcgtgctcctgcgttcctggagctgggccatctggactgacccctggaggacacggcaggacagtgcctgttgggtccgagccatcccatcgagggcagtgggcacccacggggctctcgactcagtaagcacctcatttgtgcctcacagcaccccataagacagaggcacagtgaccccatttgacagattagtggaaaggacttgttccctgtcacacagctagaaagaggcatggcaggatcggcctctctgtacccagatccatgccctgggcccctctcctcctctgagactcaaggtggccttgtggtggggcgggggggcattatcagtgcttcctggaggggtgccaggcagtggagggtgagagccggcccccacatggatacctgggtgggaaggagcaggggcatctgttttggagggccagcctgggcagggatggagggctgggccctgaagcccagggtctgcagggagctgggcctcttccctagcccatctctcctgccctgcaggccacgacatcaacggtgccctggagccctccaacatagacaccagcatcctggaggagtacatcagcaaggaggatgcctccgacctgtgagtggccccctcgcccggcctgcacccgcccagccccagcccttcgcctcccttctgtcaccagggaggtctgagggccggacctggggtctgctgtggtcccacctctgaaagctgctcctcgtcccttcccagccactgactcctccgaaatctccatagttccctgcagggagggggcggctacttccctgctggggctggggtcctggctggagctgagccgccccccttccccgcagctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccagggtgagtaagggcagggagtagggggatacagcggcataggggcaggcagggagcagggctgtggccgtgacctgggaggtgctagacactggcctggcatgggwtgggctgggtgactggctgtgcgtgggcaggtgagggaagggaggatgagtccaggtcaaggggggactcctgggctttgttctgaggcagtgggcagccacaaagcttcyaagcatgggagtgatgagggctgacgtaagtgctagaaaaatctcgatgctgtgtggagagtggacaggaagcggcgggactggaggctgtgactgtttacnttcatgggaacacctgcatacccgtgcacgcgcgccaagcccacccacttacgcatccagctgacgtgtactgtggccacaggagctggcccatggctcagatgtggcacctcagttcccccctacccaagcaagcctcatggggcccagaacccaggcccttccccccatctttctgaggagtccacaccaagggcctgacccagggctgaaccttaggcctggctttgaccaaaggttccaggcagccacccggccagccagactccagggcagctcccggggcacatgctcacagcgggaggctgggagcatgggtctgcaggggagctcagggcaaatgtakgggcccctgtctctgggtggaagagcattaaaacactaggtgcatgaactctgtgttcagacagcctggctccaacttcagcttccccatttatcagccgtctgcctcggtaacccatggcctcagtttcttctgtgaagtgagccctcaaatgcttacccctcaagattatcgtgggaagcaacaagggcacagaggatgccctgggtgcatggtggccatggacacatggccggccgtgcttcctgagctccctggcttttggggagaagggagtggaggccaggcttggggtgccaggggtgaacctttgctgcagaaggcaaactgtttgcttgaggctgtgaggctgttcctaaactacaggcccctgggggcagagggaggagaactaacatttggtaagcgcctgctggtgcccactgctgtatcatgtgcctatgattgcgtgagctcatcagccttcctgggtatccagctcctgggagaccccacaaggagccctggccactgctnccgtcaggattttaatggcacactgaggctcagagagggaaaggggcttgtccagagccacacagggactctgtgggcagggccactccaggaagggacccagggccagacctgagtctaggtgataaacaagacagacatgaggctgggtgtggtggcacacacctgtaatcccagcactttggaaggccaaggtaggcatattgcttgagcccaggagttcaagaccagtctgcaacatgatgaaaccccatctctacaaaaaatacaaaamttagctgggtgtggtggcgtgtgcctatagtcccagctactcgagaggctgaggtgagagaatagtttgagccagggaggtcgaggctacagtgagctgtgatcatgccactgctagggacagagtaagaccctgtctcaaaaaaaaaaaaaaaaaaaaaaggccaggtgcggtggctcatgcctgtaatcccagcactttggcaggctgaagtgggcagatcacttgaggcctggagtttgagaccggcctgggcaatatggtgaaaccctgtctgtactaaaaatacaaaaattagttgggtgtggtggcgcatgcctgtaatcccagctacttgggaggctgaggcacaagaatcgtttgaacctgggaggtggaggttacagtgagtggtgattgtgccactggactccagcctgggtgacagagcgagactctgtctcaaaaaaaaaaaaaaaagaaagaaaagaaaaaaaacagacacacggctctgcagtggctcctgaagcctaactggggagaggtattcaccagtacatctccaagtagaggaataatcaggtgccagaggaacttaagaggagagaacacaaggtgctgtggacttggggcatgggactgcagggactgcagggtgtgaaagaccttaacacattacagaaggcctggccattgtcagggaagtacaggacggagtggcagcccagggggcctgaggctgtggcgaggagtatgggtttgagtccccatacacgtttttgtatcattcacacaaaacctgcagggtctgtgttcttgaatcgttgtataggtttctacatgaggccccgaaggtgggtgggtggctggcacagggatgcagggggactctggagccagccccagggctgtgtccacaacagggccatggcctctctggcagttccctgggcatgggaatggggagttgctccagatgtggggaccagggatggccaaagagctggatcccatatggccacagccttccacttgctgggtgagcacagggttcacgcaggacgtgttgacctcttgggttgagtttgttctttttcctgaacactgataaaagtgaaacctgcaagaaaaaaataaacccaggcccggtggtgctggctcccttcccagtccacacctgcctctggtggggcagccccccatgacctgctgaatgccctgaggcccagccccctagggccctgtgtttccaggaagctgtggggcttcagtgggtgcaggaagagagaagaagtcctggccttyggtctggggcgggagtctttgagtccctgtgccatcatcaaggacactagtaactgccccccaagtgccctgtaggtctgaggggatcctgggcggtcccctacccacaattcggccccaggccctgccaggcaccccaatgtgggtggtgcngagaaatgcccctaagggtggatgtgacgaaacctcagtgtcgccagcttctggggggctgtgggaccctaccacgcagagaagctgcccagctggaaggcagaagctcagctgctcaccccccggccccttcccctggctctcgcagcacactgccggactctcccccagactcgggctccgaggcctactccccccagcaggtgaatggtgagtccagcgggcaccgccctcctgctccagggtttgggcaagtagttggggcggccttatcagggaggtaggggaggagggagggggccagcggctgcccaacgggctgagattatcgctggtcaaatactccctggcgcttggctattgtttccccacgggcgggtggggagcctggccctgcctctgagcaagtatccccgcggtgatgccacccgcctgcccgcctgcgccatcatggacgcacccttcggcggtaagtgggtggctggggaaggccgtgggtgcagcctgggtgcaggcttcccaggccgggcccacctcaccttagagggtgctcakgggtgccctggcccccaggtggccaagagcagaaccaccgcgggagcaggctccccgcagtccggattggggtcaagagttctgtttatcttaccaaaaacatccctggaatgcctcctggggaacaaagggagctggggcctccccgctcaggctggggggctggcccctgagagcccagaagagggactgcctgccggagaggggaacactgggcaggcctgggctgggggtctccggagacgccttcctgaggcccagaggaggagcaggcctcagaggagatggggacggagggggacctttagatttgggttggattctcctggtccagcctgggggcaggaggtggrtaggatgaggtgaaaggctgcccctccttgggcaggtktgtgcctccctgcccaggcctctagtaggtggctgaccaacggccctcccacctagggtaggtggggggcagcccccgggcttggctcaggacggggtggaagcaggagactctgccttggggaggacagtgcccaggagcctgagtgaggttggtctcagatgcccgctcccccatctctcctgcagagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagtaagacgtgggtggctggctccatggggtgggaaggtggggtacagggaccagggtgggcagggcggcgggcaggccagagagggaggtagggaccgggatgcacccagggagggcagaaggctctgcagggcagatgggggtaacatatttatacatgtttacccagcaataccttgaggggtttacagccatggctaattgctcacaactaccttatctggtgggcacaggtaggtaaactgaggctctgatgggggaaatgtcccgtccagatcatgagccaggggcagagccaggactgggcccggggctgtgctcttacccagaccccagtgattttgcagctgtctcatggaaccctcaggtttctgaggagtcttcttcctagacccaagcccccsactctgactcaacctgcacgattgtcttttcatctgttttacatgtggagattccatgaaaggtttagttcaaaggaaggttctgctgtcaaaacattttgtaaaccagaaggggaaggagtgccgtgcggaagctccccttccctggtttttgtggcccaggccctctgtggcttgtttctgatcacagggcctgctctccatngagcccccactataaagggtgaccttgagtgtgacactgcaggcagggacaaactcattcattcctcaagcgattgctgtgattctgtaagccagccctgttgctgggcatgatggagacaccaagtcaggtgtggctcctgtccacagtctgggggaagcgaagagtgacagaagcagaaaatgacagcacagagcaatggggagtaggaggaggcaaagcctgagggcttcctgaaggaggtgtcctctgggcggggcacatcctggcccaaacaggctagagaggggagagaggtggatactacccagtgggaggggctcggggagagccagcccccacggcgcacacttctgtttccccaggctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggtacatggctggccaactcttcaaggtggggtgtgggacccaaggtgcagggcccacatgggcgttccctccctccaggcctcctgcaggacagtgacagcctcagtggctcctacctggaccccaactaccagtccatcaagtggcagcctcatcagcagaacaagtgggcgancctgtacgatgctaactacaaggagctgtgagtgccctacaacactccccactcctccaggcccccccaccttgggacgccccagcccaggaccccatcaaggtcctggagcagggcctgggagcactcatttcacagaagagcaaacaggctcagggaagagccaggactggcagtcagggctcctgactcctakgccagccccaggcctccctgagaaggtgatgactgccagggaggggcagctgggaaccaagtcagggagaagtgggcagatgggtgttttttcccccrgttcctccttccccacctcctccctctgcattccaggaaggtagccggaagctgagcccaagctgggccctcccggcagccccctccctagagggagggaggaggggctggggaggatccggtcagaggctgcctgagcattcctagcaccccctcaacacccagatggctccatctttccaggccgcaggccgggagccctgtggggaccactcccctggctcacccagaaggccagtgggcaggtgacagggtaactgtggatattgccaggcctgggccagtggattagaccagctgcatggagttgggtgctccaggctttgggggaattcttagccagcagtcccaggcctgggggcatctggctgctggggtggctgaagggtcccatgaagtcctgccaggtgggggtgcagtcgtatggcactccagcctctctggcatggggaggaaaccccttactcttactgccatactctttgggccacccttgccaccccaggccccaaggccaggaagcttggcagctgcagccccggaagtggcccaggcacttcctgggtgctttgmtaggtcaggcaggtgggtggagctccaggagggaagaggtggtgagcccaggcctttggcaacactggccaggcccagaggcctcttcccacaagtttggaagcattctccctgcccagcttccgccaggccagcactgggcactcctgtgaccactcttgtgcctggggacctgagtgagggtgcgctaagccacaggccaacagttgctctttttttttttttttttgagacagggtcttgctctgttgcccaggctggagtgcaatggcatgatctctgctcactgcaacctccgcctcctgggttcaagcaattctcctgcctcagcctcccaagtagctgggactacaggcggctgatttttgtatttttagtagaggcggggtttcaccatgttggccaggctggtctcaaactcttgacctcatgatctgcctgccttggcctcccaaagtgctgggattacaggcgtgagccaccgcacctggcccagttgctctttttactgtcaactagaggtgtctcaaaggggccaaacatgggacactaaacccagcaacagatgggcaaactgaggctgagtctgagggagagtccaggagtgccccttccctccccgggcagacggagggagtaggaatgaggagggagtgggaatgagggcatctgggggcttgagcaagccggtgggcaggggctgggtctgcagcagagcaggcgcctggttccaccgtttccagggcaactagctgtcaggcgctgtgaggctctgcagacacagtccctctcgggtgagtgagggggcttcaggcagccttctgggaaggagccgagtgtggggagggcagtcaagccctcccccactcaggagttccctccagtctggtgggcctcagrgtctggccctgcttcccccatcaccagggcggggcggtggcctaaggcatggggtataggagagaatgttgtctgaggagtttgcagccctgtactagaatcctctccgggactcagtttccatttctcaggagtgggggcagccrcattggtggtttgargatgcaggggtgtggtgtgggaaatggttttggaacccagcaggtaggaggaaccgatgttccaggcccggctctggggcctcaggggagtgccctcacccgcccccccaggcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaaggcaagtttggggctcagcaaggaagggagggcaggagggccctttgggggcactgaaagaccccagaaaaagcaagcgttggctggatgctgtggctcacgcctgtaatcccagcactttgggagtcaggcagatcacttgaggtcaggagttcaagaccagcctggccaacatggtgaaaccctatctatactaaaaatacaaaaattagccaggcgtggtagtacgggcctgtaatctcagctacttgggaggctgaggcaggcaggaaaatcctttgaacccgggaggcggaggttgtagggggctgagatcacgccactgcactccagcctggcaacagagcgggacttcatctcaaaaaaaaaaaagaaaaaaaaaaaagcaagcatctgtgtgcgtgtgtgtgtgtatgtgtgtgtaaactcccccactgctactgccaccccgccctcccgccttttatccctgtgcctgcccctcagcctgcctccccctcgccctgcgcctgcctccctcttgttgggctcatcaacctgcctccctgcctccctttcgccctgtgcctgccccttaaacgttagactcctcagcctgcttccctctcgttgggcaccttaccctgactctgtgcctccttgcctccctgcctccctctcgccccgtttcctgctccagcctgtgattcccaagtctgcaaccccagtcaaracccatctcctgggccctctaccaggtgcctcagctccaggtcccaaactaaactccctgcacacttgcctcccaccctgggctcccctctcagggaatggggcgcagggccttggttacmtgagccgcaaatctgggtcagggccctctttccccaacctcatcatgcatctggccttgctattgccctggaagatccctctacctggtccggtcctcgcctctttcctgtccatcccctggtctgggttacctcccttccttgtcggaatgtccacagcagctgggacccccaactcctgccccacttgagactcagggggccacagcactccctatccttccaaggcccccagtgtcctcccagcaaagccccggcttccaagctgcaccacgggggccttgggggccctgccctccgctccagctctgccacttgtggtaccatcgcagcccccgccctccaccctgtggctccctttgccttggatgcccttcccaacacccatccctcctctccaggcagactccatgctggtcccctccccaggggcccctcccctaagacccattgggaggcaccacagcacaaccccagtagtggctgattttgagtctatgagctccctgtgggcatggctgggtctgtcggcttcggtgtgatgagtgagccaggcatggtaccttggcatggctctgccagtgcacgtggaggagtagaggagacgtgggtatggagaggatctggggagtgagtgggcctaggtgcaagtggatgggcttggaggctgctgtgaggtgtgtgggtatggacatgagggagggtggggctgtgagtgtgtgtgtgtgtctgtgtgtgagtgcatacatgcagaggtggggggagcgtgtgggtgtggaatgggggtgtgggtgtttggggagtgactgcatgcgtagctgtgcagaagttgggggagtggtatgctgtgaggggtgaggagggtgtgggtgtgaagtagggtgtgggggggtgtgaccatgcagaaggcatctgagcttgtgggaatcgcggctgagggctgggtgctgccctgtttcctggtgagctctagttgggccaggcctggctgagagggggcaggagggcaggaccagccgggtagccccatccygaggtgccactggcttcactccccacagctggaggccctgaaccagtccattaacatcgagcagtcccagtcagaccggagcaagcggcccttcaacccggtcacgtgagtgtctgaccctgttgggggtggtacctagaagggtccacaactaaagctggcttgggaatggaggggccagggaggtacccagggtgtccgcctcatgtacgttgctggcctgggtgcccctcagtggcgtggctcttgcagcctccctccctgccccctgagcaccctgcctctcctctgcagggtcaatctgccccctgagcaggtcacgaaggtgactgtggggcggctgcacttcagcgagaccaccgctaacaacatgcgtaagaagggcaagcccaacccggaccagaggtgagcaggtgggggccctgccccggagcccctccatttctgaggcaggaagacacngccctgggtggcacaccaggcacagagtcctacaggctgagccatttcacagatgagagacctgagatttagagcccttcattgacttaaggatgggaagagcagaagcctggcttctgggttgagaaacagccctggcttcttgctgtgggccctggggaatttctgccccctggtggaggctcgggttcctcctctgtaggagggggtgagatgaacatgcatctggccagggaaagggtggccctgggggcgggggcaggccatgagtacttctgagacccctgtgtgtcccaggtacttcatgctggtggtggccctccaggctcatgcacagaaccagaactacacgctggccgcccagatctcagagcgcatcattgtgcgggtgagggccacctcctcccagggcgtagacagccctccccaggactgggagaaacagcaagcagaagtacccgggtactgagagtcaggagtgggcatgctcatcctgctaggcactggctgtgtggccttgggcaaagctcccaccctctctgggctgcagggtctccacagtaaagcagggaggtggacgaagcctggtagcttctgggatcccacaagtgacaaaaagttgtcacagtgggagggacagttcaagttgggcttggtgcagtgagaaaccctggctggaaggggaggggctgctgtggagtttccccctgctcccagggccctgcaggtcccctccctatcccccaggactgatccagccccaactcgcggtaggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggggacagggctgtgggggccgggcgggtccagacgctggagcgggccgcgggggcggggctcctggggagggggcgtgactacgcggaaaggcggagctgcgggggaaggaagggagggaggctggcctcgaatcccgatctaaccactccagtggtggggtctcctctccacactgcagcctccaggctgccgccctcctgggctccggggcctgctccgggacggccgcaggaggggttcattcccgggcctggctccccgcaggtggacaccaccgagcaattgaagaggatctcgcgcatgcggctggtgcactacagatacaagcccgagttcgccgccagcgcgggcatcgaggccaccgcgccagagacaggtagggaccgggctggtgcggactggggtccggaaacccagaaacctcgggcctcagtgaccttgccccctgtcacctggaaatcctactcctcttgactcccggaactgcgcccctgggaatcatgccttctagaagtcccgcccctcggaccttggaaaatcgcacctctccaggtccccggaacctcgccccattgtcagtggaaatctgagaatcacggcccagggaccctcgcccttcgcgctagatgaatcctacctttaacctgccagaatactacccacttgccctgggatccttacccccaggaatccgccccaccccagcccaggaacctcacacctgagccctggaattgcaatcctgtgaacactggttcgtgggatctccctgctccagggctccttggaatccaaatctctgggttccagaacttcaccctctccagtcttgctcccactgtacattacaaagctgtgagtagccctttaccacccccccacccatctttggcttgtcccctgcccccaggtgtcatcgctcaggaggtgaaggagatcttgcctgaggctgtgaaagacaccggagacatggtctttgccaatgggaaaaccatagagaacttcctggtggtgaacaaggtctgtgggtgsgggaawgggagggagcccagaggcaagtggggagccagctggggaacactcatcacctccatagatactgggggcactgcaaagcagaggcaggagcaccctcggctctcatgctgcctccagagcgccctctgcaccccacagggaaggggtgagtgttcaaggagatgagtgggtagggatttggcccctggagcctgtgtgatcaagggcaagagaaaccctgtggagggccatggccttccacccccggtaaaatgagggcggtaatagaactgcacagacatcctcgtatggttacctccaggctgaaatacgtggtttattgtgaggacgacgtttgtcacttacctgtcctgagtctgggcgccaaggaggcatgtaataggtctccaccccagctgaatagtgaagtgctgacatctgagacaccagtcatccgaggggcagatcccggggctgcagccttcaggcttaggagaggagagctctggcagggagtggggagggccattcaggcaggtgggacagcccaggtgaaggtgcagaggtggaggtgttgctcggagacaggcacaggagctgtgggagccgaggctggattggaggggcccgcccnggtagggagactttgagggcctcccagtggccaaggacagtggccgcccctcctgccccctgatgtctggcagcctggggctcccggggctgactgggccctctgtgttggcccatggcccatggcccatggcccatggcaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcrccttcaggtaggggtgcggggtgggggaaggtgagacccttcttcccagggacacccctgatcctggccctcttgctgcagccatgcagggagccagttcagtcgggcgggcagcgtcccccacaagaagaggccccccaaggtggccagcaaggtaggggtgagcagggatggcaggcnggttggaaagggggcctcccttgtggcctccctttctggcttgcagttctccagcctcactgcctctggtgcttccctctccttgtgactctgtagccctcccagccccgtttctctttcttctccctttgccccyggggaaatggggcacccccttaaccgctcctcngacctccagcagagcccactggggacagcctcagcctggccctctttgcatttgcacttttcctcttggtcctcagtcatcgtccgtggttccggaccaggcctgcatcagccagcgcttcctgcagggaaccatcattgccctggtggtggtcatggccttcaggtgacttgtcccctgggctctcatggtggctgactaggggagtggagctgcccrgtggagtcagctgcccatgggctcaggcctgggggaagaggaggatgtagcttgggagatcaggcagctgaggtctcggtgaggtgggcctttctgcctcttcccctctggggtgacccattttgtaggcatcacctgggagcccagcctcaggagcaaggaccacagccttgtcctagagagagggcactggatggtggctccagctctaacggtcacccttttctgtggctccagcgtggtgtccatgtccacactgtacgtgctgagcctgcgcacagaggaggacctggtagacactgatgggtaggttcctggaggccaagccaagctgccaggccaggtggggctttggtgggcagtcccaggtcagagagccatgagactgtcttctctaaaggagttcatccttagcctcttagcctgctggggtgctgtggggatccagggagggcctccttggagggtgggcagcctttcccagtccctgctgacgctgatgtttctgtctggcctgtttagtgcccctccaggtagctgggcctgcgagtcagggctgtctgaggggctggggttggaacatggggtaggaggaaggagggccagggcagggccttgggctctgtgagcccactgtcacccccagctcctggggccacctctgactgtgtcttctcttctcttcccctttgcctgtctcaccctttgcctttttgctgccccttagctcttttgccgtgtccacttcctgtctcctggccctgctccggccccagccccctggggggagtgaggccttgtgcccatggtacgtgctgaccagcgcccctctcctctggctcctgctgcccctcttcctgcctccctcccctccctctctgcctcttcctgccctcctgcctctccaggactgtcaggccctctcccctcaagctctcccagcccctctgagctcagcccatccttccccagcaggtccagccagagctttgggaccacgcagctccgacagtcccccttgaccacggggctaccaggcatacagccctctttgctgctgggtgcgtgtctgggcaggtctgggtaggacagggaggttgctrtgttctgtctttggggcttctctggctcatacagcctctggcctcctcagtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccrctcaggtaaggctttctgtgggctggggcttggggcgggggctacctgcgtagagagaaaggcccaaatactcattgntgggagggtctcctggagcctagaacgaggctctggacaatgactgggaagttcccctgagaggaccaagagacacatggggttcactcagtcttgtggggccctagagacagctggacaggaagcagccagcttccagcttcttagcctntgcctggttctatccacaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggcmagggcccacctcagcccagtcatgtgactgtctgggttcagacttgtcagtcaatagacgtttgctgagcacagaataaggatcaggaatcaggcctgcagccttacntagatcatcccatttagtcctcacagcactcctgcaagaaaggaattgttgttcctattgttcagctgaagaaatgggatggagactaaggtgaagtgacctgcccagggttatacagcccctccgaggcagggcttgtatttgatcccgagcctggctcctccttcgccatgccagcaccaggagggtgctatactgggtctcccctactatttcccaaaccttggatctttggttttaacaaagctacagaaccttttattgtagttttcaaactgggttcctctgaggtaccctgggggctgcgctgggggctgccctgggggttgaaggggaggctgggaggcttcctggcttcaaccaggcagctctgctctcaccaactttcatctgatggattttgtggcttcaagaaaaagaaagcctggaaaatgtggcttacagagatggaaattcaatgtgatgggggaaccccatgggggagatgtttgccaggcacctgtttactgagctgcctgccactctgtggctggctctgtacaggggactgggggtgatgaagatggacacgcccctgtccccaaagacctcacagagatgaaaacacagcagtgtgatgaggctctgaggggacatgcaggtagctttgggactggggaggacacttaatccggacgaaggtggggaggatcagggaaaacttctctggagttggtgacatttgagctgactctttaaaggacctttggaatttgcccagaagggatgtgggaagggcaccttccatctcgtctgtatctgatacctgtcctgaccacacagggtgtcctggatcctgttggggtccttgggtccctgggtcatgcctcagagctgaaaacgtaccaggtccagcaaatgttcagcggccccagcttcccccttcctgggtggatagtcaggcagcagcaagactgtatgtgaactagatgagcaagaagtcctgtctcccccatctgacttgtcacacttcagtcccacccctacccagccagccagcctgcagtcggtttgttcagggaggctgcgaggagcagcgtgctggtagcggtgtaatcatcggcctcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggaggcagacgtcaggctcatgggaactgggtagtcctagggctgctgaggaaagggtgtagtgtgatgctggccattgtggaggtctggaaaaaaataacctggaacttattcatactaaggtgtgagtgactgcttcaagtctggcaaggaaagacttgccagcttctcatttgtgtcctgccttgtcaccttactcctgccccaacagcctctctccttgcagagccagtgccctccctgacctccatccaggtgctggagaattcgatgtccatcacctcccagtactgtgctccaggggatgcctgcaggtgggctgggctccctcccctcacccagggaggtcctcaggtgacatgagcccaggtggtacagatcacccggaacttgccctttcagggaggagcctcccccataaggaagggtagcccctttccaggctacccttggacactgtctcttctggagggctccagtacagattgggggctgaggagtccctggtgggggtggggggtggcagggtaccctcaggctaaggtgccagttttgcccctgcaggcctgggaacttcacctaccacatccctgtcagyagtggcaccccactgcacctcagcctgactctgcagatgaagtgagtgccggtgtggggaagtgggaggcaggaggggagccagggagaatctcccgcagagcctcagaacagccgagtctgaggacagccggagagtctctggtatttcctgcatggtgggataagtgctgacttcattgcctacttcgtggttaactggctaaatgacctggcctcatgggctgaggaccacatgggatggtcgatgggaaaggttttgttcgagggccctggttattatgcggtgtttcaggctgggtggagattcagaggcgtgtggcaggctggctgggagggggctggggttgagggactctagaacctcatttctctgctaactgggcctgtctacagctcctcctcccccgtgtctgtggtgctgtgcagcctgaggtcaaaggaggaaccatgtgaggaggggagccttccacagagtctccacacccaccaggacacccaggtaggtgggactgggaagctgcgggccggccaggcccgagctgcttctctcctggcacaactgggccccmaaatgggcaaggagcagaagctgggagttatagagtaaagccttctccacaagggacactctggggcctgggcctctgtgtcccagggaggggcacgcgtgcccgtgtttgttcattgcactctgctgagcatctcccagccctgccgtgctggagacgtggggaagacagcagatcacaggtgctaatgtggatgagtgcaatgatggaaacaggcaggtgtctgggagcccatggcggggagggctgtggctcactggaggtgtctgcagaagcaggaaggagccgacctcatgctcaggttggggaagtggcacagctagatgtacagcatcagagggcccctcaggttccatgtttggccacctcttctgggagaactggatggtgagctcctccctggccaggtaaccggaagttatgactgtccctggggctgatggacccccagtttcttcttgagcctaagaggccatgggagaagacgctcaggacaaatgaagggaagtagtgattattttttcttgcccattcatgtgtttactcagaaaatattgattggggccccatctgtcccaggccctgtgctgggtgggcctagctgcaggggagagaggtggagtagacacaggttttgacttccaagaacgtactctatagtgagggagaaaagacgtgcagaaagcacctgcaacagaggtgggggtgcttctgagggaggcccgagccctgtcgccctgcagaagagacagngtccaagacagagggagagcccagctagacacacagcagacatggtgctcgggcctgaaaccacatcacagacgcacagccaaagcctcaggtagatgggcaagctgcctgcagccaggctgcatgccaccctgtgagggagacagccagacagacctgggtttgaatcccagctgtgtgattttgccacactgtgtgatttttaggaagtggctcagtttcctcatccagaagatggggctagtagcagcactgtgtcactggattgtactgaggatggggctaatgaaatactttgatgtgcccagagcatagtgggtgagggaacccagcacaacaggactgggaaggaggcagggsccasgtggaggtggctgtggacctgccagtcccgggcacggtctgcatggagtagctgccattgctccttctgccaaagcagaacatgctccttcctatctcttcaaagttctctgcttttttccttcataaaactccccacagaccccaggactgcgacggccgtggtgagagatgctggttgggataagggcagcagtctgtcctgacccctctctcccttctctccagggcacctctcaccggtggccaataaccatcctgtccttccrtgaattcacctaccacttccgggtggcactgctggtgagcaggggcatcccacctaccctggaggtctgggcacccctgtctgcgacgtggggcttgaggaatggggggtttgcacagtatgtggtagggctgggggcacagtgtcaagcaatgtcagcagggagtgccatctgccccgcacccccagagccacctcaccttcccactgcccttccacccagggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtncagcaggtcatcccwcccttcwtctctctcctttggcgtttgttcctgtagtcactgsgctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctgagcttgcctccttgtctcttcttgggattggtctggtgggagaggagtcacctataaggctagggccaattggaattcaaagttcttcctgagaagcctggaatctctgagcgcctgaaccagagggccaaatggatgcttcataccccttatcctcttagcttcatattggggctaggagtggactcatcagcctctcccatggccacaccttcccctcctgcgcacccgctgctgcccacctgcattaaaagtagccactgaggagaaaagccttcttagggggagaagctgagcctggtgaggatgccccagcacagagaatggtggctatgtttatggcagggactggcctagggcagaatggaccgatgtgggttcccagagaagtttgtcctagaaacaatagaaaagggtaggcccagaccctatccacaggtaagccttaaattccaatgacaaaacaccggtgctacacaaatctcatcccccttaagtagatcagcagcaggaactgtgaaaggcagatgagaaatgggaaagggaagagattggggaagcaatgtaggtcccagcacccaccacccctgcagaatgggccccagacaggactgctatacatctgcatttattatgagcagcaggtgggacacttccagcaacagtaaaaaaaagtaatttacaaaagcaggtttcagtgaagccatctggttgttacctaaaagaggagaggggtatcaaaataagaccaatggcccttctttcctccttctctccctgcacccctgtgctcctggggcaagggctattgagcacacacctctgaggatgagccaccagagctgattcctagtggcctgtttggtggattgtctgcagcaagttttaagccctggatcttgaccccctttcagccagctgacttcccagcagcctctccaagtcactggggtctgacttctaagaatgtaaatgtacagccatgggatgcctgcgtccacacttctaggtggtacatcccaaaggcagatcgaggccttgggccatgtgagctcagaactgagagtcacatttggctcaaatccgtatgaggggcagggaaagaggcacaaatgtctagtgtccctacccattccactgagtctgtctccatcaaccaaggggtcatgctggtaagagctttaaggaccctgctgacctgactctggggaggcttccctgggctgtgccttggaggctcacgcatccatcccattgcagctcttacccttgggtgctcacacgtagatgccaacccagagcagcaggaagaggactccaaagcccatgaagagtgaggccactaaggagatgaggagctctttatagatatcacgagtgtacttggtagaggtgacctcgtaactgggcacagcagttaaggcaaagcgaaggggtggactgtggagtgcagagagcccagcccacggcaatctgaggagaaaagcattggctcaatgccttctgggaggcctatctggctcagagcagccaggcagaggggcctaagagatgccttggactctggtgctccactgccatgaagaaaatgagacccagaggagttaggtcacttgccccaggtcacacagctcatgagggccggagctgggactagccctcagacctcctgacacctgagtgcacccttccttataccacctttccaactgtagcacccctattccccacctccactccagccaggtcccctgctcactgtcctggaaatccaaagaacaaactgagctcacctgaacttgggaaataaggctataacctgcccctgggcatcactagccctcctctcctccttaccttctctcagccccaatccaatgtacaaaaccggcggggtccatgtacctagcgtggtttctccctgagcttcccacatcactaatgctggtcctctggctgctcagtgaaaggatacacgaagaaccaggcggtgaagaacatgccaatggccaaaagcaccacggtcagatgggggaagacagctgggttcactgggctggtatatctgctcatggcctcgagctcctagaggagggaaagagatcagagctatcaaagaatcccacgatttcagcctggagagaacatgcggttatcaaggagcctggtgctgccgtgaaacagaggctgattttagcccggaaatgtagctgcagatcaatggcccttattagcattttctgaggccaataatctgaccactatgaaaacgtgactaaaggtacgaactctctgcctgagaaaaaccacatacaagaaaaagtttgcctacaatttccggagctttgtggaccagtgtctatagacaccaagctgagaacccccgctataagtcactgactggtggtacccagatctcaatatcttttttttttgacggagtctcattttttggacggcgtctcactctgtcgcccgggctggagggcagtggcacgatctcggctcactgcaacctctgcctcccgggttctagagattctcatacctcagcctctcgagtagctgggactataggattacaggtgcgcaccaccacatctaatttttgtatttttagtagagatggggttttgccatgctggccaggatggtcttgaattcctgacctcaggtgatctgcctgcctcggcctcccaaagtactgagattacaggtgtgagttgccgcgcccaggctcaatttttttttttttccagacagtcttgctctatcgcccaggctggagtgcctggagtgcagtggtgccaactcggctcactgcaagctccgccttctgggttcaagtgattatcctgcctcagcctcccgagcagctgggattacaggcgtgaaccaccatgcccggctaattttttgtatttttaggagagacagggtttcaccttgctggccaggctggtcttgaacttctgacctcctgatccgctcgcctcagcctcccaaagtgctgggattacaggagtgaaccaccgcgcctggccctcaatttctaattcagtattttcctcactacctatgctattatggaatcttgtgagctatggtcaagacattcaagttctggttctgagtaatctgagtctgagtaaagcgactgtaatatctatttcacagaactgaaaaataagaaagatgatgaatcaaagcatctagtgcctagcagggagtattttgctcaacaggtatttgcttccttcctaaggctgtagggaagatgatgagataatgtcttttatgaaagagggctgtaaacgtaaagatctgtacaaatgttaacttcattgtcaccggtcagccaatgcttctaaaatccagaacataacaactctagagaagtaaactgcccccattgttctgagacactggaattcaattcagtaaacaatcacggcccccttcccccaaaatgataaagacaatcactgccatttattgagcttccaattacgggccctctgtttggcactgagaatacaaagatgaatagacatcatcccagagctagatgcgcgtcagacggtggtcactaggaggcgtggccgaaaacaaagaagtccatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccaccgataacagagatatacaaactggaaggtattcaaaattcgccccacgcctctcgcccttagaaatcgcgagctgagaaacctaaggagttcatggcaaggggcttcccccttccccacccttcagcccaagccggaggttccaggagcgtctagccctctggatctccggcgtctgaggagataagcgcggtgtgggtcagaccccgaggggtcctcgcatctccgtctggaactcccctcaacgctctcaccattttgccccgcgaaggctaatccgccgctccgccaccggaagaacacgtcggcaggagcaggcgcctagcacaaccggaaaaggaagtgcctccggcgcaagtggcattgagggacttgtagtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcggtaataagttccaccttatggggtcgtgttgtatttttcctaagaccttggacgagaaacatttctgacacttgagttgtttaggcccctttcctgcctacctgtctgtgggacgccgtgaggggatcaagggctacatggtctggtcctcagtccacactccagcagcgcggccggcttgaggcaagagccgaagggttgaacaggcctggagaggggacattagaggtttctgtctgttgtctcagttaaccctggcagcagccctgagagacaggcatggtaatcgttcttcttctgtagacgagaaaataaacctcagtggcttggtaatgtcacacggatggtaaatgccgcgcctagattcaaggccagagcttttgccgctgcagttcacaggggaattattcatattaatcaaatgaataattcattgtcaattaattattaattgattaataatccagggatggacctggaaggacgcgtgagaggatggcgagaggagggcacagctaaggaaaagtgggaaaaggcgggccttattccagctttctgttgagatcccagaatgtagggttaggttgggaaccagaacatgaaagatcgtgatgccatgctgaagtgtttggactgaattagaaggaagaattgaacagtcattgatgctctagaaagaaccctgtgaagaaagagtgggaacaatgaaaaggcctgatggagtctttcgtttcttctttctcttttcttttgtcttcttttcttttcttgacagggtcttgctctgttgcccaggctggagtgtggtggcacaatcatagctcactgtagcctggaactcctgggctcatgtgatcctcccaccacggcctcccaaagtgctgggattactgcccagagcctctgtgcctggccccagtagaatatttcttggagtattggacacataccaacagtgggcacaagatgagttttttatttttttgagacggagtctcactctcttgctaggctggagtgcagcggcacaatctcggctcactgcattctctgcctcctgggttcaagcgattctcctgcctcagcctcccgagtagctgggattacaggtgcacaccaccacacccagctaattttttttttttttgtatttttagtagagacagggtttcaccgtgttggccaggatggcaagatgattttaaattgcaccccctaaaaatcctttttaatagttatacatttaatacatattaaaatataactaatagaacacaaatattattgcttatgagttttccagtttag

SEQ ID NO: 10661 - DNA, 37927 bp, Homo sapiens
aggtcaggcagttggctcatgcctgtaatcccggcactttggcaggccgaggtgggtggatcacttgagcccaggagttcaagaccagcctgggctacttggtgaaaccctgtctctaccaaaaaaaaaaaaaaaaaaattagccaggcgtggtggtgtgcgtctgtagtcccagctactaaggaggctatggtgggagaatcacttgaaccaggaggtggaggttgcagcgagccaagatcgtgccactgcactccaacctgggtgacagaacgagaccctgtctcagaaaaaaaaaaaaagagtggatatatgctccgtggagcctgaaacatatacaattgtggggctctaaaattatgtaataaattcaatatttatttagagtaaataaacttatgtaataaagaattaaatgatgtcataaagtcagtatttaaaatgagaagaatcattgtagattttgaaatactgacaaaaaccacagacatcacaaagtccagaaaaataatattaataactgcccagcaaccgctataagtcttcacccatcttgcattttttagttgcatactctttgcaactaaatgaccattttatagagatgttagaaagataaattagtcaaaaatagattttaaataattgatagtctctaaactttgtattatcagctttccaactccttgctataatgtcttgcacgggtgatgcttctcgctgaggaaaagccctggggagaattccagccctttgatctcccttggcttggtctccaaaggggcttctaagacagctccatctggtggtcactgccctcgtccctagcccaccgaccctagtccaccctcaactgacacttggcctgagagaatgacctccatgctggggtccaagtgtccgatgaagggctggtaatactttttttttccattctgatggaatgaggttcagagtaaatattaggttgtacaaataagggaggagaccacccctcatattgtcttacgcccaatttttgcctccaaagaaagaagaagtaaaaactaaaaggcaggaatgaagtccacaagcagacagcctggcaccacactctgggcctggtagttaaagatcaacccctgacctaatcggttatgttttctatagattacagacattgtatagaaaagcactgtgaaaatccctgtcctgttctgttctgatctaattaccaatgcatgcagaccccagtcacgtacccactgcttgctcaatcgatcacaaccctctcaagtggacccccttagagttgtgagcccttaaaagggaaaggaattgctcactaggggagctcggctcttgagacaggagtcttgccaatgctcctggctgaataaactgcttccttctttaactcggtgtctgaggggttttgtctgcagcttgtcctgctacatttcttggttacctgatcgggaagcaaggtgattggcagatggtcgagacagctccttaggcggcttaagcctgccctgtggaacatccctgtgggggacttcgaccagcccaagtgacgcagattctgagagcgctcctgggtaggcatttgcccaggcgggatgcctcgccagagcagtgtgtggcaggcccctgtggaggatcaatgcagtggctgaacaccaggaaagaactggtacttagagtgtggacatctgaaacttggtaagactagtctttggaacttgcctactccatttgagtggaagcgtggcctgatcaccgacggcatgcttttaatggcactttggtttggttttggttttggttttgacttggtttgaattgcttgacaagaccggtcttaggaactttcccactccatttgagtggaagcgtggcctgatcacccacgacgtgcctttatcggcactttggttttggttttgacttggtttgaattgcttgacaggactggtcttgggaacttgcctactccatttgggtggaagcgtggcctgatcacccacggtgtgcctgtaccggcactttggtttttgtttttgacttgatttggattgcttgatactttggttttggttttgacctggcttggatttcttgatactctgattttggttttgattttggtttggtgtaaactgcaaaagtgtgtgtgtgccctttttacctgttctttgttttgtggtgtgcgtgtggtgtgagcatggtgttttgtctcaaagaagcatgggtcaggcacaaagtaagcccaccccactaggaactatgttgaaaaatttcaagaaatttaagggagactatggagtactatgacaccaggaaaacttaaaactttgtggaagatagactggccagcattagaggtgggttggccatcagaaggaagcctggacaggtcccttgtttcaaaggtatggcacaaggtaacctataagccaaagcacccagaccagttcccatacatagacacttggttacagctggttttagatccccgacagtgattgatagaacggcagcataagtggctggcagaggcaaggaaagaccaggagagagagagagagagagagagagagagagagagagagagaggcagagagagagaaagagacagaggcaaaagaaaagtcaaagagaaaaagagacagaaaatcaaagaaagagagatatacaagtagttaaaagaaaagtgtaccctattcctttaaaagccaaggtaaatttaaaacctgtaattgataattgaaggtattctccgtaaccctataacactccaataccactttgttgacagtgtaaacaagggcgtatcttgaaagcactgaggccttcctatcaaaaatccttaacccagtaacccgtggatggcccaaatgcattcaatctgtagcggcaactgctttgctaacagaaaaaagtaaaaaaaaacttacaggaaacctcattctgagcacacctcaccagttcagaagcatcctaaggaataaaagggggggggggggcggaatttatgtaaaaagagtattatatggtaaatttttgtcctgaattaaattaactggttgtttaaagaaagaaatatttgtaataagtcagaaagttgaagcatgtcaaagaattgtctgcaaaagttgtgaaagagaaaaatgttattaaaaaaagaatttatgcaagaaattttgtataatttaaaagtaactaggcctcctgaatgtaaacaacaaacaaacaacagtttatgtgcaaggtgtataaggaaagtaaaatatacctgtggtaaaagaattataaggaggcatgagaatataaatttttacctacattaaaaggctaaaaatatgtatattttgttttaaaggtttaatcaagttttaaagtgttaattggaaagaaaattctgtgtgtaaacattggctaaagttaaagcagtatcatccagtttttctgtaaactggacattaaaataaaaccatagcaggtttttcttaaagcaccaacctgctctttagcaaaaattataaaaagttaaaaagagtctataaaatcttaccttgtggtctaacattaaaaattgcataaatatgtctacaaggttttgttaaaattaggtttaatattaataacacactaatataaaagtaaaatttagcttatctggtgtaaaaatcatagaaaaagcattgttaaatgtaaaatggtatttggctttctttggtttaaaaactaataaaaataggtgctaaagaaaatttctcagtaaaaaggcactaaggactaagtccactgccaaggtccccacatttaaaacaaaaggtcaatttcttaaaaattatatacttggtttatcttccactttcctttccctcaaaaactaaaagtcttttagcacatgtaccacccctagaatttccggtaaaccagcaccagcctgaagatcacgttctcatcaaagggtggaaagaagaaaaactcgagccagcctgggaaggaccctaccttgtgctgctaaccaccgagactgttgtttgtacagtggaaaggggatggactcaccacacccaagtcaagaaccccctccagagtcgtgggccatagtcccaggggaaaaccttaccaaactaaagctaagaaaaatttaactttttcatctattctattactcttccttctttcctcgctctattgctaaccgtctagttattaacattaccaagtcaattttgcctcaaactattgcatttaatgcttgccttgttataccctgtggggacttgccaagtcaaagacagctctttacttcagaaaagtacttctgtcccttctgactctcctcagattgggcattagtaaattaggaccatttaatctggggaaatttcgataaagattccagtgtcaaccaggagtcttgccccacaatgtagagcttttatgctgtagttggtccaacattctatggaccactaaagagcaaggatggactgccctaactggtttttgtaatttcctaaaatcatacattcattttactagaggatcatagaagttaaagacttaaaacaaactttagcagttaagacaggataccaagatgcaaatgcctggttaaaatgaatcaaatattccatctgcacattaaacaaaagcaattgttatgcttgtgcacatggcaggccagaggcccagattgtcccccttccactaaggtggtcctccagttgaccaggcataggtctgcatggtagctcttttccaggattctacagcctggagtaataagtcatgccaagctctctctgctatatcccgaagtccggcaccctgcgggtcagcccccaagggctatccagcttccgtctctcaacactaagttcacttcatgtctccctggcattccttggagacctgaaaggatgcaatgagcttaagaattttcaagagcttatccatcagtcagcccttgttcatccccgagtggatgtgtggtggtattgtggtggacctttactgagcactctgccgaataactggagtggcacttgtgctttggtccatttggctatccctttcaccctggcatttcatcaaccagagggagaaaaaaataagacatcgtaaagtgagagaagccccttattggtcttccgactctcacgtccatttagacacaattggagtcccacagggaataccagatcaatttaaagcttggaatcaaatagcggcaggatttgagtcaatattttggtaggtgacagttaataaaaatgtagattggataaactatattataaccaacagcaacaagcttttcatgagttaaaactcatgtcggccccagccctggggctacctgacctgacaaaaccctttacactctatgtatcagaaaaagaaaaaatggcagttggagttttaacccagactgtggggccatggccaaggccagtggcctatctctcaaaacaactggacggggtttccaaaggctggcccccatgtctaagggccctggcagcaatggccctgttagcacaagaagcagataaactaacccttaggcaaaacctgaatataaaggccccccatgctgtggtaactttgatgaataccagaggacatcattggctaacaaatgctagattaaccaagtaccaaagcttgctatgtgaaaatccccgcataaccattgaagtttacaacaccctaaaccttgccaccttgctcccagtatcagagagcccagttgaacataactgtgtagaggtattggactcagtttattctagtgggccgaacctccaagaccatccttgaacatcagtagactgtgagctgtacattgacaggagcagctttgccaacccctgcaaagtgactctgaaaaagacgacaagccctgctccagtcatatccggaagctgactaatccacacacggctgaagcatgagaaaactcatcacgggactcattttccttaaaatttggacttgtacagtaaggacttcaactgaccttcctcagactgaggactgttcccagtgtatacatcaagtcactgaggtaggacaaaaagttgctacagtcttattattttatggttattataggtgtaccgggactctaaaaagaacttgtttgtataatgctattctatacaaggtatgtagcccaggaaatgaccaacctgatgtgtgttatgacccatctgagcctcccatgaccacagtttttaaaataagattaaggactgaggactggtggggaggactcataaatgatacgagtaaagtgttagccaaaacaaaagaaaaaggggtgcccaaacaagtcaccttgaagtttgatgcctgtgctgtcattaatagcaataagttaggaaggggatgtggctcttttagttgggaaaaaggctatatgaccgaaaataagtacatttgtcatgaatgaggactgtgtgaaaatgaatgtggatactggtcttgtgtcatttaggccacttggataaaaaatgaaaaggatccagtccaccttcagaaaggaaaaaatggctcttcctgtactaagggacaatgtaaccccttagagctagtaataaccaatccccttgatcctcgctggaaaaaaaggggagcgtgtgaccttaggaatcgacagggctggactggatcgtcgagtaaatatcttagttcgaggagaagtctgtggaaaatttaaccttaccaattgctgcctgcacatagatgatcagaggcaagtagtcgaagatatagttaaagacatgacgaaactggcacatgtgcctgtacaagtgtgacacggatttgaccctgaagctatgtttaaaaatggttcccagtgctaggaggatttaaaactcttataataaaaattatagtagtaatagcctgcttactgatcccttatttactatctgtactcattcaaatggtaaaaggtttcatcactactctagttcaccagaatgcttcagcacaagtgtactacataaatcactatcgatctgtcatgcaggaagacataggtagtgaagatgaaggtgagaactcccactaataaaatgagtgagagtctcaaagtgggggaataagggaggagaccacccctcatattgtcttatgcccaatttctgcctccaaagaaagaagtagtaaaaactaaaaggcagaaatgaaatccacaagcagacagccaggcaccacaccctgggcctcgtagttaaagatcgacccctgacctaatcggttatgttatctatagattacagacattgtatagaaaagcactgtgaaaatccctgtcctgttctgatctaattaccggtgcatgcttgctcaatcgatcactaccctctcaagcggatccctttagagttgtgaggccttaaaagggacaggaattgctcactcagggagctcagctcttgagacaggagtcttggccgatgctcctggcggaataaaccgcttcctgctttaactcggtgtctgaggggttttgtctgcggcttgtcctgctacactacagcaaaaattaggttgtattatagaaaattaacttttttggtttttttgagacggggtctcgctctgtctcccaggctggagtgcagtggcaccatctcggctcactgcaaccttcacctccagggtcaagcaattctcctgcctcagcctcccgagtagttgggattacaggcacacgccaccacgcccagctaattttttaaatttttaatagagatggggttttaccatgttagccaggctggtctcaaactcctggcctcaagtgatctgcccacctcagcctcccaaagtgctgggattacagacgtaagccaccacgcccagccgaaaattaacttctattaattgcatacctgggtttgcctactgagaatcataccctggatatttgtattctttactgaaaagaactgttctatctttccagaaagtggtttcctaaattctggttttcctcctggaatcctgctatttccttctcgcatactctagagaaatcgaagtgttttcaaaggtgctctgaagcttacgctccactagtttcacagtaaatcgccccttgcgagggcgctttttttttttttttaatgtgttctctgaatcgctttccccctttaacactgcatgacaagactaaagccagaatcccaagactgcagcgctaccccttcacaagccgtcgggctgtcccgggcggggccggcccattttcactttctccactagaggcagcagcgcaccgtgaccctggcttactacggtaagaaagcggagaccttttgcttcgaggcggttggtggccagtagtcttgatcgacaagctcaggcctctgaactaagcagccgctgtttatgcacgtacagccaatggaaaggcaggagtgcggccaacggccaatgaggactggtcttaagcggaccacagggcggggtttccctcgagaggcgaacgccgggtaaaagatcgggagcggaagtgggcgagtcagagcacatccggtgttagaagcgctggtaggccttggagaggcgggttaggaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacagggtgtggagggaagctagggaactagtgctgcgcgtgcgcaacagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaaggtaaataaatggcaaatggacttttctagttacttattgatatttatttacagtttatcttttgtatgtgtggtttaagaattgaattctggaaagataccggaattgcataaacacatttcttatgacctgcgtatacacacttttttctgtaattattgtatttacactctttggtgttttcttattctttgtgtctaatatttttgttctggcctaaagaatatgttgacatttagattctctgccgccactttcctccagtagggacagaatagttgaacccttgagaaatacaatctgtacttttgatccatagtttgcttcttccgttatttatctggttgtggaaacatggtttagtaccttcctcctcttttttttttttttttttttgaggcagagtctcactgtcgcccaggctagagtgcagtggcgcagtcatggctcacttgaaccttgacctctcctggcttaggtgatccaccccagcctcctgagtagctaggaccacaggtggacgtcaccagctccagctaatttttgtattttttgtggagatggggtatcaccatgttgcccaggcttaccaactccagaactcaagcgatttatttatttattattattattatgttttttttttgagacagtctcactcccttacccaagctggagtgcagtggtgcaatctcggctcactgcaacctccgcctccctggtgcattcaattctcatgcctcagcctcctaagcagctgagatgacaggcgcgcaccaccatgcccagctaatttttgtatttttagtagagacgggcttttgccaagttgtccagcctggtctcgaactccacacctcaagcgattcgcccgccttgacctcccaaawtgctaggattacaggtgtaatcctttcctaaagaaaaagagtcatctctcctgaagaataagaaaaggtaaaattaatctagatacttagcattttcaagttattttccctgattatagatatagttcgcgctctttatacaaatgctgaaaatgcagaaaaatgtcataggaatcaatgtatgttttgggagggtttttttgttttaaagatttgttttcacctatggctgaaacttttgaaagcttatataaatgaaagcttatttttctactgtaggatggaatagtaaaaagagcactagactatagtggtcagaagaccccaaatctggttctggctctgctatttaactttctaatgttggtcaaatcaatactaatgtttgttttagtactttacgttgatttcacacagattttcttattggcattcagtagagcaggtattgatcatcatcgttatcttacagatgaggaagctgaaataaccttaggtaaaatgatttttcctaggttatatagtagaaagtggcagcacttgtgacaccaaatcctgtcctcttgccactattacattgcctttttgaacttaaaaaagatgtataaaatgggcctaatctttccctttccttgtgggttgatgtgtgaggattgaaggtgatacatatataaaagcaccttaaaagttataaattttatataaatatagtcaggrgtattagtatagaaggtactactgctggcctgacgagtttcattttatttcgtaaactgcccaagggtattaattttctctagagaaaccattgaatattctgatgctctaacttctgattttttttcctttactactttgacctggttgtagaatctggtagaaatgtcttctaccactctgttttgttcccccagagtttctaaccaaactgcatgcagcccttcgtagtttttatacacattttgttttccaaagatggtgttcgagaccaaggagagaaaggctgtctccttgacttaaaggttacctaagtgaccccttgaggtaggttccactctgagccagctggggaatgttgatttgaggttacagcactcttgatctgataatagggtctaaatttgctctagagactttgtagtgcttaaatcttggggatagctgagctgaaccagatgcaagctctgccctcagggtgagaagtttctgcacaattaactggaatccaaaacacgtgaaaaaggagcttcaccagtgagggtgaagtgggtatgctgtttgtcttaatttatgtgtgctccccatttgggctaaatatggtgttattagggagggattactggtttatactggaagaagattatgtatttaggattttggggccttcttaggattcagtatctgtcaaacgttatagagagggagatgaagtagtgtcaacgtttggtacaaaaaataatttactgaaggcagtaggcatttcatctccagttactggtttggttttgaggcagccccctggaggagatggattcagtattagctaatccagggatttgggtccaagttaagggagaggcggggacatctagggtgtccacctgggaagatcaaagcttggtcctagttgaatgaaacaattccttggatggttccgaaactgaactgacctacctcctgggagtggcagggaaagcatcaagcttttgcgcatttacttcatcaaatcctttaccatatcagattatcacttagtggctattaggctgtctcaaaatgtccatggccctgtgggacaagagagatagtataaatgtgctagaagaaaggtatgccatttaaacaaaagtacagacgggccccaatttatgatgattggacttaatgattttttactttataatgatgcaaaagtgctacctgtttgctagaaactgtacttcaggccaggcatggtggctcatgcctgtaatcccagcactttgggaggccgaggtgggcagatcacttgaggtcaggagtttgagaccagcctggccaacatggcaaaaccctgtatctacttaaaatacaaaaattagctgggcatggtggcacacacctgtaatcccagctacttgggaggctgaggcatgataatcacttgaacccaggaggcagaggttgcagtgagctgagatcgtgccactgcactccagcctgggcaacagagcgagactctgtctcaaaaaaaaaaacccagcacatttagaatttccatcttttcccagactagggatatctggtatgatattttcacatgagatatttaacactttattataaagtaggctttgcgttagatagttttgcccaacttcagactaatgtaagcgttctgggcacatttaaggtaaggtaggctaggcttaagctataatgtttggtaggttatatgtagtaagtgcataaattacgatactttcagtttacaatgggattattgggatgtaacttcattgtaaatcgagcatctatacttttaccagtaatgagatttttcaagtgcctttatgtttcagtttataattttcttttctctctttttttttttttcttttttgagacagagtctcactctgtcgcccaggctggagtgcagtggtgcaatctcggctcactgcaacctccgcctcctgggttcaagccattctcctgcctcagcctcccaagtagctgggattataggcgcccaccaccacgcctggctaattttttgtatttttagtagagatggggtttcattgtgttggctgggctggtctcgaactcctgacctcaagtgatccgcctgcctcagcctcccaaagtgctgggattacaggctaaaactagacttttaaaagagaataatctactgaagatattgtagtaatgagtacaccagtaataacaatgttagtacaccagtaataacaatggttaccatgtattgaactcattctatgtacaaagagctattttaagaactttatttgtattatctcacctaatctgcaaccttaggaaataaggattgttatgtactagtattttacacatggtaggtgaaactgaagtacagtgaggttaagtgccagcagcttgctgcatgtcccactgctaaggaaataactaggattcagaagtagcaggcagtcttaaccactatgcaggggacatggttatacagtgtatgaacattactcagtagtaaaaactaatgaatggaaagctttcttggccaaaaacacagaagaagaagaagaagaagaaaaaaaactactgacaaattactaacagttcttccccctcctttttttgtttttgtttttttgagacagagtctggctctgtcacccaggctggagtgcagtagcgcaatctcggctcactgcaaactctgcctcctgggttcaaacgattttccttccctagcctcctgagtagctgggattacaggcgcccaccaccacatctggctgatttttgtatttttttactagagactgggtgtcaccatgttggccaggttggtctcgatctcgtgacctcaggtgatccacccacttaggcatcccaaagtgctgggattacaggcatgagccaccgtgcccagccctttcccctcttttaaactatatgggatttttcttctaagtatcaatttggtcccttctagatatgtgggaacaaggttcaggatggttgaatttatacaacaggaagaaagaaccatgtaattgacaaactaatttttttgttttaattttataaaacggttttgctgtgttgcccaggctggggtgcagtgacacatttttgctctgttaccaggctggagtgaagcaacatgatgatggctcactgcagcctgaaattcctgggctcaagcaattctccttcctcagcctcccaagtagttgggacaacaggcgcacaccaccacacccagctaattttttaattgtttgcagagatgaggttttgctgtgttgcccaggttggtctggaactcctgggctcaagcgaccctcccaccttggcttcccaaagtgctgggctcacaggtgtgagacattgtgcatggcctttttccttttttgttttttggaagtgaacataaccttgagactttattgtcttcataataaaacataaactgatatttaattaaatgtgcgaacagtgtttctttgacttgctgttttaatgttgctgtacacactgaggcaaagtctgtcttggctccagcattgcatagaacgcatactaaatccacgatagttttgttttgcatagcttttggctacttcagcatgtttcatgttcactgtagctcctaggtgtgtgggaataggactgaagagaatggttgtgttttttttaatttttaaattttttttacacgtagtctcgcactgtcacccatggtggagggcaatggcgtgatctcagttcactgcaacctccgcttccctggctcaagcgattctcctgcctcagcctcctgagtagctgggactataggtgcccgccatcacgcccagctaatttttgtatttttagtagagacagggtttcaccatgttggccaggctggtctccaactcctgacctcatgatctgcttgcctttgcctcccaaagtgctgggattacaggcgtgagccaccgcacccagcctgttttttttttgttttgttttgttttgtttttaatttaaggctggacccttgataatagtctttcattttaggacaagggtaagggagatacctagaacaaaacaaggcatttaacatgacctagatgtccactgctaagaatgcctgtctcctcctaccagcccctgctgtccctgtcttcccaagcaaaagcagaccacaggaatatctaactcaaacaattgtgtttacttgagttttttcttgggagagctatgtattaagctcttagctttttgtttttgcatggctctggcagaggaggctggtcagggataccacagaatgatgacacttcagcaaaactttagcagtatgtgcatgacatgttgacagcttctgacaggttttcctctcctgggatgaaggcataacaggaggctctgaatgaaattagaggaatttggttatgattaacacctgaacatttacttttcagttacaaacgcagtataggcagattttccacaactccaggaggcactatccacattgtattctatgtaaataacccctcctctttattttagaattgaattagtaagtaataggcttagaggtgtgaaaggactgctgtattgaattttttagcagcttgtaatgtactttttttctttattgtggtaaactataacattttaatgtgtttttttaaaacaaagattttcatttaactgtgggctcctctggaatgttagcgagttacttggttaatggtactgaatataatacttcaagctcttaagagctgattgctcctagaatggaaaatacttgatatgagagctgctatttttgagttaagtgcaacttaatcttgtttggctgagtttgcatatcggccattgaaatgtaggtatcttttctgagcttcgctagttgaagctaagattgaaacttggtaagtttattttatctggcaaaacttgtcagaacagtttgatctcattacttatctgtatattcttgtctatttggaacagctctagagcaaactatcatatttctttgattctaagacctatgtattccctctcacattttaacatttctgaaattgtcatctgtacattgtgtcatatacattaaatgtatacagatgctcctcaagacggggctgcatctggaaaaccccatcataagttgaaaataccgtaagttgaaaatgtaagtccttttctttttgtaagtcatttttgtttttttttgaaacggagtctcgctgtgttgcccaagctggagtacagtggtgtgatctcggcttactgcaacctccacctcctggattcaagtgattctcctgcctcagcctcccaagtagctgggactacaggggcgtgcctctatgcccagataatttttgtattttttgtagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctggtaagtcagggaccatctgctttaccaggtttcttttttttctccataaagctaataaaattgctgtgcccttttgcgtctataatatttggtagttacatgttttgttttaaattttgaaatactgatattgaaaaacagaagttttagttattttttaatgatttcaaaccacaagcttctattaaatcaaagtgaaattgccgtttgacatctcatccccctgccccaacccacacagcctttgatggttttggtttttccatcaacagttgttaagagagaaccagaaagaggcagtcagtaccccctgggaaacgtcagagaagtatctgagaaaggggagtttctgccattctcccctcgaacagattccgccaagcagggtctggttacatgagcattgcctctttcttagaatcccctgggcgtttgaggatccaccccgctccatcccttacctttctttaattcttgtaattggaagcaagaggttctttagcattgctgttgtgaatactgagaaacttggctctgaaagttgcttcagtattattgtaagtgctgtctagggatgtcattaggggtgttaatgggaaaccttaaacaaagacactttccaggtgctgaattctgccatgctgtaagtgtgctctctagaggacatagtcatattcatcttggttatggaaggctgtggttggccttgtaacaacctgcaataattgcaccatctagatcaagagggcccagatccgtgtgactcagaggagagagcaacaaccttagtaggttctgcagcttctcactgtatctgtccttaagaacagaattaacaaaagttctgaggtgagtagtgatgttaatgagagaaggaaagaagaaaccagagaaagcaagccagccattgtgattgtttcatttgtgggagagagcctcaggaagcagatgatgtttatatctttccactggcccaggattccttaggaaatttgtttggggactgtaacttttattattacctagatgaattgttctgagtgttgggctgggtgctgattagagtgcttcattcagtaggtggcgtttcacacaactttatgtttgaatcccttcctccctgcccctccttttctggtagatttaaaatggatgggcattatggccctgataggagtttggaggatttatatttagaagagatgaaagttcttgactggatctttagtactgtagattgaacacgtttacttaggattgcatgtgaaataggggagggagcaaaacttaagaacttgactttatggtgttgatatgatctaacctggatatagttcagtttaaaaatgccctttttgacattgggacagttggcaaaaatctgaataaggtctgcagattagaaatagtattgcattagtattaatatcctgattttgatcattgctttcaggatatacacactgaagtgtttaggagcactgtgtctgtatggttagggaaaaaatatttttacatctgtctatatattgctatatagaaagaagatgaagcaaatgtgaaatattagcatttaggaaatctgggtgaaggttgtacaggaattctttgtactgttctaacctttctgtaggaaaggttctgaaactgtcaaaaaaataccccccaaaaaatcctcctttctgcataaattccttttttatggaggtaggaacctctctttttttaaaattgtgagtccttttcagttcagttcttaaatgtgttaggttaagaaaatttgatacgcatatatttaaaatgcaagtcttaatgccagacccagctttatagtttttgtttgttttgttaagactagtcaaagttttgttttttatctttgaggtgctgctagtgagataatttttttttttttttttttttttgagatggactcttgccctgttgcccaggctggagtgcagtggcgtgtcttggctcactgcagcctctgcctcccaggttcaagcaattcttctgtcttaggctcctgagtagctgggattacaggtgtgtgccaacacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcstctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataasctaacaaattaacttggccagaatccagaggacctratgaaaatgtccagattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcracgcagcagcacctgaagaaggtctatgcaagttttgccctttgtatgtttgtggcggctgcaggggcctatgtccatatggtcactcatttcattcaggtaagaacgattttctctcctggttgctgtggtacaaattacattaggaaaaaaccagctcagcaaggtggtccaagggaccctgytcctctctttaatctttatcagtagtttaggatttaaactcagacattaaatcaggacatgtaaagccattttaattttctggcaactgtgccccctctagataccgaaaaacagaatgccttaaccttggcactgaatggtgtgctgctgacgtacaagacccccacccactgagtaggcgcatggcatgcatgctgggattctttggcacagaagcttttttatcttttcctccattcttcctttacaaaactctgattgtgtgattaactatcaggagaggcaggattgagatctttttaaggaattgacctgttttattttccgataactgttgtctgcatggttgggtaaaaaccttcaacaatttgttttcctgtattgagagagaatctgggtttggtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggatagggctttgatcgcttgagttttaggcaaggttagcccttaaataatttagtaaaatacagtcaatccttgttattcacagactctatatttgtgaattcacctactcattaaaatttgtaaccccaaaatcaatactcatggcacttttttttttttttttgagacagagtctcgctctgttactcatggcactttttgcagacagtcacagagtggtgaaaaagttgagtcaccctgctgttgcagtgttttcagctgaggttgaacaagacagtgctctgccttcttgtttcagttctcgtattgtaaacaaatgttcttttcatggtcatttagtgccacttcctttgtatttttgtgcttttaattggtgattttgctgggttttttgagtggaggtcttgtggtgtcgtcctgactggtctcaaactcctgggctcaattgatcctcgcacctcagcctcccaagtagctgggaatacaagcacatgccaccatgcttggcttaattttgctgttcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatycgcccgtctcggcctcctaaaatgctaggattacaggcatgagccaccgtgcctggccctttttttcctttttttttgagacagtgtctcygtctgtcacccaggctagagagtgcagtggcgtgatcttggctcactgcaaactctgccttccgggttcaagcgattctcctgcctcagcctcccaaatagctgggattacaggcatgtgccaccatgccyggctaatttttgtatttttagtagagatggggttttaccatgttggccaggatggtgttgatctcttgacctagtgatccacccaccttagcctcccaaagtgttaggatgacaggcgtgagccatagtaccctgcctcctggcttttttttttttttttttttttaagatggagtctcaccctgtkgccaggctggagtgcagtggcgagatctcagctcattgcaatctctgcctcccaggttcaagcgattccccttcctcagcctcccaagtagctgggactacagcggctaattttttgtattttagtagagacggggtttcaccatgttggccaggatggtcttgatctcctgacctcgtgatctgctcgcctcagcctcccaaaatgctgggattacaggcatgagccaccacacccagcgcttttttttgtttttttgtttttttttttgagactgagtttcactcttgttgcccaggctggagtgcagtggcacgatcttggctcactgcagcctccacctcccaggttcaagcgattctcctgcctcagcctcccgaatagctgggattataggcatcaaccaccacgccagctaatcttttgtatttttagtagagatgggccactatgttggccaggctggtctcgaactcctgacctcgtgatccgcccacctcggcctcccaaagtgctgggattacaggcatgagccactgcccctggccctaattttgtattttagtagagacggggtttcaccatgttggtcagactggtctcgaactcctgacctcaggtaatctacctgcctcagcctcccaaagtgctgggattacagacgtgagccactgtgcctggccttcctggcctgctttctaatctcatataggttcattttgtttccccatccattaggggaaactctgtgagtagccactgtgactctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttraattagaacagcttgttctgagtgacagtctaatatacgtaggagaaattttagaaaggaagagatttagggattaaratttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttctaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcrtaatactgtgttctgggttttctgttttctaggagttggcctgggccctgccctggagttttgtattgctgtcaaccccaggtaactcttttggtagtgtcttatgtgcttttatctttatgaatataccttctaaatgtagacsgtatacctgtagcccttaatctaatggtctttttttctaacagcatccttcccactgctttcatgggcacrgcaatgatctttacctgyttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttctttctttccttttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaaaaaaaaaaaaaaaaaagtgtgggggccgggcacggtggctcacgcctgtaatcccagcactttgggaggtcggggcaggcggatcacgaggtcaggagatcgaaaccatcctggctaacacggtgaaaccctgtctctactaaaaatacaaaaaattagtcgggcgtggtggcgggcacctgtagtcccagctactcaggaggcggaggcaggagaatggtgtgaaccggggaggcggagcttgcagtgagcggagattgcaccactgcactccagcctggacgacagagcgagactccttctcaaaaaaaaaaaaaaaaaaagtgttggggggtggctatatatttacatatccatagtggctacctccaagcagaagtgagggaaagagatctttctccttttcctatttatacttctgtattttttaaacaatgagtagaagatacactctttttttagagacagggtctcgctctgttgcctaggcagtagtgtggtgccatgaacacagctcgctgcagcctgaatttactgtgctcaagcagtactcctgcctcagcctcttgagtagctgggacaacaggcacgtgcgaccatgccaggctaatttattttttgtagagatggggtcttaccatatgcccagattggtctcaagcagtcctcttgccttggtttcccaaagtgttgggattacaggcttaagccaccatgcccagccacttttttttttttttttttttttttgagacagttttgctttgtcacccaggctggagtgcggtggcaacatctcagctcactgcaacctccgcctcctgggttcaagcgattcttgtgcctcagcctccctagtagctgggattacaggcactctccaccacgtccagctaatttctgtaattttagtagaacgaggttttgccacgttgccccgtgaggacatggtgtcgaactcttggcctcaagcaatctgccttcctcagcctcccaaagtggtgggattacagacatgggccaccatgcccagctcacttttttttttttgagacggagtttcgctcttgttgcccaggctggagtgcaacggtgtgatcttggctcaccgcagcctccgtctcccggcttcaggtgtttctcctgccttaacatcctgagtagctgggattacaggcatgcaccaccatgcccggctaattttgtatttttagtagagatggggtttctccatgttggtcaggctggtctcaaactcctgactcaggtgatgcccgcctcagccttccaaagtgctgggattacaggtgtgagccactgtgctcggcactttttttttaatgtagtgattctctcagtctcatgactaattagtggtagttaagggttcagacttggacctctgcagagttcagagcgcttgagacagggcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtaggggtggggtttatattctgcatctttgtgggcttgtggataaaaaagtctgaagtacagatcctaatctggttcttgcctttcaggcactgcattgatctcttcttagatttcattactgtcttcagaaaacycatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatrtggttaagattcagttcttgctgagctaaggaagcatttctcatttctttttaattgtctggctcacttctagtccctaactaaatgctcactcaagagttttagcttgaatgtcaaatgtcaaaaaattaattgggtgatytttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtatgaacagagacaaagacctcccactctgtagccccagcatgccacaaatgttgagaattttctctgtcaaatatgtaagccagttttttttccagtcctctccaccccctgccacctttgctatatgttgtttgtggtgatatgtgcagttggttcagatgtgcagccaagctttggagtttgaggatgcataatggaaaaaaggcaaatgatacccactcattctgcaagtatttttgttcacccactgctgcccggctgtattctaagtgcattagttaataaagatgtaaaagttggccaggcatggtggcttatgcctgtaatcccagcactttgggaggccaaggtgggcagatctcgaggtcaggagttcaagaccagtctggccaacatggtgaaaccccatctctactaaatacaccaaaaaaaaaaaaaaaaaaaaaaaattaggcaaagtggcaggcacttgtaatcccagctacttgggaggctgaggcaggagaattacttgaacctgagaggtgaaggttgcagtgagctgagatgcaccactgcattccagcccgggtgacagagaaaaaaagtcggccaggcgtggtggctcacgcatgtaatcccagcactttgggaggtcgaggcaggcggatcacctgaggtcaggagttttgagaccagcctggctaataaggtgaaaccccgtctcaactaaaaataacaaaaaatagcccggcatggtggtgggcgcctgcagtgccaactactcgggaggctgaggcaggagaatcgcttgtacccgggaggcagaggttgcagtgagccgagagcgcaccactgcactacagcctaggcgacagagactcccatctcaaaaaaataataaaagtccttgtcatagttcagatatgagattatcaatcggaacttgcattacaatcaggttgctcaattctgtgtttgtgtttttgttttgatttttggagacagggtcatggtcttgccctgtcacccaggctgtagtgcagtgatgcgatcatggctcacagcaacctcagtcacctgagctcaagtgatccacctcagcctcccgagtagctgggaccacaggaacatgccactgcaccccgctgatttaatttttgtagaggtgggatctcaccatgttgctcaggttatgttgaactcgtgttcctcaaacgatccaccttagcctcccaaagtgctgggattataggcttaagccaccatgccgagcctagtagctcaattttaccatgcttgttctccgcttgtcatattcattgtagacccaggccttcctgttagaatttgaccattattctgactggttcatctaggttactcccagttgacctgttcggactccacatgtgcccgtgccaactaaggatagccattttccttaagcttgggaaatattccttaagcatcttttctctcttgctgactttgagaaaagactggtcctaaagactctttaaagcccccattttatctgctaggggagaagtacaaggtgcaacaccttttgagtgtttacaaggtcaggcactgtacaaagtgccttacatggattgcttaacatccccagtagtttaagaagatggtgtatttactacgtacggtcagttacttccagggctggcagatgtgtgcccagaaagaatctaggcacactatctccagagcccctatcctttactgttaacctatgtaagcagtgttaaggttagtcctcctgggctggagtcatcctttccatcctgacctacatcctggctatggctctggccaagggtggaaagggaaattgtgaaggggtttgagcaaaatctccccaccccaaatctttgtaaccaaagaaacgtagaagagtgagcggcctttttagtctttcttcccccagccagcccaccaattaccaattaaatggaagaggataacaaacagcagctctttccatgtgtaggagacctgcaggccaaaactagaccaaggaagaccctagtgggcggcagaagtggaaggtcctctgggttgaaagaagaaacagtattttttttttttttttggagatggagtctcactctggcccaggctggagtgcaatggcgtgatcttggctaacagcaacctccacctcctgggttcaagcaattctcctgcctcagcctctccagtagctgagattacaggtgcatgccaccatgcccagctaatttttcatatttttagtagaaagggggtttccccatgttgctcaggctggtctcgaactcctgacctcaagtgatctgcccttaagtgatctgcccacttcggcctctcaaagtgctggattacttacaggcatgagccaccacgcccagccaagaaacaatatgttctttctaagcatggtgagcagatgaggggatctgtcttgtttaagctggggataaagatgtagaagacagttcctgccttggagtccttcaccactgagtagtgctggagagccacatgtgaacattacatgtgaataggagttaagcatagtgggccatgagacaacagcaggagacacagcctggtctggtcggtcagagaaagtgctttgtagatgacacctcagctaagtctaaatctcaaagtttgagtcaaagtgaggcaagtgaagagattaagaaaggcagtgggagtggatgtttctgatcaagggatcagcacgaggaaagacaggagtacgctccagcatggggagtgcaaggaaggagctgcaaaaacaggttttgctaactaggaaagttggaggaaactagtaggaaatggagggggtaagtcaacagttactgaagacctggtatgaggcactgttgcatcaaacctctgatgaagctgggcgcagtggctcacacctgtaatcccagcactatgggagaccccaggcgggtgaatcacctgaggttgggagtttgagaccagcctgaccaacatggagaaacctaaaaatacaaaattagctgggcgaggtggtgcatgcctgtaatcccagctactcaggaggctgaagcaggagaatcgcttgaacccaggaggcaaagattgtggtgagccaagatcgcaccattgcactccagcccgggcaacaagagcgaaactccgtctcaaaaaaaaaaaaaaacaaaaacacttttgataatgaaagtagataatgataatataagaatggccactaatgccgggcgcagtggctcaagcctgtaatcccagcattttgggaggcagaggtgggcggatcacgaggtcaggagttcaaaaccagccttaccaacctggtgaaaccccctctctactaaaattacaaaaattagctgggcttggtggtgcacacctgtaatcccagctactcaggaggctgaggcaagataactgcttgaacctgggacgtggaggttgcagtgagctgagatcatgccactccactccagtctaggcgacagagtgagactttgtctcaaaaaaaaaaaaaagaatggccactaacatcatattaagacagacaacctgacatcacataccttctgatagaagtaaatactaccaatgaagtgtgtattttttttgtttttgtttttgtttttttgagatgtctcattctgttgcccaggctggagtgcagtggcatgatcttggctcactgcaacctctgccttccaggttcaagtgattctcctgcctcagcctaccaagtagctgggattacaggcacctgccaccacgcccagctaatttttttatttttaatagagatggggtttcaccacattggccaggctggtctcgaactcctgacctcgagtgatcagcccacctcagcctcccaacgtgctgggattacaggagtgagccactgcgcccagcctaccaatgaagttttcttaacaacaacaaaaaaattgaatctgggctgggcacggtagcttacacctgtaattccagcacttcgggaggctgaagtgggtgaattgcttgagtccaggagttcgagaccagcctgggcagcatggcaagaccccatctctacaaaaaaatataaaaatacacctgtggtctcagctacttgggaggctgaggtgggaggatcagttgagcctgggaggttgaggctgcagggagccataaacgcatcgctgcactccagcctggggagaaaaaattgaatctgaatcatattaagttctgtgtgaggtaataatacatacgtcagttcactagatttaatcatgccacaatgtgtatacacttcaaaagatgttggacacatatatggttttatctgtcaattaataataaaaagaaaactttaagttcaaactattggtttcttttttcaaaaaatatggcaaagaacaaatccaaaaagagagggaaggaaacctagacattaagagacttataagccatatcaacaaaatgcaatcaatgatgtgatcttgtttgaatcctgattcaaataaatcaagtatagccgggcgcagtggctcacgcctgtaatccaggcactttgggtgaccgaggctggtggatcacttgaggtcaggagttcaagatcagcctgaccaacatggtgaaactctgtctctactaaaaatacaaaaattagctgggtatggtggtgggcacctgtaatcccagctactcaggaggcggaggcaggagaatcgcttgaacctgggaggcggaggttgtagtgagctgagattgcaccactgcactccagcctgggcgacaaagtgagacttcgtctcaaacaaaaacaaaaataaacaaaaaaaccaagtgtaaaaggaaaagaaaaagggagagaattggagcaatttgaaccccgattcacattctccaagatggcccccaaggatcctcaccttggtgtgccctggtagagttctccacattgaggcaggctggcacgcatgaccaaaatatcactgcagaagcgtgtgtggcttctgaggccaggtcttcagaggaattgcagcttcctccttgtctccttggatcacttgctctgagtgaaactaagtacaggttctgaggccattcaagccgccctgtgtggaaagccttgaagtgaagactggagccccctgcccacagccagcaccgacttgccagccagtgggaaggagccaccatgaaagcagatcctccagtttcaaactttcaggtgactacagtctcatgagacactgagccagaactgcctcaccaatctaccaatctgtttctgaatgcctggcccacagaaactgtgagcaataatacatttattgctgttttaaaccactgtgttacacagcaatagataacagctcaaacactgactacatgataaagaaatattattaatgcataacgctaataatgttatgattgcattcttcaaaagttatcttttaaagatgcatactggccaggcgcggtggctcacgcctgtaatcccagcactttgggaggccgaggtgggcggatcacctgaggtcaggagttcaagaccagcctggacaacatggtgaaacccggtctatactaaaaatacaaaaatgagccaggtgtggtggtgggcgcctatagtcccagctactcgggaggctgaggcaagagaatcgcttgaacctgggagtggaggttgcagtgagccgagatctcaccactgcactccagactgggtgacagagcgagactccatctcaaaaataaataaataaataaaaattaaagatgcatactgaaataagtatggattaattactatgatgtctgagatttgcatcaaaatactcagttgggcttgtggagtgcctggagtgagggttctggatcccacccg

SEQ ID NO: 10662 - DNA, 93480 bp, Homo sapiens
  misc_feature (1)...(93480): n = A,T,C or G, or insertion/deletion polymorphism (see Tables 1-2)
tcaaaggaaataactcttagcattaagtctctaactttactctgactggaccattcctcagctaatcacagtgggcaggggaaagccgcatgttaagtggcttgggcctgcccatctgatgtaacaagctgtgagatcacctgtgctggcctagaggcagagtaggtcccagtgagatcacatagctgctctaacgtggggtggttctccaaagcaaaatcagaggggccaatggatacaggatgggcaaccaatgcaagccccctatacgaacctgctaaagcctaaacacctgcgcatcagatggttttcctgttgtccacagcatccctgaattcagcaaatatgtattgccacatatttgctgaattcagggatgaatgagtttgataatgctgatggctggtggaggaagtattctcaaatgtaatctgccagtcggtaaatagaatatctgagattcctgtcttggtggttaaaggggtagggggcaaagagtaggagggaggtgctagcacagaagggaccaagaaggggctggcctggcccagtggacctgctcatgaatgaacatgggagaagccgagcccccaggaagacagcgccaggaagattgctgctctgggccctttgccctctcagtcctgtggtctacctagtattggtgggtttggttgtttcaaacattagatataatggagccttgttcccaatcatttcatgatgttgaactgcccttttcatttctattcacaggaaaggtcttgtgtcactctaggggagggagcttcctggggtttctgatctttctttccactgctctcagtttctaccagggcactctgccagtctttggagataaacttgctccaatgctatgtctgtctcactgcttcctttgccagccctcttctgacttcctaggtaccaggatatccaggtctgtgagctctcatttttggaaaagtgtgcatttcactctagtaggaaacaagttaatttcattatccaaaccaaattcagccttcttggacatacctatccctatcctgatatttgttgggaaatttgattcctcgtaattgcagcccccaactgtaggttggtgcaaaagtaattgcagtttttgccattttgatgcaaaagccgcaattacttttgcagcaacctaatatcttccagactaggaggccaaggttttcagggggctcaccagtgggaaaacctctacccttactcaccatttaggacttgaccactatagtggagctgccatccccacctggataatagagctgttcctgcttaggccactgcataccacctacccaacaagtttaacaatctgtcctaattgtttaacccttgtcctaataggccttatggccttagatattgccaaggtgctctcttctggctctgtccccacttctctaactgaactttcccacctgtggcatgagacagagaccctttaagtgccactgtccccagggttctggcctctttccctaaacacttcagagctcctgagatgacctgtccacaagcccctcacatgactcaagtctccaaccccagacactctgtcccttttgagccctgaatctccaccgagatgtcctgaccgagttccatattgtctccctatgcctgagactccctctgtccactcagtctcccaatctgacagcaccaagtcaccttgggccagtccttcgtcccattcatccctgaatttcatcacttctgcacgatctgggcctcagaccaggccctcactgctcttcgccaggacttttgcccagcctctgacagcagggctgcctgcaacctccccactcccacctcccccactgctgcctggggtctaagcacaccccgatccagccactctcaggaggagactctagggtgttcatgtcccttttagaccaaggccagctttctcctctgtaccagaaagtctgacccctcttacttctctcactccccatcacacttatccccacagagctgcagtctgtgctccagcttcattaaaagtcctgcatctggaattctctgagcctttttgcagctctagacctttgagtatggaatgctgccttccttcccccacctcctcctccaggaccctctgggcaggtctcccagcagccccaggtctgggaggctctttaccccaagcctggacctttgtgggaaggacttttctctagcgctctgcagcctggaggggtgacctgactatgaacctatctccttcctcatcccaggagcctctcaggcacagagactgccttgctgactgttgtcttctcagtgcctaccatgtttgcagcagggcacagctgcccagtgaacactgaataaatgcccctgccaaaagcactagtaattttcaagtgaatcttctagtgtttcaagcctggacagttgcaagaggttatagctggttttcctgctcccaattctcacaggctcatccagtctggtcatggccattggatagttctacctaaatcactcatagggcactttctagttccaaagcctgcctttcctttgtttgtctaccaccaactccaagcctaactctgacaagcactcattcatcttctgctgagtgaatgaatgaatgaatgaatgaatacatgaatgaatgctttgtatatagtagagattcttgcaagtggagcccattgctaggagacactgggggtgggagttgttaacctgggagcaaggggatttcgggaagcatcatcaggaggtaaggaatcaggctcagtgaggtgcaccagggactaagattcacacggggagagatttaaagtacaaaattgagggcatctcacctgtctgcccaactggctcatagacacataatttttcaagttcttaggtgagaaagggttgcaagtgggagttggaagagctgttttcctacctagctgtaaactttaggtgcagaagctggcctctggggaactcagcatggaccagctcaggttgcttggaagctccaaggccagcagctggaccaggtgagaagtggccatggcagcctatagcacagggcccaggagatcactcctcctcccaggtcagacattccttggtggggatagaggttctgcttaaggcagggtgagagcgagcaatctgacttctgatagtctctttctggtaggagcggcccagggaatcttggtgaaatgcacctaagggtgccaattagaggccaagactcccagtgtttctcacattccctactcctcctcccatcttgactggctcactgctatggcccacttcaaaggcttcctcctttgggctaccttccctggatatcttgctaggaagtagccgcttcctctctttcaattctatacctgcatcctgaaccagtgctgcctgggcactcagcccacattgccttgtggctagtgtaggttcattttcctactcagctgtaggtgctatcttcacatccaccctcccaagcacacagtgccctagatgggcatagccaactgctttaaagtatttctggattaatggtagatccgtgatttttaataaccttcaggagttctgcactgacttggcctattccaatccatcactaggcgagcttgtctgaagcagcacccctgtggactggtggtttgttagttggctgtagaactccttgaggagaggttctccttacatttccagggaaatgacctaggccctccctcctcagagtgccattcgtgaatggggcatcagcatcacctgggctacttagaaacacagaacctcaaagagtcagaacctgcctttgaataggctctctaggggattcatgcaaatgaatgcctggaaaccctggcctaggggagactctcaccaggaagcagggctttaaaaggatgggtgaggagtgacacactgaacagctgctgggaggaccaactccacccctctcaacttagatggggaaactgaggccctgggaaccacggtggctcacaccagagagttagcaaaacacacttccctgcctgggctctggagactgacttcccaggtgctagcttgtcttctagctgtgtgcccgtgtgcaagttattctgcctctctctgcctcagcttccccatctgtaagagccacctcctagatctgcatatttaatcattgaacgaccaggacaggtaagagtgtacacagtgcagtgcctggcacacagtgaggccctgtaactagctcttgttattagtgctgcccaaagccacattcacagaagacagtccagtatccaaagtgcctgcttgaagcatggccagaaggcaagcagatggtggggtgggcagtgatgtcaatgagcaaatgcctgcatccatccatcagtacattaactcctcctcgaacaactatgggtgtttgtcgagtaaggtcctggacattcagcagtgagggagagagcgggggtggtcagtgggcagaggccactgaggaatatgggtacctgggcatggaccctagcgctgcagtccacagacccctgggtctccggccagggggaaatgagctcttagtggcgggtctttctctggcctggtatcaggggcctgggcgggagagccagggctgcgtgctgccttcccatggctctcacgctgggcaccggtatgcatcatgcatcagcaaggatcctagggcatctgcggcccataccctgggtggcagctggcctggatgcagcacaggttgagctcttggggcataggcctccttcccaccttgtccccccgctgtatgcctccagggcctgtgggccgcctgcacctggtcgccggccttgggttctccaccgagcctgcctctgagttatctcccctgagccccagcacctgccgcccatccgcactgtccaccatccctgacattcgattcccccacgaggcacctcgcctgtgcgtgcagtacctgttttgcttccaccccattcccagcagcgggttccgcacctgggatcgcacgtgagatttccccccaccccccaaccgcatgcctgggctctactacctgcacctgccgccccacccctgcatcccgctccgcacttcccgcgcataggtttggccaggccctccctattgaggcacctgttctccaagacagagccgctgtgtcccaggtgctctgggtgcaggcgcgagtggggattgaaggaggcgctcttattccactctgtccgggacaggggcggctttgtcctagggcactcttgctttaatagagagggcccggccacacccacgtgcgggaagtgcggggcgggatgcagggttggggaggcaagggcaggaagtagggcccaggacgcggttgggagggcggggaagctcagctcacttggatcccagctgcagggcccgctccgggggaagcccccgagcttcccggttccgaaagtgtgcagccactgagaatttattagcctcgtggatccctaatctttccccttttctaccctttgctcagccgcattctaacaaacggcaagcacacgccccgctgggtagcagcaacccgagaacgcccccacccccgcccccgccagacgccggttcccgcttgagagggtgagggtcccgagacccctgcgaggaggagggtcgcggggttccaggatgccgatgccaagcaggaaagatcacctcgttgcttcttccaccggcctctccgcgagacatagctaaacttgaacttggcattccaagggtctggaaacatcttcgtgggacccatcgagaggttgtttaaagactggcacccgctcccgcgcccaggtggggaaagggctggccagaagtgaaagtccggtcggggcgccacacctaggctgcggattccgagagactgggaggctggaggcctgggaggcgtggcgggggcggagtcgccgggggccggcttcgcgcacttcccgggcccggccagcctggatggactagccggggccatggccggcgcggcrgcggagtcagggcgggagctgtggaccttcgcgggttcccgggacccgagcgcaccgcggctagcctacggctacggcccgggcagcctgcgcgagctgcgggcgcgcgagttcagccgcctggcaggtgaggcgggcgggcaggcttgggggacacgaggtttctggaaccgacgtggacggatcttttgctcctagtgagagcggcgctacctcattcgggcgcattttaaatcgaaactccaggagggacgtgtccacgcgtcctcctagtagacacggctccctgaggtcccacctgcagccccaaggcttcttgctactcttactcttccgactttccggtgggcaggaccaacctagccgtcttccccttttcccgccctccgcgagcggggcttaggatggttcttgccctctcttgcgggagacccctcactgtaaagggcctgctggggccggggttgcaaaagacagcatgtccagcggccgtgacccttcggatgtcctcccgaggtaggagcggtgcgtggaccgccagcgcccgggctgggacagcacctctgacggcgcgccaggttgggaccgggaggccaaggcctcttggccggggcctcccgaggctgcgctctgcagactcctctgggatagcctgtattcagctttgattttcgaaacctcattttccttactcttacagcgtcagaacaatccctctgagctccagttctctgggggactagaagaattagcaaacagtgcaatttcacctttaagaacagggcgagcctgtgaattagacaacaccaagatcacatcgtgcctttcctcagagcggaacaggctgatgaaattgcaaatcaagctccatctggccttggccgacccagccctctgctgccagggcccaagttcgtgactcatccctctgccagggactttgggtgcagggcttcatcaagccccagggccgcgtgccggatggtcaaggagggtgtgcaggtgaagtgggcacgtcttggcacagggcaccggggtttgagtgtatctgctctgtcgcgatgaacaactggtgactgctccccttctgggggcagaacagcaaccatgacttaggtttcactactcgggtagctgatttcagcgcttcgggtcacttcctggtgttgtggagggtaactgtgttttccctttgggggctgtgagaactgtggcctcctcctgtgtgtctcctctggcttcctaagtagggagagtcaggagggagacgggggtgccttctgccaacctctctattcactcctcatccttccctctcgcagggtcacctgctggagacagctcctcacccttctttcgtattctctctctctctctctctcaactattaattatggaaatttcctaccactcagaaatagaggggtactatgaatgcctacaggtgctggggagggaggctctccattctttgaagcaactcttcaaggctacctgagtaattatatcagcaccgcacctccttaatcccctaaatctcctccagctgtgatctctcacgcccactattggccaacctctcccctcaatgctaccctgggaaagtagagctatgttctggtcccctcctggtttcactcttgtccctcagagaacagtacttttcccctcaaatgcaaaattgggatgtgtcagccaggctggccctcagaactcgttaccacttactgtatgtctggtagtgttgtgggcatcttttatttaatgcaagttccttgtatttcctctacattacggttaaagcagacatttgtgcactaatctgacgcccctcccactgctgggagtcttggaacatgtccacttgtttttctcctagaaacaagacagagagagggcgggaaaaaacaaaccaaaataacatcacctcttcctcgttcctcctctcccctcatgaagtttttctgccaatttgagaattactctggttaagtggtggctcagaataattaaatgcttaagatttaagtgctgaaatgtgttacctaaagatttggatgggaacttccttgcctttgtgaagggagagtattgaatatacggatgtgtgtcaagggtctctggaagccttcgtgctgaatcatgaccactcaccatgctggaaagagaactggagggggatgacctagagctgaccctggaattctctttcctgaagaaggtctgatgccatttaactttggggtaattcacctgtttctaataacagctacacctgtgtcccgagcattggactggatgctgccatatagcagctcatttaacctttgtcccatctgcagatgaaagaacaggggcccagaatggctactggtggagccaggattcaagtctgggttgattgacttggattttgtactgttaacccctatgctgcctgactttctcctaacatcacatctatgggtgatttaacacagctttcccacccttttgtttttcctgcaaaattaaccattggaccaaaagccaaagcatcttcttctccaatagctacttggccctccagaagactgtggcacagtgtgagatgctccccagcagcttccaggtctcacctgtggccttgatgcctgggtgaacaaaagcctttcttttggtttggtacctttgtatttctgaatctttagtaaaagcgaacattgttttaaaagtatctttttggactagctcatacatttgatatggtttggctctgtgtccccacctaaatctcgtgttgaattgtaattcccaatgttgggggagggacctggtaggaggtgattggatcaagggggtggatttcccccttgcagttctcgtgagggtgcgttctcacaagatccggttgtttaaagtgtgtagcacaaactgggtatggtggctcaagcctgtaatcctagcacttgggaggctgaggtgggcagatcacttgagcccaggagttcaagaccagcctgggcaacatggtgaaaccccgtctctacaaaatatacaaaaattaggcaggcatggtagctcatgcctaaagtcccagctactgtggaggctgaggtgggagaattgcttgagcctggaaagtcagagctgcagtgagctgagattgcaccacttcactccagtctgggcaacagagtgagaccctgtctcaaaaaaaacaaaaaaacaaaacaaaacaaaaaaactttctttggccaggtgcagtggctcatacctgtaatcccagcactttgggaggccagcctggccaacatggcaaaacccagtctctactaaaaatataaaaaaattagcccggtgtggtggcacatgcctgtaatcccagctatttgggaggctgaacctgggaggtggaggttgcagtgagccaagattgagcccctgcactctagcctgggtggcagagcaagaccctatctctcaaaaaaaaaaagaaaaagaaaaaaaagtgtgtagcacctgccccttcacaagcaccttctctctctctgtctctctctgtctctcctgtcaccatatgaagatgtgcttgcttcgctttccaccaagattgtaaagtttcctgaggcctccccagccatgactcctatacagcctgtgcaactgtgagtcaattaaacctcttttctttataaactacccagtctcaggtagttctttatagcaatgtgagaatggactgatacaacatttagtggtatcagattcaaaagttgccaaaggagggtgaagaatcaccagggagcctccctctcacgccagctgcagccactgtgtctacctcagagtcaattgctgtcactcatgtcttgtgtatctttccagtggttgtccatatttatgtgtgcatgtgcacactttttgagacggggacttgctctgtcacccaggctggaatgcagtggcatgatcatagctcactgccgccttgacctcttgggcttaagctatcctcttgcctcagcctcccaagtagctgggactacaggtgtgcaccaccatgcctggctatttatttctatagagatggggtctcacatgttgcttatgctggtctcaaattcctggcctcaagcaatcctgccttggcctcccaaaatcctgggattatagatatgagtcactgtgtccagtacacttaaaatacgtgtgcacacacacacacacacatgtgagccatatgtctcaccacttgacatagtttgtgtttaaggtctttctctgccattatcatgctatcttctattttgttcattgctgtgtctccagcacttagaacaatgcctgacacatagtaggtgctcaataaatatttcttgaatgcaaatacactcaataaactaggaatgaaggaaaagttaaccaactgataaaggtcatctgcaaaaccccccacagctaacatcatacttagtggtgaaagactgaaaactttcatcctgagtttgaaacaagacaaaagtgcctgttctcaccatttctattcaacattgtactgaaggctctagccagggcaattaggcaagaaaacaaaatagaagggatccagattggaaagaagtaaaactatctctacttgccaataatgtaattttgtgtataaaaaatttcaaggaatccacacacaaaactattggaatttaaaaacaaatttagccaagtggtaggatacaagatcaatatgcaaacatcagttcaatttctatacattggcaatagatactatgaaaatgaaattagaaaaacaattcckaaggcatcaaaaataataaaatacacagaaaaaaatttatcaaaagaagtatcacatacactgaaaattgtaaaacatcattgaaagaaattaaagaagacctaaataaatggaaagatatcctgtactgatgggttggaagacttaatattgttaacatggcaataatccccaaattaatatacagattcaatgaaatgcctatcaaaatcccagctgcctttttgcagaagttgacaagctgattctaaaatttatatagaaatgcaagtgactcagaatagccaaagcaatcgttttattttattttttgagtcagagtctcactctgtcacaaagactggagtacagtggtgcaatctcagctcactgcaatctccacctcccaggctcaagtgattatcctgcctcagcctcccaagtagctgggattacaggcgcacgccattaccgcctggctaatttttgtatttgtagtagagatggggtttcaccatgttggccaggctggtcttgaactcctgacctcagatgatccactcacctcagcttccccaagtgctgagattacagtgtgtgccaccacacctgacctcaaagcaatcttgaaaaagaagatcaaagttagaggaatcacactttgcagtttcaaaacttactacaaagttacagaatgggccgggcgcggtggctcacgcctgtaatcccagcactttgggaggctgaggcgggtggatcatgaggtcaggagatcgagaccatcctggctaacaaggcgaaaccccgtctctactaaaaatacaaaaaattagccgggcgcggtggcgggcgcctgtagtcccagctactcgggaggctgaggcaggagaatggtgtgaacccgggaagcggagcttgcagtgagccgagattgcgccactgcagtccgcagtccggcctgggcgacagagcgagactccgtctcagaaaaaaaaaaaaannnnnnnnnnnnnnnnnnnnctctcccaaaaaaaaaaaaaaaaaaaaaaaaaaaaaaaaaaaagttacagaatgaagacagtgtgatattggcataagtatacacatatagacaaatgaaatataattttaatttaataaacccatatgtctatggtcaattgattttcaacagataccaagactattcaacgagggaaataacttcttcaataagtgatattgggacaactggatatcaacatgcaaaagaacgaacttggacccctacctcattctgcagtcaaaaattaactcaatggatcaaatacctaaatatgaaacagctaaaagtataatattcttagagtaatatataagcataaatcactaggaccttgttgaattagacaataatttcttatgacaccaaaaatgcaacaacataaatagacaaattggattttatcaaacttaaaaagaacttgtatgtttcaatgaacaccatcaagaaagtgaaaggacaacccaccaaatgagagaaaacacatccacacaaaaacttgtacaccagtattcataccagcaatcatttataatacacaaaagtggaaacaatccaaatattcctcagtagatgaatggataaaatgtggtatattcatacaatggaatactattctgccataacaggaatgaagttctgatacatgctaaaatgtggacgtaccttgaaaacattatgctaaattaaagaagtcagacactaaaggccacatattgtatggttccttttacatgaaatgttcagaacaggcaaatctagagaagcagaaagtagattagtggttatcaagggctggggttggaggcattggggagtgattggtaatgatatgggatttcttttgggaatgaatgaaaatattctaaaattggtggtatttatgtaattttatgaatatgttaaaaaccactgaattgtatactttaagagagtgaattttatgttatatctcaataaagctgtgataaaacaacccattctacacaaaacaaaatatttgataagtgaatgaatggatctcttcacattatatgtacttgaaagtgtatctcagagtttgtttcatgtcagtacttattattagtgtacaatgtttattttaaaagcgcattgatggatatttaagttgtttccaatcttttgctattgcaggcaatagttcgtcgaatagccttatattcaggtcattccacaaaagtgtgggtatttgtaagatgaattcctgcaagtggaattgctaggtcaaagggtgtgtacattttaaagcatgaactgatgttgccaaattgctgagcataaaggtgtacctgtgtaccctcctaccagccgtgtaccagtgagcttgtttcgccacagcttcattcacacagtgaggaatccaaccactgatctctgccaatctgatcagtaatccgcggtatctcattttcatctaaatttgcatttctctcagagagaggttggatggatcatttgcattccttgtattcttggaagctctgcagctgcattagtgttgaggggtgcagagcagtgtgggaaagtaggatcagggctctcccctcagggactcctcccagaacctccagaataggttgtgagtgacaatgtgaaacagctttgccatcattcatcacgaatgtctgctgggcgtcttctctgtrtgggatgctgttccaggttcacaaaagagtgaagagagctgattaatcaggagggctctctcagkgctttaaaagtccttcagcattagaagtgcagtccttccactgctcatgcctacacttggattaagaggcacatatcaagaggcacaagtcagtggcctgatgttacgtctgcatgcattagatgacattggttgggcttacacaaaccagattcaggtaaaattttagtatttattttgtgttttctttcaggaactgtctatcttgaccatgcaggtgccaccttgttctcccagagccagctcgaaagcttcactagtgatctcatggaaaacacttatggtaaagaaaaacacctgaaacaggttttagtcaactacatgcagctgatatacctgtgcatrttaaacsytggattaataggccaggaatattctgaccacaaaaagctgaataagccccatgtaagataggggccaggcaagcaccctgggtcattctgtactgtaaacatgtggccgggatggagggagctggctcagggacagacacacaggttactaccagaagaagaggccagtgttaggaagggcacagagattcaaaggtgctgtatttggtggtggtgagtgaccctgtatagtgcagagagtggggcagcaggagggatgttaattcagtcattcactctataactgttcattgagccactatgatgtgtgggggacagtgctataatgggaacaaaataaacatatccctttcttcttggacactgtgatctagtcctggaagacaagaccttaagtgaactccaaatagatgtgattaccaactgtgtgaaggactatggacaaaaggtgcctggttccaggccagcctgtatctgcagtgacagtggggttggcttgtgcatgtctagggaaagcttcctttggagtggagtggatgctggaggatgagccagaattcactcagacaagagggggagaagtgcgagcaggcagggtaacagcctgagccaagatcccatagtggtttcaggaaccagtccaggaacacggaagggagaagagtgggagaggtctgaatggggagggagggagaagaagccagtgcagggcattgtagatgcttgatctttgttctaggagcaatggcattgtcatcagtggcatttatttgcagcacaacatgatctcacatactttggaaagggaacttgaaatcatagtggcagtagcaattgtaatatttgtgatgagaataacgataagtaacatttatcaggtactcgctatgagctttctctcttcagcctcacaacaacccaagaggcataggttctggtatcactcctgttttataggtgaagaaatggggccccagagagggcaagtaactagcctgaggctgcacaggaaggactggagcttggaggagctagaagctgtgtttgcaggcagtttagctccagagcccaagcccttagcctccaccagagtgcctcgattcaggatacttctgttatgccacattaaggggtttggattttggctctgggcagccagcagatatttaaatctggggaacagtcttctgggaaggtgccaaggagggatttatcctgattttaatctgcagtttgcaaaggttcttgtaattctccttctttaacctttgcaagagccataaccgtgggaaagcctgagagatggcagagttgagattgcaggtggtggtaatgatgcagcgctaaagccaagcagaggaaaggcaatgaggataattaccaggtcccacaggttactagcaatgtggaaacagaacatatggtagctgcagtggccagaaatccagtgcaatctttcagtgtattttggaggaaaaaaaaagtctaaaactaaagggcaaattctgcgttaatgagcacatgtagctcctgagaaatgctggtgcctggtcttataggtcaggccctaccaaagcctgtctgggggttaagtttgagggaggtcatgatactctgggacacatttggtgaggacaccgggaagggagcaaaactagaagttaagaggaagagtgacattgggaggagggccttcctccttgaaagtggatggctaagggcagcacagtggcccccttcacatatttggaggccgggatcaattatttctgcaggaaaggcatcagcagtggtggtgggatctgcagggcaatacgtggggacttagattaagtggcgttcatggctctgcttcatgcttggagaaaagggcatcctcctgaggctgtatactgcattctctggagttaaacagagccacagccacctgtctggaacatgtagaacagactcttgcactggcctgcttctgagctgacttccagctctaaaatactcttcccgatcacatttggttttactagtgaggagagattttttttttttaactatwtcataaaatttaccagctgggtacagtgtctcaggcctataatcccagtgctttggtaggtcaaggtaggaggattgcttgagcccaggagttcaagacaaccctgggcaacatagcaagagcctatctttacaaaaaacaaaaattttaaaaaatcagccaggtgtggtggcacatgcctgttgtgctagctattcaggaggctgaggcaggaggagcccttgagcccaggaattcaaggttatagtgagctatgatcagccactgtactccagcctgggtgatagagtaagattgtgtctctcttaaaaaaaatctatttcaggtgtccaatgatgattttttagtgattgacctagtgatgcaatcatcactataaatcagttagatgttttcattcccctgaaaagatccttcatgcccattacagctaatccttgttgctgaccttacccccaggcaattgctaatctactactttctgtatctctacaattcttttgctggacatttaatgtaaattgattcatgcattatgtatattcttgtgtctggagtatttcatttatcatgcttttgaagttctttcatggcatagccagtagttkgttcctttttattggcaaataacttccctggctgggcacagtggctcatgcctgcaatcctagcacttggggaggctgaggcaggaagattgcttgaacctaagagttcaagaccagcctgggcagcacagtgagacctcatctctacaaaaagtaattttaaaaagttagccaggtgtagttgtgcacacctgtagtcacagttaggaggctgagatgggaggatcgcttgagcccaggagtttgaggctgcagtgacctatgatcatgccactgccctccatcctgggtgatggagcaagacagaacaaaaaaccaaatcactttttattttatggatgtagcatattttgtttatctgttcacccattgatggacatttatattgtttccagaatttgactttctgaataaagctacgaacattcccatgcaagtctgtatggacataagttttcatttttgagggatagaaatctaggagtggaattgttaggtgatatggtagttttatgttgagctttttgagaaactgagggagtggattcagaaggaacacaaaagaarmgaccctaagtagtgacttggtggccttgtctttgtaacctgccaggtaatcctcacagccagaacatcagcagcaagctcacccatgacactgtggagcaggtgcgctacaggtaagcatcagggacacctgcctgactgggcatacctaggcagacagacttccttcctaggacttgcctgcatcccacaaaagttctgagttgrtttcaggaggatcacagttggctaaaaggcaatgcatgtatgttgagaaacatcagagtcagagctcagaaaggcagcggtgagtagatgcagtgtggggcagatgagacacacaggtaggtggctctgaggtgcacacagctgttctgtgtggctccagagactctgcagtgccaaagtgacaggaagtgacccaggatcctaggtcttgttttcagaaagaagaaaagtactatttctctggttttccttttcataagaagttttattaggcaacttgttttcttcctgtcttttttcccttttccccccttttttactagtatttgtatgttaaacagctctctatactttctaaacataacagtatctggcaaataatttccaggttgtccttaaaattattaacacaatttccaatcacacaatttcaagttagttcaaatgtgaaagtgatactgtkttgctattagagttgccaaaactaaaagcaatgtaaacaggttgattactacttaaaccttgttatgttagagctgagcagaaagcaccaaggagagaaagtagtatcaactctgattaagtttattgtggattttttgtcatacatatccaattggagatatccagtgatatttgggaggtaagaggattttgccaactggaactcgttcccacggcttccattgccctcgccctaatttcgcagctgtggcaaacctatctatccattaaggtagagatgtcatagttaatagaaataaaacagcctgcaaacattcagtgctggggctgagatccgcgggttgcggggatgctgtgcttcttccagaatcctggcgcacttccacaccaccgcagaagactacactgtgatcttcactgccgggagcacggctgctctcaaactggtggcagaggcctttccatgggtgtcccagggcccagagagcagtgggagtcgcttctgttacctcaccgacagccacacctccgtagtgggtatgaggaacgtgaccatggctataaatgtcatatccaycccggtcaggccagaggacctgtggtctgcagaggaacgtggtgcttcagccagcaacccagactgccagctgccrcatctcttctgctacccagctcagagtaacttttctggagtcagataccccctgtcctggatagaagaggtcaagtctgggcggttgcrccctgtgagcacgcctgggaagtggtttgtgctgctggatgcagcctcctaygtgagcacctcgcctttggacctgtcagctcaccaggccgactttgtccccatctccttctataagatcttcgggtttcctacaggcctgggcgctctgctggtccataatcgtgcggctcctctactgaggaagacctactttggaggagggacagcctctgcgtacctagcaggagaagacttctacatcccgaggcagtcggtagctcagaggtaaccttgccacaggggaggggtcagaggagttcagcaaggtggggtctggcctgtttctcctggaggattatgcaagaggtgggtctggctttgagggtcagcagaattcaggttgctggcagggacaggctgatggcagggctcagatctgggaggcagaagttgactggaggtgacacaggtgttcagtgaactctacccccatttgagaggcttctccagagctgtgagaggactggggcctgcagataagaactgcacacaggagagataaaaggccctcatggggtaaggagggtgagctaccaggcctctgccctcagcactgacaagaggttgcaacagttgaaacagtggccttaaaaggtggcacccagtggctttaaaaggtggcaccatttggaaaaagtctgcccacacattgacagcatagctggttctccaggagctaggatcagctcagcctggcacctagttagcaggaggaatcagttaaagcagaggcccccagacttgtgaggcagtgttagcggcaacctctatgagccccactgtgagtgagttacagagggagtctgggtgcaggttgtcacttgccctcaaatgccagaggcctctgcctgggttgttggcatatgcatcatccccaggctgcaagggcaggtggtgtgggttatgctcaggactctttcaaatggtaacagctgggacctgtaaggtcgagtgtgtcaaggctgaaaatggtggctgatccagggttctgctgggtcaacagtggggacacagggttgggtaggcaactaatcacctccagggtccggagaaggcctggggcatagacgggaagggctttagatccccaacagaccccacacagacgcaagggtcctgcacgtagggccatggccttgacgatagagtcagtgttagctgtgtaagcctcaggctggaccactggggaatgagtccccgctccactgcacaccagcgaggggacatgtgacttgttctctgcacctcatgttttttctgtaaagtagaaatgataatattgggtcgggtgtggtggctcacacctgtaatcccagcactttgggaggccaaggtgggtggatcatgaggtcaggagttcgagaccagcctgcccaacatggtgaaactccgtctctactaaaaacacaaaaattagctgagtgtggtggtgggtgcttgtaatctcagctgctcaagagattgaggcaggagaattgcttgagcccaggaggcagacgttgcaatgagtcaagatcatacccactgcactctagccctggtgacagagcaagactccatctccaaaaaaaaaaaaaaaaaaaaaaaagaaatgataatattgtccttttagagctaacatgggtgaagtatcagaatggtagggatcaatgttaggaggctatttgatgcctcttttatttaggacttgtccatagttggggggcttctaaaacaggaatgctcatgtaaaacctcttgactccaagtgtgataatttaccatgtaacagaatcaaatgagaaaagaatgacaggcataacataatgtaagttacaggcagaacaaagcgacacctcaaatttaatttggccaataagggcacctgaaggccaggagaagtggggcagctcactgggggccagggcatgaatgggctgggggggatcagacctctttcctttgattcaggtagatgactttacaacagatgacacgccaacattcccagaaagctgaatttatttatttaccattataagccaatttttttcttgtgaacttaggactagaactcaatagatttaatactcaacctaaaggtttattgaataaataccttgactatgttctcaactttattttataactcagcgaagtacatcccttgacagaaacaaaaaacttttattttaagaaatctattaagtatttgatcaataaataattgtcaatcaattaataactggctagtttaacaaatttttttgtagagatggggtcttgctatctagagatggggtcttgctttttgtagagatggggtgttgcacaggcaggtagtttcaaactcttggcctcaagtgatcctcccacctgggcctcccaaagtgttgagataacaggcatgagccactgcacctggccaccctaggaaatttagagcagcccaagaaaactgcagagtgggtcagggccagaggcagctggacaggtcttggtgtacaaagtgcccccatcctgaaggggagagcaatgttttataagacagcagagggaaggtattaatagattacagcggtattagtccaatttcacactgttataaagatactacccaagactgggtaatttataaacaaaggaggtttaattggctcacagttctgcattgctggagaggcctcaggaaacttacaatcatggcggaaagggaagcaggcactttcttcacaaggcagcaggagagacagagaagagcccaggggaactgccatttataaaaccatcagatctcgtgagaactccctcactatcacgaaatgagaacagcaagggggaaaccatccccataatccaatcacctcctaccaggtccatccctcaacacctggggattacaattagagatgagatttaggtggagacataaagccaaaccacatcaacagctaagcctaaaatctaaagctcattatataccacgaaatgcacatggatygttttgaccacagcttgacctgttctccttaccccgtggttataggtttgaagatggcaccatctcattccttgatgttatcgcrctaaaacatggatttgacaccctagagcgcctcacaggtcagtggacatttctatccctgtggaatttgctcctgttgtgtccttgagggagctctggcacaggtgtgattcaggtaaaggagacagagtctgtggaagtgactggcactccatgtagttaaatttgattcctagtaacttcaaaaccacttcagagagcaagagaatgaggtggggtttttggattgttttttgttttttcagctaaaataacattttaacaggtagaagacattccaaatcaggagattgctagcttcacagaatgagaggagcatccctgggtcctgggaatggttacagatcctgaggcctttacctgctcttgcctttctgggtcctccccactgccccacgggggagctctgcctatgaatgagctgatgctcagagaggttaaacgccttccaggccagggagctggaaaccaggagggcaaggatttaacccaagtcatactgatgcctaaccatgagcacccaaccactgtgtctgccgatggtcttcgcatgaggcatgatttctttcctggccattgctcttttgtcacagtaatgggacccttcagtgccttaaccttagccttagcccaacataggggcagacaggattcacgggaagagaggktcgccctgatggcaatgcagggaggtgagtgggcatgatctgggacaaacggagtagttaataaatacaggcagtgagtagtgagtactttccaaggaaagatattaacagggcccccaaactgcaggtgacagtgtctaacaggtccaggtagctcggaatgcaaaggttgactgtaccagtccacaatatggcaaaccctgatttttttcctatgtcattgttccttttttaaaaaataaaaattgtggtaaactatacataacataaaacttaccattttaactatttttaagtgtacaactcagtcgtagtaaatacattcacaatgtcgtgccaccatcaccactatctatttccagaactttaccrtaccaaacagaaactctgtacccattaaacaataactctctatttcctcctccccttccaacccttggaactacttttttttctctgtggatttgcctattcttggtaactcatctaagtagaatcatacgacatttgtccttttgtgtctggcttcacttagcacgtttccaagattcattcatgttgaagcatgtattcttcattgctttgtgtagtgttaaaatgatttaaacattaataataaaaacaaacagcaaaaatatgtttagaggaaaaaacatacattttgtgatctgttaccaaagggtctaaatatctaaatgtttaagtaacattatgtataaaaaagaggatgacaggaatgcctatggaaaaattctgttgttcagtactgaagacctaaacatttgtcacaagggcagtaccatccactatttacacacatttaaaattattaatgtgaggtccaggtttgccagttataacaaacttgttttcttaaaagtgagttagtggtgccaggcgtggtggctcatgcctgtaatcccagcactttgggaggctgaggcaggtggatyacttgagcccaggagctcaagacaagcctgggcaacatggtgaaactccatctctgcaaaaaatacaaaaattagtcaggcatggtggtgaatgcctgtcgtcccagctacttgggaggctraggtgagaggatcacctgagcccaggaggttgaggctgcagtgagctgtgatcataccactgcactccagcctgggtgacagagtgagtgagaccgtgtctcaaaaaaaaaaaaaaaaaaaaaaaagagtgaattgagaatttacataaagctcatgattctcttgtgtttcatgattgatttgaggtggaatggagaatataaagcagcacaccttcaccttggctcagtatacctacrtggccctgtcctctctccagtaccccaatggagcccctgtggtgcggatttacagcgattctgagttcagcagccctgaggttcagggcccgatcatcaattttaatgtgctggatgacaaagggaacatcattggttactcccaggtgggttttctttccatcctgctgactttattacaactcatcctagttccagacgagagcaatgcagtgtgacaaagtccatgcactgttgaagaggccaccaggccctcagccacatgcctttccaccttcattcaccctcgtttttcagtcctctttactcagccaaaagtggtaactttcaaatgggaagaaagaggccagttcttctgatggcaggtgggaaactgttgggtctttgccatagtagaataagctgttcacttcacttcctggtccactaaaatgtccagagttgcactgagcactcaggcatggtggtaggtggttatcagacggggtgtcacagatggacaacaggaaccaaatgttactcccagagcagcactgtggggaatggattcaatcgttgggtgtttggaagacggtgctggtttttccttgaaagcacatctgcatccmcatttttatttatttttttgaggtggggtctcgctctttcacccaggctggcatgcaatggcatgatcttggctcactgcaacctccacctcttgggttcaagcaattctcatgcctcagccttccgagtagctgggattacaggcacacaccaccacacctggctaatttttgtatttttagtagatacggggtttcaccattttggctaggctggtctcaaactcctgacctcaagtgatccacctgtgttggcctcccaaagtgctgggattataggtgtgagccactgtgcctggcccacattttgtttttaacaaagaaaaaaaggtttatttggctcatggttctgttgactggaagattgggcattggtgaacaccttaggttgcttccacctgtggaggaaggcaaatgtgaactggtatgtgcagccagagaggaagcaagagagagggtgagggaggtacctggcactttatttttattttattttttcttccaactttttttttttttttttttttgagatggagtcttgctctgtcacccaggctggagtgcagtggcgtgatctcagctcactgcaacctccacctcttgggttcaagtgattctctcacctcagcctcctaaacagctgggactacggacatgtgccaccatgcctggctagtttttatattttagtagagatggggtttcaccatgttggtcaggctggtcttgaactcctgacctcaggtgatctgcccgcctcagcctcccaaagtgccgggattacagatgtgagccactgtgcccggcgttcttccaacttttattttaggttcaggggatacatgtgcaggcctgttacatgggtacctgaaaggtagtttctcaatcttcccctccccccaccttctaccctcaagtaggccccggtggccgtggttttcttctttgtgtccatgtgtactcaatgtttagctcctaattataagtgggaacatgcagtatttaggtttctgtttctgtgttaattcacttaggataatggcctccagctgcatcatgttgctgcaaaggactggtttcatttttttgtggctgtgtagtatcccagggtgtaaatgtaccacatttctttaaccagtctaccactgatgggcatataggttgattccatgtccttgctgttgagaaaagtgctacaatgaagatatgcatgcatttgcctttatggtaggatgatttatattcctttgggtatataccagtaatttaattaaggaattgggatggctggattcaatggtagctctgtttgtttgtttgagacagtctcactttgttgcccaagctggagtgcagtggagcaatctcagttcactgcaaactccgcctcctgggttcaattgattctcctgcctcagcctctcaagtagttggaattacagatgtgcaccactacgcccggttaatttttgtatttttagtagagacagggtttcaccatgttggtcaggctggtctcaaactcctggcctcatgcgatccacctgcctcagcctcccaaagtgctgggattacaggcataagtcaccatgcttggccaatggtagttctgttttaaattcttttagaaatctccaaactgttttccacagtggctaagctaatttacattcccactagcagtgtataagtgtttttttttatccacaacctcagcagcatatgttaatttttgaccttttaatagccattccaactggtgtgagatggtatctcattgtggttttaatttgcatttctctcatgattaatgatgtcgaacatttttttcatatgctattggctgcatgtatgtcatcttttgataagggtctgttcatgttctttgcccatttttaatggggttctttgttttttgcttattgatttaagttccttatagcttccagatattagacctttattagatgcatagtttgcaaatattttctctcattctgtaggttatctgtttactctgttgatagtttcttttgctgtgccaatgttcattagtttagttaggcttcatttgtcaatttttccttttgttgcaattgcttttggagtcttcatcatgaagtctttgtcaaggcctatgtccagaatgacatttcctacattttcttctaggatttttatagtttcaggttttacatttaagcctgtaatctgtcttgagtttatttttttatgtggtgataggaaagggtcccatttcaatcttctgcatatctatagccagttatcccagcaccatttattgaatagggagtcttttccccattgcttgttattgtctactttgtcaaagatctgagggttgtaggtgtgcggctttatttctgggttctctaaccttttccgttgaatttatgtgtctgtttttgtactagaaccatgctgttttgattactgtagccttgtagtatagtttgatgtcatgtagtgtgatgccttcagctttattctttttgcttaggattgctttggctatttgggctcttttttggttccatatgaattttagaatagttttttttctaattccatgagaaatgacattggtagtttgataggaataacattgactctgtaaattgctttgggcagtgtgaacatcttaacaatactgattgttcctatccatgagtatggaatgtttttccatttgtttgtgtggtgtgtgatttcttttagcggtattctgtaattctcattgtagatatcccccctggtaaggtggattcctaggtattttattatttttgtggctattgtaaatgggattgcattcttgatttggctttcagcttggtcattattagtgtataaaaatgctactgattttcatgcattgattttgtatcctgaaactttactgaagttgtttattagttctaggagcctttgggcagagattatgggattttccgggtatagaatcatgttatcagtgaagagagataggttgacttcttctcttcctatttggatgtcttttatttgtttctcttgcctaattgctgtggctaggacttccagtattatgttgaaaaggagtggtgagagaggtcatccttatcttgtgccagttttcaagggaagggcttgcagcttttgcccattcagtatgatgttgggtgtagttttgtcatagatgggtcttgttattttkatgtatgttccttggattcctagtttgttgggagtttttaacagaagggatgctgaattttgttataagccttttctgtgtctattgagatgatcatgtggtttttgtttttagttctgtttatgtaataaatcacatatattgatttgtgtacgttgaaccagctttgcatcccaggaataaagcctacttgattatggtggattaactttctcttcttcttttttttttttctttcttggagacaaggtttcactctgttgcccagactggagttcagtggcatgatcttggttcactgcagccttgacctccctggcttaagtgatcctcccacctcagcttcccgagtagctgggactacaggaacatgccaccatgcccagctaatttattttaatagttttttattgtacaggtggtttttggttacatggataagttctttggtgatggtttctgagattttggtgcatccgtcacttaagcagtgtacacattgtacccaatatgtagccttttatccctccccaatcccacccttcccccctgagtccccaaagtccattatatcattcttatgcctttgcatcctcatactttagctcccacttataagtgagaacatatgatatttgattttccattcctgagttatttcacttagaataatggcctccagctccattcaagttgctgcaaaggccattgttttgtttcgttttatggctgagtagtattccatgttgtgtatataccacattttctttatccactcattggttgatgggcattgaggttggttccatatttttgcaattgtgaattgtgctgctataaacatgtgtgcgtgtgtcttttccacataatgacgttttctttgggtagatacccagtagtgacacctggctaattttttggcattttttgtagagacagggttttgtcatgttgcccaggctggtcttgaacacctgagctcaattaatctgcccaccttggcctcccaaggtgctgcgattacaggtgtgcaccactgtacccggctggattagctctttaatgtgctgctggattctatttattagtattttgttgaggatttttgtgtctatgttcatcataggtattggcctgaagttttctttcttcattgtatctctgccatgttgtggtattaaaatgatgctgtccttatagaatgagttagggagtcaatccacatttgttaaaccctagatttcccaaacaaaattcatttcccaaggaatctttttctccacttttctgagtagccataaactttctaaagaatactattgggcaatattcttctgggggagatgtcggtcctcactggtgttcagggcagacactgtacagccacaggtggtctcttgagtatggcagctgtgcagaccccttgcccccactgccctcagctgtcagtactggcagaaccagccctgacactactaagaagcacaatattttaaatgcttttggaggggacaaggtggaaaatgcatcagaggcaaaaggtttgccttcttaaatatgttattctaggtcattggtaacataagttttattcttgaatcaaaagtaaatgtgcctgggtgcggtggctcacacctgtaatcctagcactttgggaggccgaggttggtggaccacctgaggtcaggagttggagactatcctggccaacatggcgaaaccctgtctctactaaaaatacaaaaattagctgggcgtggtggcacacacctgtaaccccagctactcagaaggctgaggcaggagaatcacttgaacccgagaggtggaagttgccatgagctgagattgtaccactgcactccagcctgggtgacagagcaagactctgtctcaaaaaaaaaaaaaaaaaagtaactgtgtgtgctgtggcagtggcatgggattggtagtggagaagaagcctccaagaagaagaatcaccagggtgtgaggctgcctgtgtgggtgtctggggactctcattccccagggctagacacaggatgagtttctccctctgtgccttggtagaggaagctcattgtgtgaatggattctgtggctaaggcatgactaactgtgccagttcaagaaagtgcagttacggttttttcaggttcagggaacttcacgatatgggaatttccacagggattttggtggccttcggaaacatcagctgggtttggctgtctctttttcatcaggggatgtgtaaagaatttagcttcctatgagaaggctttgtgttcttgttttggtatatccaggcttctaattttattctcccactgttggaagtcactgcatggtgattaagagcagggactcagagtctgtctgcctcttgccagctctgtgaacttgggcaagttaagttctccaagactctgtgaaatggggataacaatataccctgattatagtgttgatatgaggattaaatgagacacaatatatacatcccttagcacaggacccagaagaaagtaagtgctcaatgaatgttgggcacaaaggctcccgggctgggagcctccagggcattgtggctgggcctgtttctcagtcctccctgaatgctgtgctcatcctgccatagaaaacaacctccttcacctggctgggcacagtctgggcctgtgtgggattccccagggctgagggcaagaagagactgatgcataaaagggaaattaggacaaagggtaagtgtggctgcaacagcatcttctgctcacatcctctcctgccatgagactttgacactcctccatggagggctggggatctgtgggtcttcccctagaatctgggctgatctgtgactcgctcatagctaacagagtgccgggaggatgacactgcatggcttctaaggctagatcagaagagatgatgccctattggctttgttccctgggacactagctttggagcctggagttacgctgtcagctactgtctcgagccctgaggctgctgtgtgtgctgcaaggatgccaagccacatggagacgccaagctcaggactgtggctggcggtcctaattctgaagcccttccagcctgtggaccagaaagacccaggagtaaaggagtctccagatgatcccaacccccagatgccaaactactcccagactttgagtcttcctagctgagactccagacattttgagacagacaggagacatctcctccatgccctgtttaaattcttcccacactgtagccatgagctgcataaaatggttgttgttttattctccctagtttgggtggcctacttcacagcaaaagtaactggaatggtgaatatgggggagtgggtgaggggcagccacggggactctaattcagcctggtgggagctggacgggggtcgggggtctccctagtagttgccttgtgacgggaaacctgacctggagatggagttggccaggcccagtagagctgccaggactcaccttagagctgggaaactcctgaattcactagcaggtctgcatgccagtgggccattagccaagggtgaaggaacagaattgttcatctgaagcccctcagttcaacccagagaatggcttcttctcacacaccagaggagatggccaaagtgaagactgccgtggtcttgataagggtctgtgggaggcatcgttgcccagccaagatccctggctgaccacacggtgacctctggccaccccacatgtgacttcccagggagaaaaattcaaaggctcactcagctgagcaagatgtgtttattttcctgaatgcagttcagtgactcctcctcctgaattcagcctgagcccccagggtgaggactcttactgggcccccaggcccttggggaatggagtacttgattcacagcctggaggaactggagcaaacatcccaggggctcatgtgaatgagaaccacctcccagagccttcagagggcaggaaagagctttgggaacttctggactgaaaagcaattctgtgattaaaccgaaagttggagaaagtaggaaaagcaaatcaattatactcagcatggacacagtaacacttggagtccaggctgcgagctgaggcggggctgctcggaataacacttcgcggggcctgctctgtggtccaaccctgtgcagctgatgccaagaagccactgtctccagccccactgaaacattttatacaacgtttaacctgtgataaatcattttagaggacaattccaggcttgtatcatcattttattattaggaaagagaggtccaaatcctgatctgaatctctcagagtaaaactgcacgttggtaatggctcattccatgttacattaaatccgcaggtggacaaaatggccagtctttacaacatccacctgcgaactggctgcttctgtaacactggggcctgccagaggcacctgggcataagcracgagatggtcaggaagcattttcaggttggtacagggctctgcgatccagacgctggtcagcgagacccagcaacacctgttgctgcctgcgtgtctggggtgggggctgctgctgcatactcatttctccacgcctactctgtgcatgtacaaaggaaaaggaatacaaatggaaaatgcttcaagaaggccgggtgcggtggctcacgcctgtaatcccagcactttgggaggccgaggcaggtggatcacctgaggtcaggagttcgagacaagcctggccaacatggtgaaaccctgtctctactaaagatgcaaaaattagccaggcatgatggcatgcgcctgtaatcctagctacttgggaggctgaggcaggagaatcgtttgagcccaggaggcagaggttgcagtgagccgagatcgcaccattgcactccagtgcctgggtgacagagcaagactccatccccgtccaaccaaagaaaaaaaaaaagaagaagccgggcacggtggctcatgcctgtaatcmcagcactttgggaggccgaggtgggcgagtcacctgaggtcaggagttcatgaccagcctgaccaacatggagaaaccctctctctactgaaaatataaaattatccaggtgtggtggtgcatgcctgtaatcctagctagtcaggaggctgaggcaggagaactgcttgaacccgggaggtcgaggttgtggtggtgagctgagattctgccattgcactccagcctgggcaaaaagagcaaaactcagtctcaaaaaaaaaaaaaaaaaaaaagaaaaaaagaaaatgcttcaagatattatctctatagcagactttcagattcattttttactttgaggccaaccatttaaaggcaagggaggggtgttaacaagggatgtgtgaggatgtgcccttacctggttcagccctcctgaggtacggcctccaagctagagttagctgacatctgggttgggtgcggtgtggaactcttctagggctccagggattctgcgtctcccagaatccccaccctccctgtctcttccctgggctgaggtttttcacttcagggtatagcctgttttgaaccatttcattaggaataatttgagtggcaaagagtgtttattgatttgagtttctaatttgattttcctttggttgctgtgaaatactgtatatactagatctcaactaaccatgaactgagttttgtttaaaaagaaagagggataggacagaaggagagggaggagataggagagagggaggagaagaaatagagagggagagggaggctcagaacacaaacacagctccagatagaatatttggtcctatggaacgctgtggctccatttgttygggtgtctgacccggatccagcaccaaggtttgtccaggactgctccatgcactgtgctgacctgtgaccaacaccaggcagccgggctcggagactgagattctcctgcctttcttccccatctccctgcaggggcactcaagctgaccttggccttcacagtggcccggggctggtcatttgcaggggcagcatctctgcctttccctgttgtcaaggggcagctctcagggatgcaggcctcccctcagtaatgagaggctaacgagagtgaccagtgatgtttctcccatctcagccccgggtagaccttgaggttgaccccttggtgcttctgaaaccttagtctgtgttttgacacctctgtgagccagccctgtgcctggctctaggtaaatgctttccatgaagtatttctattaaacttttaatggccccttgagattgatattggtcccaatttacagttgagcaaaatgagatccagaaagtggtcccctgcaggtagagagctgaactatgtcccagaygcacagcacatattaatgttgcagttctgttttcctgggttaattttaaaattaacaaaatttattttgccgaactgtttccartgtctctatgagaaaggggtcactctggctgatgcacttccctcttatcctaggctggtcatgtctgtggggacaatatggacctcatagatgggcagcccacaggatctgtgaggatttcatttggatacatgtcgacrctggatgatgtccaggcctttcttaggttcatcatagacactygcctgcactcatcaggggactggcctgtccctcaggcccatgctgacaccggggagactggagccccatcagcagacagccaggctgatgttatacctgctgtcatgggcagacgtagcctctcgcctcaggaagatgccctcacaggctccagggtttggaacaactcgtctactgtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtaaggaatttcacagcagcacagaaagtcttctctttgtttactctctctattttttgataaagtgaagaaaagcatgaaaaaaatcaaaatcattcatcagagtgttgtggtgagaaaagccattctcactctccctttcttggtctgtgctgacttttgaacatgactgctcacggggactcctgagaggaccctgtttctgagtggtgaatgtgtcattactcttattaattatagctgtaactttcactgaatgtgtgtgctggctgtgtgctgaagcattgtatgtgtttatttgtttcatttgatccttaaaatggtgaaatatgaggtagatagtaatattatccctattttatagatatggagcctgagggttttgaggttaagcactttgcccaggtgacctgaagatatgtcaaaaggacacaagagccagcttgaaggagctcccgttggccaagtctttggcaatatgtacatcaaaataagtactgatagtgatgagtggtgagcatttgagaaacacaggaatccatgagtccagtagaaagtaaaaatgaattagcgaataaatagagaagaagctcaaccctactatagaataccaactaataaatcaatgatagaattttaaaaactaccattttgcaaccatcatgccaataattgatttaggcaatagtcatcaatagatgctaaatctaatgaatgaaaatttgataagtaacaggatatctgcatattctgaaaatatctctccataaaatacttattaattagtaagtaccgcctacttattgatgaattttacaatggagaaacctaatagaccccatgttaaccaagtggcaaaagttgacatcaccaacattgggacaaatgaatggggtgtgtctcctgggatgtacagagaagaacatagcgttggtcctgaggcattcctaccaaaaatgcagaaataataaggaagctcagataatcccaccttaagagacatttagcaaggtagctggactctacttctcaaaaatatcatggttgtgaaagacaagaggagactgaaggagactagagagacgcgacaaatgtatgcaacgtgatattcsatgcagacagcagaggtggaatctgaatggagtctattgattagttgtaatatcaggtcaatggtaattcctaattttgatggttgtactggggttatgtcagagagtgtccttatacttagaatatgtrcagtagagtattatggggatgatgagacattattttgcaacttattctcaaatgatttagaaaagtcaacaatcagaattggagtgaaacgtttatgggagctctgtgaactgtaactacttttatttaagcttaaagtatattaaaaatattaaattttaatttttctaaattgtggcatcagtaaataatgttacttttttttgcatctttactactgagggtagctgggctcccttatgtgtgcactgcagggacatctatgactagttctgtggttggaactctgaacctttgcctttgtccacacccttcttcagcagacagctggctcaggaaaagccctcattgaagggacattgcacccatgctatcacttgctggtgctgttaaaacctaacctgtggacaaccgctcctgcaaagggcaggagcaggaagccagcagagacgaaattggactaattctctctgtactcagagaaagcacatccttgctaaaataaaggttcaaagaagaaacgagatgaaaactgaattggtcttgtagcttaggaaataagtggaggggatgtatgaaacttacagaatgtaacccacagctgtttattcccaactaaacccccagatggcttagggaaccaccatgacatcttgtgaggatgctgcagcctttcctcaatgtgggcctctgtttctgaacttgggcccttctcacaattacatgaagctgcttctattgctccacagctgaacttctataccagaayggtcaacccaaagaacatcatctccattagtttaggatctcaccatcttgcaaaagcaggatggggcgacaaggcttggcatctgtggtaggtgaacccagagatatggtggaaggagcagcaggagggagctgctggtgggacggctacacctcttatacaggtcagctgtaggctgggaaactgcacttcagagaccctgatggaaggaaaacaagcaaagttagaaataatcaatgcctcttgttattctgtgatgtcagcttttgatacctatacccacctaactggtggttttaattttttccatcagcagactctgtcaaatttaattttaccttttatggytttttttttttcttttagagaaacacaccaccaggaagaacatttgtaccttatcttccgggtcttcgaaaaagccagcatctttttggggaaacagtttaaaactagtttctcagggagctttcttctgtgctgaaagacttcttacttgctactcactttatccatttattcatttgcttattattattttttcgagatgggatctcactctgtctcccaggctggaatacagtgctgccatcaaagctcactgcagttttgaactcctggtctcaagctatcctcccgcctctgcctcttgagtagctgagactacaggcatacaccaccatgcctggctactttttaattttcattttttttagagacagggtcttgctatgttgatcaggctggtcttgaactccttgcctcaagtgatccccctgcctcaacctcccaaagtgctggcrttacagacataagccactgcgcccagctctactcactttattttattttatttatttatttatttatttatttatttatttatttatttatttatttttgagatgaagtctcgctctgtcgcccagactggagtgcaacggcacgatcttggctcactgcaagctccgcctcctgggttcaattgattctcctgcctcagcctccagagcagctaggactacaggcgcctgccatcaagcccggctaatttttgtatttttagtagagatggggtttcaccatgtcggccaggatggtcttgaactcctgacctcgtgatctgcccgcctcagtctcccaaagtgctgggattataggaatgagccaccatgcctggctatttattattattattattttattttattttattttttgacacagagtctcactcttgtcgcccaggctggagtgcaatgacatgatctcggctcactgcaacctccgcttcctaggttcaagcaattctctcagctgattttttgtatttttagtagaaaaatatgtctatactattatgaaatacctggacagacaccactgctaaggaaggatatacaagagcaaaggggtgggcgtggtggctcatgcctgtaatcccagaactttgggaggcaaaggcaggtggatcacttgaggtcaggagtttgagaccagcctggctaacatggtgaaaccctgtctttactaaaaatacaaaacttagccgggcatggtggcaggtgcctgtaatcccagctactcaggaggctgaggcaggagaatagcttaaacccaggaggcagaggttgcaatgggctgagattgcaccactacactccagcctgggcracagagcaagactccatcttaaaaacaaacaaacaaacaaacaaattaaaaaacagcaaaaaaagagcaatggctggagccagctgggaaaggaggcttgcttttcactgtagactcttgtactctctgaatgtcaggcattacctacttaaaacatggctcgaagtggagaagggtggagtgtggacctggaggctgaatgggagatatccagctcctacatcatcttctttgcacwgtcctctctgttttagtttcttctcttcctccctttcttccttccagtgtaggtgctgaattcatgaagtytatctgtgtttgtgtagccactgtacaaataggtgaagaccaactttggggagccctggcctgagacacgtctacctttttgtttaggtgaccaggtggcctgtaggaaaccaagggctgctatatgaccggagctggatggttgtgaatcacaatggtgtttgcctgagtcagaagcaggaaccccggctctgcctgatccagcccttcatcgacttgcggcaaaggatcatggtcatcaaagccaaaggtgggaaaactgcttcattttcacagagcagctcccaacagcagcttttatattcatatgaaatactctaccaagtgttagaataacccatcagcctgggcaatacagtgagacctcatctctacaaaaaaaaaaaaaaaattatcctgggtgtgggagcacgtgcctgtaatctcagctactcaggaggctgaggcacaagaatcacttgaacccgggaggtggaggttgcagtgaatcgagatcatgccattgcattccggcctgggcgacagagcaagaccttgtatcaagggaaaaaatgggtaaaataacctgaaagtaagggaaatagtgtctaggaaacacaacaaagagtttgttccccttgattttgggaaatttcgggagacagaaagatctgacagttcaatcagacggtaaagaggggccaggtgcggtggctcacgcttgtaatcccagcactgcagaggtgggcagatcacttgaggtcaaaagttcgagaccagactggccaacatgacgaaaccccttctctactaaaaatacaaaaagaagctgggcatggtggcacgtgcctgtgatcccagctacttgggtacttgggaggctgaggcaggagtatcgcttgagccccagaggtggaggctgcagtgagcccagatcgcaccactgcactccagcttgggcaacagagggtgatgatgtctcaaaagaaaaaaaaaaaaaagtataaactttatattaattagatgatgtcctatttacttaagtttcttttattttcttcactcatcatcatgtatactgcaggctttaattcatccttgttgattttgttatgagtgacatgaatgatcaaaccaatagaaaagtataggcccactctgtttagtagaactttctgtggtgatgaaaatgttcaaactataccttgtccagtttagtggccaccagtcacttgtgactattgaaatgtggctagtgggacactagaactgaattttaaattttacttaattttaattagtttaaatagctacgtgtagctatgctacagtgttggacagcacgggtataaagaataatacacaattacagcattcaattttagcaaatcttaacatttggccacatttcctttaggtcctcctcctcctcttcctttttcttttttagcacacatacgtacatacataaaacattacatagcagttgtggtgctgggttaaaaaaaggtaaaagacattacagatacagcagaaatttcctgtggacctctcctgagtcttactcctcctcctttcccattccactaacttgcagttgtacttttgtgatatataacatttccatatattcacgattgtgtttcttggctgtaagtgttctgttctgttctgttctgttctgttctgttctgttcccgtggtttatttttccttgaaccaagaggccagtgttattactagagttatagaataagtcttgatatcccattgttkttttttttttttgagacagagtttcactcttgttgtccaggctggagtgcaatggcrtgatctcggctcactgcaacctctgcctcctgggttcagcgattcttgtgcttcagcctcccgagtagctgggattacaggcatgcagcaccatgmctggctgattttgtatttttagtagagacagggtttctccgtgttggtaaggctggtctcgaactcccgacctcaggtgatctgcccaccttggcatcccaaagtgctgggattacaggcataagccactgcgctggccctattatcccatttgtttaaattgtctgttgtcacatattgcagaatctcttttaagattgagtagtattccattaaatgagtataccatatttactttattcatctcttaatggacatttagattgtatccatatcttggctattggaaatagagctgcaatgaacattgggagtgctaatatctcttcggtatcctggttgaaattattttggataagtacccagaagtgggatcactggatcatttgatagttttatttttaattttctaagaaatctcaatattgtttttcatattaactgaaaaattttacatacccaccagtggttgcaagggctcaagtttttccacattctcgacaacacttacttactgtcttttgtttgttttcttttgacaatagccatcctgacaggggtagagtgatatctcattttgatttcaatttgcatttccctcattattagtgatgttaaacattttccatatacccattgaccattagtacatcttctttggaggaatacctagaaataactattcaggtcttgaacccattttttttttttaattttttaatttttttttttttagagacagagcctcgctctgtcgcccaggctggagtacagtggcgcgatcttggctcactgcaagctctgccttccaggttcacgccattctcctgcctcagccttcccagtagctgggactacaggcgcccgccactacgcctggctaatttttgtatttttagtagagacggggtttcaccgtgttagccaggatggtctcgatttcctgaccttgtgatctgcctgcctcggcctcccagagtgctgggattacaggcgtgagccatcgcgcccagccactaacccatttttaaattaggttatttggttttctgtttgtttgtttactgctgagttgtaggagttccttatatatctttgaggttaactactttttcagataaatggtttgaaaatattttctcccattccacaggttgccttttcacttttttaattgttccctttgctgtgcagaagctttttagttggatatagtcccatttgtgtatttttgtttttgttacttgtgctttgggtgtcatattcacaaagttattgccaagaccaatgtcatgaagtttttcccctatgttttctgccaggagctttacattttgggatcttgtgcttaaatctctaatccatttgagttgaagtttttgtatgatgtaagataagggtccaattttattcttttacatgtggatatccagttttcccaacaccatttgttgaaaagactatcttttctccattgtgttttcttgacaccctttccaaagatcatgtaaccatatatgcatggatttatatctggactctctagcctgtttcattagtctgtgtatctgtctttgtgccagtaccatactgctttgattactatagctatagtgatatattttaaaatcaggaattgtgacaactccagctttgttcttctttctcaagattaattagtttatttgtcatcttttgtgggtctatatgaattttaggatcgttctttctatttctgtaaaaaaatgccattgcgattttgatagggattgcattgaatctgcggattgctttgggctctatagacattttaacaatattaattcttctaatccatgaacatggagtgcctttccatttgtttaatttcttgtttgtgtcttatttctttcatcaatgttttgtagttttcagaatgtgagtatttcacctccttagataagtttcttttgttcttttaaaagagatttagggtctcactctgttgcccaaactggaatagagtggcatgatcacaactcactgcagccttgaactcctgggctcaagcaatcctcctgcttcagcctcctgagtagctgggacaacaggcatgtgccaccatgcctggtctagatgagttcatttctaggtattgtactcttttttttgtgctattataagtgggattggtcttcttatttccttttcagagagtttgtttttagtgtatagaaatgcaatagatttttgcatgttgatgtgtatcctgtatcctgcaactttactgaattcatttattagtttaacagttttttaaaatggagtatttagaattttttgaatatataagatcatgttttttgatcaaacaaggacaattttacttcccttttccaatttgaatgtcttttatttctttttcttgcctaattgctctgactagaacttccagtactatgtcaaatagtggaggcaagaatgggcttctttgccttgttcctgatcttaagagaaaaagttttcagtttttcatcatggagtataatgttagttgtaggcttttcatatggcatttattatcttgaggtaacatgttctattcctaggttattaagtttttattatgagagggtgctgaattttgtcaaatgctttttctgtgtccattgagatgaatatgtaattttctcctctattctgttaatgtagtatgtcacattaattgattttcatatgttgaatcatccttacatcccaggaataaagctcactttctcatggtgtatgatccttttaatgtactgttagattaagttttgttgaggatgtttgtgtttatattcgtcagggatattggcctgcagttgtctttgcctgcctttagtatcaagataatgctggcctcataaaatgagtttgggaatgttccctcctcttagtttttaagtagagtttgagaagatttagtattaattcttctttaaatatttgatagcattcagcagtgaagccatttggatgtaggcttttctttgttgagaggtttttgattactgattcaatcttcatactagttgtaggtttgctcaggctttattttgttcatgtttagtttcgatagatrgtatgtttctaggaatttattcatttcttctaggttatccagtttgttggcatatagttgtttatagtaatttcttagaatattttatttttgtggcattatttatagtgtctcatttcatttcagattttgagttttcaatttttcttttctttttttttgttttgtttgtttgtttttgagacggagtctcattctgttgccaggctggagtgcagtggcacgatctcggctcactgcaacctccgcctcctgggttcaagtgattctcctgcctcagcctcccgagtagctgggactacaggtgcrcaccaccatgcccagctaatttttgtacttttcgtagagagagggtttcaccatgttggccaggatggtctcgatctcttgacctcgtgatctgcctgccttggcctcccaaagtgctgggattacaagcgtgagccactgtgcccggcaagttttctatttttcttagtctagataaaagcttgtcagttctgtttttcaaaaatccaacttagttttgttaatgttttccatttttcaattttatttatttccattgcaatctttgttgtttcattccttgtgctaaatttgggtttactttgttctcctttttctagttccttgtggtgtaaaattaggttgtttgagatctttcttcttttttactgtagacacttactgccatgagcttactatttagtactgcttttgccatatcccataaattttgatattttatgttttcatttgtctttggtattttataatttttaaaattttcttctttgatcaaatggtcatttaagagtgtgttgtttcatttccacatatwtgtgaatttttccattttcttgctgctactatttctagtttcatttcattgtggtcagaaacttgatatgatttcaatctttttaaattcattgtctttttttttttttttaagtcttgttttaagacctaacgtgatctatcctggagaaagatccgtgtgtgccttagaagaatgtgtattcttctgctgttgggtgaaacgttttatgtatgtttgttaggtccatttggtctacagtatgattcaagtcctcccttgatcttcagtttgcatgttctgtccattattgaatttatttttsttttgctgtctatttctcctttcggttctgtcaatgtttgctttatgtatttaggtgctctgatgttgggtgcatatatatttataattgttatatactcctggtggattgatcattttatcatcataaaatgtccttctttatctcttgtgacagtttttgacttaaagtccattttaatggacataattatagccactcctactctcttttggttaccatttgcatggaatatctttttccatctgtttactttcagtctatgtatatccttaaacctaatgtcagtttcttttaaacagcatacagttgggkttttttttatgtctttttatgcttctttttttttattcagccactctaagtcttttgattggagagtttaatcaaatatatttagagtaattattgataaggatttaatattgccatttggctagttgttttctgttagtcttatagttcttttgtctgtcttttcacctcttgctgtctttgtgttttgttgatattttatattaatgggctttaattcctttgtcttttcctttttgtgtaacttctataggttttttcttttttttttttggtgtgtagttatttcgaggcttacataaaatatcttagagttataacggtctattttaagctgacagcaagtttaatcacatacataactctacactttaagctttgctccccatactttacgtatggttgtcaggatttacatctattcatgatgtgtatctttttttttttttttttgagacagggtcttgctctgttgcccaggctggagtacagtggtgtgatcttgactcactgcaaactctgccacctaggctcaagcaatcatcccacctaagcctcctgagtagtcctaagctaagtcctaagctaagtcctaagcagacacatgccaccatgcctggctaatttttgtatttttttttttagagacagggtttcaccatgttgctcaggttggtcttgaactcctgaacttaagcaatccatcctccttggcctcccaaagtgttggaattatgggcatgagccaccacccctggcccatatttgtatcttttaacacatatgtatatattttaagagatgtggtctcactctgttgcccaggctggagtgcagtgacatgatcatagctcattacagttttgaactcctgggttcaagtgatcctcctgccttaccctaccgagtagctgggactactgatatgtgctgccatgcccagctaaattttttttttttttgagatggggtctcgctctgtcacccaggctggagtgcagtggcatgatcccagctcactgcaacctctgcctcctgggttcaagagattcttcttcctcagctttccgggtagctgggataacaagtgcatgccaccacacccagctaatttttgtatttttagtagagatggggtttcaccacgttggccaggctggtcctgaactcctaacctcaggtgatctgcctgtctcggcctcccaaagtatggggattataggtgtgagccactgtgcctggcccatgcccaactaaatttttaaaacttttaaaaagatgagttctctccaatctaggcaataccattcaggacataagtaagggcaaaggtttcatagtgaagacagcaaaagcaattgcaacaaaagcaaaaattgacaaatgggatataattaaactagagagcttctgcacagcaaaaggaatgatcaacagagtaaacagacagcctatagaatgggagaaaatttttgcaaactatgcatctgacaaaggtctaatatccagcatctataaggaacttaaacaaatttacaagaaacaaccccataaaaagtaggcaaagaacatgagcaaacacttttcaaaagaagacatatatgcagccaacaatcatatgaaaaaaagctcaacatcactgatcattagagaaatgcaaatcaaaaccacaatgagatatcatctaacaccagtcagaatgagtattattaaaaagtaaaaaaataacagttgctgatgaggttgtggagaaaaaggaatgcttatacaccgttggtgggactgtaaattagtttagccattgtggaagatagtctggtgattcctcaaacacctaaagacagaaataccatttgacccagtaatcccattactgggtatatacccaaagaaatataaattattctattataaaaacacatgcatgcatacgtacatttgtgacacaattcacaatagcaaggacatggaatcaacttaaatgcccatcaataatagactggataaagaaaatgtggtacatatacaccatggaatactatgcagtcataaaaaagaatgagataatgtctttttcagggacatagatgaagctggaggccattagccttagcaaaccaacataggaacagaaaaccaaataccacatgttctcacttataaatgggagctaaatgatgagaacacatgaacacatagaggggaacaatagacactgagacctacaggagggtggagggtgggaggatggggaggatcaggaaaaataactaatgagtattaggcttaatacctgggtgatgaaataatctgtataacaaacccccataacgcaagtttacctatgtaataaacctgcacttgtaccacggaacttaaaagttgaaaaaaaaaaaaaaaaaagatgagatctcgccatgtttcccaagctggtttcaaactcctggcctcaagaaatccttctgccccagccccctagtagctggaattacaagcattagccattgtggactgcatatattttaacctatttttgtagttattctttaatacttttgtcttttgacttatttttgacatatttttgtagctattttaaatatttttgtcttttgacctttatgctaggattaaaaatgagttacccactaccaatagtaacataatattatttatttgtctacatatttactttatagcaaatttcatgctttcttatgctattgtgttgttgtttagtgtcctatagtttccacttgaggaactttcttttgcattttttataaatcaggtctagtagtgataaattttctcagctttttcttggtatggtattcttgttggcaggtttgtttcttttaatagtttgaatatatcattctactttgtctggcctacaaaatttctgctgaaaaaaatccactgattgtattatgagggttcccttgtatatgacaagtcagttttcccttgcctttttccttccttttgacttttggcaatctgattatatgtgtcttggcgtggattttttcagatttatcttatttggtatctgttgggctttttgaatttggatgtccattttcttcctggatttgggaagttttcagccattctttctttgaataagctttcttttcttttctcactcttttcaaagttttagactcccataatgtatatattggtccacttgatgatgtctcataattcccctaggcttacttcactgttttaaatttttacttctttttgctcctctgactgaattatttccagtgacctgtcttcaagtttgcttatcttttcttttgctgatctagtctgctgttgaacctctcttataataaattttttagttcagttactgtgtccttcacctccatgatttctatctggtacttttaacattttctatttccttgtcgaactattcattttgttcatgcactgttctcttgactttggtgactgtctttatagagttattttaaactctctgtcaggtaaaccatattactctgtttcattagggtcagttgctggaaatttatcttgttcttttgtttggaacatctttgcctgattcttcattttcctcaagtgtctgtgttggtgtctgtgcattacttgtttgtttctttgtttcaagacatcttgctctgtcacccaggctggagtacagtggcacgatctcggcttactgcaacctttgccctgaggtttcaagcgattctcatgcctcagcctcccgagtagctgggtttacagctggtgtgcaccactacaccaggctaatttttttgtatttttagagatgggatttcaccatgttggccaggctggtctcgaactcctgacctcaggtgatccacccaccttggtctcccaaagtgctgggattacagacatgagccactgtgcccagcctgtgtctatgcattagacaaagcaagcaactctcctagtcttcaccgactggcctcataaaagaagacccctaccaatcagattggccagagattcagggggtcactaccaactctttcgtcccttaggataatcaggcaactatgttttctatctgcttatggtgcgatgagcactggggagctcaagatgctacctccattctcttgcgagtggcttcactgtgccaggcccatcagagctctaagactgagaagacagaagccagtcctctagggagctctcttggaaaggttggggtgctagacacacaaaccagccccttctcttccctgagtgaagctgagagtgaggggctctcttcctgattgtatggcactgcactgtgggccaggtgtctgtggagacggtgctggaaatctccctaccagtttcagtgagtctggtttcatgttctggggttcaggagcctgtcaattaggttctgatttccatgtcatcttctaataatgatagttttgtacctttctttttcatttttatttctgttaatttttgtcttactgcatttgttaatctttcctatataatgaggaatggagcactgatggaagacattcttctttattaccaacttgagtggaatgcttctgaagtttcaaaaataagaatgatgtttattgtaggtttttgattgatttattttatcaggctaaagtagttcttttcctattttgccaaaatttttatcatgactaaatttatttcttactgaacgctttttctgtatttgtttatcatattttttcccataagctattaatatgatgtattacattactagattgtctataactgagctatatatttggtatcttaaggaaaaagtacacttggcaatgactttctaatacattgctgggtttggtttgctaatattttagtgatgtttgtgtctgtttttatcagtgagagtgattatagcccattgttattaaattattcttgttcaagttcaagtacccaggatattaacatacattaattattgttattttgaactgttacctatgcatgttacgcattcctttatatatatgatgtgtataacatagaaaaaagactagctttccaactctactgtgacatagtaagttttttgtttgtttgtttgttttgtttgtttgttttttagcaataacgatgattgatgcaggaatccaatttgatgctaactcctagaggctaatgagatttgacactctatgctgatatctttacagaatgagccttcatgcttgtctgtctatttctaaaggattgaaggtagcttagagaacaatgacccacgatgtggatgatccagaagtacagaaatctttcaaaataatttacagagtgtccctggggccttggatgtgatcgcccccattcaggctcttccataaaaaacttgctcagtgcacatactattggtggcactgataatgatgaagaaagtcttcatgttataaaaagatttctaagacccaggcacttccttgatccaaccaaattctagtgtcattaaaattcttttttttgttgttttggtttttttgagacacgttctcactgtgtcacccaggctggagtgcagtgacacaatctcagctcactgcaacctccatctcctgggctcaagcctcaagcgatcctgctacctcagcctccggagtagctgggaccacaggcatgtgccaccacatccagctaatttttgatattttcagtagagatggggttttgccatgttgcccaggctggtctgaaactcctgagctcaagcgatccacctgcctcrgcctctgaaattgctgagattccaggtatgagccaccatgcctgaccttaaaattattgtatatttcataataatgagctttgatttacagttattcctttttaattttgaacagatacagtaattgtacatatttatggtgtacaatgtgatactttgatacatgcatacaatatgtaataataaaatcagtgtaatgatcaaatcagtgtaattatatagcatattcatcacctcaaatatttatcatttctttgtgttgaggatgtttaaaatcctcttttctagctattttgaaatatttaataaattattgttaaccatagtcaccctattgtgctacagaatactagaccttattcctcctatatacctgtaattttgtacccattaaccaacctctccctatccccttctttatcctacccgtccctgcttttggtaaccactattctactctttacttctatgagatcaacttaaaaaattcccacatatgagtgagaacatgcagtatttgtctttttatgcctggcttattttacttaacataatgtccttcaggctcatccatgttgctgcaaataacataatttccttcttttttatggctgaataatattccattacacacacacacacacacacacaccattttctttatccattcattaattgatgaacacttaagttgattccataacttggctactgtgaatagtgctgcaataaaaatgggaatgcagatatatcttaaacatactgattttcctctccttcgttattattattattatcacttcaatagtttttgggaaacaggtggtgtttaggtacatgggtaagttctttaggtgtgatttctgagattttggtgtactcatcacccgagcagtgtacactgcacccagttgataatcttttatctctcaactcccctccacccttttctgcaagtctccagagtccattatgtcattcttatgtctttatatccccatagcttagtttccacttataagagagaacatacaatgtttgttttccattcctgaattacttccctaaaaataatggtctccaactctatccagattgttgcaaatgccattatttagttccttttaatggctgagtagtattccatggtgtttgtgtgtttgtatacccacatcatattttctttatccacgcattggctgatgagcatttaggctggttccatatttttgcaattgtgaattgtgctgctataaacatatgtgcacaagtgtcttttttatataatgacttcttttcctctgggtaaatacccagtagtagggttgctggatcaaattgtggttctacttttagttctttaaggaaactccatattgttttccatagtggttttactagtttacattcccaccagcagtgtaaagtgttcccttttcaccacatctatgccagcatcgactatttttcaatttttaaattatggtcattcttgcaggagtaaggtggtattatattgtggttttgatttgcatttccctgataattagtaatgatgagcattttctcatgtttgttggccatttgtatatcttcttttgaaaaatttccattcatgtccttagcccactttttgatgagattatttggtttttgttgctgatttgtttgagttccttgtagattctggatattagtccttcgtcagatgcgtggtttgcaaatattctctctcactttgtggattgtctctttacttttctgggtatttcttttgctgtgcagaagctttttaaattaggtcccatctatttatctttgttttagttgcatttacttttgggttcttggtcatgaattctttgcttaccgcaatatctagaagggtttttccaatgttaccttctaggatttttatggtttcatgtcttagatttaagtctttgatccatcttcagttgatttttgtataaggtgagagataaggatccattttcatgtttttacatgtggctggccagttatcccagcaccatttgttgaatagggtgtcctttccccactttgtttttgtttgctttgtcgaagatcagttggctgtaagtatttggctttatttctgggttctttattctgttccattggtctgtgtgcctgctttaataccagtgccatgctgttttggtaacagtagccttgtattatagtttgaagttgggtaatgtgatgccttcagatttttctttttgcttagtcttgctttggctaagtgggctgtttttttgtttccatacgaattttaggatcattttttcctagttctgtgaataatgatgacggcattttgatgggaattgcactgaatttgtatatttcttttaacagcatggtcattttcacaatattgattctagccatccatgagcattagtccatttgtattgttgtgttagcctgttttcacactgctataaagaaatacctgagactgggtaatttataaaggaaagaggttcaattgactcacagttttaaatggctggggaagcctcaggaaacttacaattatggtggaaggcaaagggaaatgaggaccttcttcacatggtggcaagagagagaagggcaaaggaggaacttccaaacatttataaaaccatcagatctcataagaacttactcactatcatgcaaacagcatggaggaaactgtccccatgatccaatcacctccctcccttgatatctagggatcacaacttgagatgagatttggatggggatacagagccacaccatattattctgcccctggcccctcccaaatctcatgtcttttaacatttcaaaaccaatcatgccttctcaacagtaccccaaaatcaattttttttaatttttttattattatactttaagttttagggtacatgtgcacattgtgcaggttagttacatatgtatacatgtgccatgctggtgtgctgcacccactaactcatcatctagcattaggtatatctcccaatgctatccctcccccctccccccacccacaacagtccccagagtgtgatgttccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatcctgaggaatcgccacactgacttccacaatggttgaactagtttacagtcccaacaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcctgtataaatgtcttcttttgagacgtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtggtttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagagaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaaggcattggtagcttgatgggggtggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagctggattcctaggtattttattctctttgaagcaattgtgaatgggagttcactcatgatttggctctctgtttttctgttgttggtgtgtaggaatgcttgtgatttttgcacattgattttgtatcctgagactttgctgaagttgcttatgagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaggttgttgaattttgtcaaaggccttttctscatctattgagataatcatgtggtttttgtctgtggctctgtttatatgctggattacatttattgatttgcatatattgaaccagccttgcatcccagggatgaagcccagttgatcatggtggataagctttttgatgtcctgctggatttggtttgccagtattttattgaggatttttgcatcaatgttcrtcaaggatattggtctaaaattctcttctttggttgtgtctctgcctggctttggtatcagaatgatgctggcctcataaaatgagttagggaggattccctctttttctattgattggaatagtttcagaagtaatggtaccagttcctccttgtacctgtggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgacggtagtttgtatttctgtgggattggtggtgatatccccttttatcattttttattgcgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaggttagggtgtcaattttggatctttcctgttttctcttgtgggcatttagtgctataaatttccctctacacactgctttgaatgtgtcccagagatgctggtatgttgtgtctttgttctcgttggtttcaaagaacatctttatttctgccttcatttcgttatgtacccagtagtcattcaggagccggttgttcagtttccatgtagttgagcggttttgagtgagattcttaatcctgagttctagtttgattgcactgtggtctgagagatagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccgtttgcttggtaggtcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggtgattttgctcgttacttgatgcagtttcttcctagacttgatgatcgttacattttggcatgattttgcagcggctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttaaatattggcccccactctcttctggcttgtagggtttctgccaagagatccgctgttagtctgatgggcttccctttgagggtaacccgacctttctctctggctgcccttaaaattttttccttcatttcaactttggtgaatctgacaattatgtgtcttggagttgctcttctcgaggaatatctttgtggcgttctctgtatttcctgaatctgaatgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaattttccttcttgcttcatttcattcatttcatcttccattgctgatactctttcttccagttgatcacatcggctcctgaggcttctgcattcttcgcgtagttctcgagccttggttttcagctccatcagctcctttaagcacttctctgtwttggttattctagttatacattcttctaaatttttttcaaagttttcaacttctttgcctttggtttgaatgtcctcccgtagctcagagtaatttgatcgtctgaagccttcttctctcagctcgtcaaagtcattctccttccagctttgttccgttgctggtgaggagctgcgttcctttggaggaggagaggtgctctgatttttagagtttccagtttttctgttctgttttttccccatctttgtggttttatctacttttggtctttgatgatggtgatgtacagatgggtttttggtgtggatgtcctttctgtttgttagttttccttcgaacagacaggaccctcagctgcaggtctgttggagtaccctgcagtgtgaggtgtcagtgtgcccctgctggggggtgcctcccagttaggctgctcgggggtcaggggtcagggacccacttgaggaggcagtctgcccgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagctgggcaatggtgggcgcccctcccccagcctcgctgccgccttgcagtttgatctcagactgctgtgctagcaatcagcgagattccatggggtaggaccctccragccaggtgcaggatataatctcgtggtgcgccgttttttaagcccatcggaaaagcgcagtattcgggtgggaatgacccgattctccaggtgccgtccgtcacccctttctttgattaggaaagggaactccctgaccccttgtgcttcccgagtgaggcaatgcctcgccctgcttcggctcgcgcacggtgcgtgcacccactgacctgcacccactgtctggcactccctagtgagatgaacccagtacctcagatgaaaatgcagaaatcacccgtcttctgcgtcgctcaggctgggagctgtagaccggagctgttcctattcggccatcttggctcctcccaacaaagtccccagaatcttaactcatttcagcattaactcaaaagtccacagtccaaagtctcatctgagacaaggcaagtcccttccacctaggagcctgtcaaagaaaaaacaagttagttccttccaagatataatggggtacaakaattgggtaaatatacccattttaaatgggagaaattggccaaaacaaatggtctgcagtctccttgtaagtctgaaatccagcagggcaggcattaaatcttaaaggttcaaaatgatcttctttgactccatgtctcacatccagatcacactgatgcaagaggtgggctcccatggccttgggcagcttcttcatgggctgaagttgagtgatggggcttttccaggtgcaaagtgtaagctgttggtggatctatcattctggggtctggaggacagtggccctcttctcacagctccactaggcagtgcccctgtggggactctgtggaatctccaatttcacattacccatctgtgctgctctagcagaggttctgcatgagggatccacccctgtgcagacttctgtctggatatccaggcattttcttacatcctctgaaatctaggtggaggttaccaaatctcagttcttgacttttgtgtacccacaggcccaataccacatggaagccaccaaggcttggggcttgcaccctctgaagcaatagcccaagttgtaccttggcccttttagccacagctggattgcgagtggccagaatgcagggcaccaaatcctgaggctacacacagcagtggggccctgagcctgacccgcgaagccatttttttcctcctaggcctccgggccgtgatgagaagggctgctaccaggatctctgacatgccctggagacagttttccccattgctttggcaattaacatttggctcctggttacttatgcaaatttctacagcagcgttgaatttcttttctgtagcacagactgtgaattttccaaactcttatgctctgctaccctccccttttaaatataagttccaatttcagatcatctctctcaagttgaaagttccacagatctctagggcaggggcaaaatgctaccagtctctttgctaaagcatagcaaggtgacctttgatccacttccccacaagttcctcatctctatctgagactaccttagcctggacttcactgtccacatcactatcggcattttggtcaaaaccattcaacaagtctctaggaagttccaaactttctgacatcttcctgtcttcttagccctccaaactgttctaacctctccccattacctagttccaaagtctcttccacattttcaagtatctttgtagccatgccccaaactcctggtaccaatttactgtattagtccattgtcacactgctataaagaaatatctgagactgggtaatttataaaggaagcagtttaattgrctcacagttccacatggctggagaggcctcaagaaacttacaatcatggtggaaggtgaaggggaagcaaggacatttttcacatggtggcaggagagagaagggggtaggaggaacttccaaacacttataaaaccatcagatctcatgagaactcactgtcatgagaatatcagagggaaaactgcccctgtgatccaatcaccttcctccctttatgagtggggattacaattcaagatgagatttggatggggacatagagccaaaccatatcagatttgtttccatttgtttgtgtcatctatgatttctttcagcagtgttttattgttttccttgtaggtatcttttcctccttggttaggtatattgctaagtattttaatttttttttgcagctgtggtaaaagggaatgagttcttgatttgattctcagcttggtcactgttggtgtgtagcagtgctactgatttgtgtacgttgattttgtatcctgaaactttactaacttcatttatcagatctgggagctttttggatgagtctttaaggttttttaggtatacagttatatcattggcaaacagggacagtttgacatcctctttaccgatttggatgcccttyatttctttctcttgtctgattgctctggctacaactttgctgagggttttaatcataaagcgttgctggattttgttaaatgttttttctgcatctattgagataatcacatgatttttgtttttactcctgtttatgtggcatatcacatttattgacttgtgtaagttaaaccaactctgcatcactggtatgaaacccagttgatcatggtgtcttatctttatgatatgctgttgaatttagttagctaggattttgttgaggatttttgcatctatattmatcagggatatttgtctgtagttttctttttttkttgttatgtcctttcctggtttkggtattagggtgatactggctttatagaatgatttagggaggattccctctgtctctgccttttgaaatagtttcagtaggattggtaccagttcttctttgaatgtctgacagaattcagctgtgaatccatctggtcctggactttttttatgttggcagyttttttattaccatttcagtctcrctacttgttattggwctgttcatagtttctatttcttcctggtttaatctaggagggttgtatatttccaggaatttatccatcttctctaggttttctagtttgtgtgcataaaggtgttcatagttgccttgaatgatcttttgtatttctgtggtttcaattgtaatattgcccatttcatttctaattgatcttatttgaatcttctctcttcttttcttggttaatcacactaatgatctattggttttgtttattttttcaaagaaccasctttttgttstatttatcttttgtgttgttttttgtttgtttcaatttcatttagtgttactctgatctttgttatttctttttttttctgtttggtttgggtttgattttttctttattctctagttttttgaggtgtgaccttagattatttatttgtgctctttcagactttttgatgtaggcatttactgctatgaactttccttttagcagtacttttgctgtatcccacaggttgtgattggttgtgtcactgttatcattcagttcaaagarttttttaaattccatcttgatttcattgttgacccaaggatcagtcaggagcagattatttaatttccatgtctttgtatagtttcgagagttctttttggagttaatttccaattttgttccactgtggtctgaaagggtacttgatctaatttcaattttcttaaatgtattgagacttgttttatggccatgatatggttcatcttggagaatattacatgtgccagttaaaagaatgtataytctgcagttgttgggtagaattttcataaatatctgttaagtccatttgttttagggtatagtttaagtccattgwttctttgttgacctgtcttgatgacctgtctaatgctgtcagtggagtattgaagtctcccactattattgtgttgtcatgtatctcatttcttaggtctagtagcaattgttttataaatttgagaactccaattccggtgttaggtgtatatagatttagaattgggacactttcctgttggactgttctttttattattatataatattcctctttgtctttttaaactgttgttgctttaaagtttgttttgtctgctataagaatagctactcctgctcacttttggtttccattttcatggaatatctttttccacccctttcatcaagtttatatgagtccttgtgtgttaggtgagtctcttgaagacagtagatacttggttggtggatttttatccattctgccattctgcctcttttaagtggaacatttaggccatttacattcaaacattactattgagatatgaggtactgttctattcatcatgctagttgttgcctgaataccttttttttattgtgttattgttttataagctgtgtgagctttatgctttaaggaagttctatttttggtgtatttcaaagttttgttttaagatttaggacttcttttaccattttttttgtagtgctggattgtagtcacaaattttgtcagcatttctttttctaaaaacgactttatctttccttcatttatgaagctttgtttcactggatgcaaaattcttggctgatawttattttgtttaaggaggctgaagataggaccccaatcccttctgacttgcaaggtttctgctgagaaatctgctgttaatctgttaggttttccttttgggttactgatgcttttgcctcacagctctttagattctttccttcatcttgactttagctaacctgatgactatgtgcctaggtaataatccttttgctatgaatttcccagrtgttctttaagctttttatatgtggatgtctagatctctagtgagatcagagaagttttccttgattattccctcaaataagttttccaaagttttagatttctcttcttcctcagggacaccaattattcttatgtttggkcatktaaaataatccaaaatttcatggagactttgttcattttttaaaattcttttttatttgtcttttggattgggttaatttgaaagcgttgtctttgggctctgaagttctttcttctactttttcaatactattgctgaaactttcctgtgtattttgcatttctctaagtgtgtctttcatttccagaagttgtgatcatcttttctttatgatatctatttctctggagactttttcatccatatcctgtatttttttaaatttctttaaattagttttcacttttctctggtgcctccttaagtagcttaatagtcaaccttctgaattctttttctggcaattcagagatttcctcttggtttagatccattgctggagagctagagtgatcttttgatggtgttatagaaccttgttttatcatattaccagaatgacttttctggttacttcttgtttggggagactgtttctgtgggaagatatgggactcaagggctgctattcacattcttttgtcccaggggtgctcccttgatgtggtgctctcccccttcctctaaggatacggcttctaaaaagccagactgcagtgattgttattgcctttctggttctagccatttagcaggattctggggctccagggtggtgctaagaactgtctgcaaagagtcctgtgatgtgattcatcttcacgtcttccagctatggataccagcacctgctctagtgaaggtggyggggagtaaagtggactctgttgggagtccttggttgtagttttgttttagtgtgctggttttagtccttggttgtagttttgtttagtgcggtggttttctcaaatgctggttatgctagcagtgaagttgtcacatggacagactcaggacctctggttaaccagggtgttgcaggtggtgaaattagctgttgttttctccttctttggagcagagttgttctcttatgagttgctgtaatggcttgagttgattggcctccagccagaaggtgctgctttcaagagagcaccagctgcagcagtagaagggggatataattttgccctgccttggctaggataggtacttggcttcctcaggtaatgaacagggccatagagctcccaagagaccatgtcatttgtctttggctatcagggcaagtagagagaaaccatcaggtgggggcaggttaggtgggtctgagatcatactctccttgggcaggacttgctgtggccactctgggggtggggggctggttcttgggcaaatggagttatgttcccaggggaattatggctgtttctgctgtgtcaaataggtctccagagacatggggraaagctggcattgaaagacctcacccagctcccacacagccagcaaggccagtctcactcccactgtgcctccccagcagcactgaggtttctgtacaggcatctggtaagcagggctgagatcttgccccaggctacaagcctcctgctgagaaagcaagcagggctctcaggccttgctcctccctgcctgccaggacagttggctgcagcttctacgcttgtatctttacttcccatttgtctcctcttctgcattctacttaggaaagtttgtgctcagttaaaatcattacaaagtcaagctaggagcttccttcaccctgtggcccctctccaattccactggctgccttcccttccccaagaacccctgtgagataagtccaggaatggctttcctggggttcaagctggagaccaggagtccctacagggctcttcctgctgctgcttctacttttatattttgcttggctgcctaaatccatttcagctctakgtaagggtaaatctttcccttgtcatctggattttcaggttccccaatggggatgtgtgttcggagaccaacttctcaccttctcacactttgggaactcaaatttttggccatcttgtgtttgcagcagcaagctgcttctttcaaagtgtctgtgaattctatcagttttcctgatatgttcctgcagcggttcatgcagcaaaagttcacagtgtgagtctctacatgctgttctgtctgtctaactgggagctgtacattagtcctgtctcctatccactgttctttttttcctctgattttcctttcctttggataaatacccagaagtgggattgctggatcatacggtatttttatttttagttttctgaagaacctcagtagtgttttccatgatggctgtactaattcacattcctaccaacagtgtgtcagagttcccctttctctgcatcctcaccagcatttgttattttttgtcattctggtaatagccattctaactggggtaagatctcattgtggttttggtttgcattcccctgatgattagtgatgttgaacattaaaaaaaaattgattagccatttgcatgtcttctttcaagaaatatctattcagattatttgctcatttaaaaaaattgaattacttgttttttttcactgttgagttgttgatttcctatttggttattaatcccttgctggatggatgctttgcaaacatttcctctcattctgttggttgtctcttcattctgttgtttcccttgttgtgcagaagctttttagtttgctataattctgtttctctattttggcttttgaggctgatgcttttgaggtctcatccaaaaattgtttgcccagaccaatgtcttgaagcagttccccaatgttttcttctagtagtttaataatttggggtcttagatttaaatctctaatccattttgagttgatttgtgtatatggtgaaaaataggggtctagttttcttcttctgcatatggttatctagttttcccagcatcatttattgaagagaactcttsttgctccaatgtttgttcttgacacctttgtcagaaatcacctgactgtaaatgtgtggatttatattttggttctgtatcctgtcacattggtctatgtgtctatttttatgtcagtaccatgctgttttggttactayagctttgtagtatattttgaagtcaagtagctgttgtttttacataatgataaatttgtttttaacctttgttcattagggatggagcctatagaggtgcctcttgaggaaaatagtgaacggactcagattcgccaaagcagggtctgtgctgacaggtgagactctgaagcasgtgaaaatctcagctttattgacaggctggcacagagggggaagagggtaatgccctatgcaatctatcctttgctacccttcagtccagttgctgyccatttctcccttgcatgcttctctctaaccacactcttggctctttggtcttcaaacctcccaagcatgctcccttctcaggtctttgcacttgctgttccctctgcctggtgctcttcccctagttatacctccacagggctgttctctcacctctgtcagtttcatctccaacaggtctctgttcaaaagcccccttctcagagggccacatgactacccacagaaaacaacctctccctcttcatttccccttttgtattcatctcctttgcctttgttgtttccaagttaatatatatctgtttattgatctttagtccctcccactagaatgcccatgttgttcccttcagagcctgggacagtgtcaagaggacagtgtggggtgggaagaaaaggtgacacagaaggaacagtctggagggcactgcaacactccagaggaggcctcatagggagggaaaagacctgatttgcatgttgagaagaccagctggtgcctgtggagcagttggaagggggaaggggtgcaagcaggaaggccacataagcacctgtgttagcaacacwggtgagacaagatggaggcttggaccagggtcagagagaaagtcaggaagctgcaggtatgtattctggaaatagaataacctgaactagctgatgattggataargaggctgagggtgaggggggttatcaagacatctctcaggtttctaaaacctagctttcaggtgataactcacagattatatacccatattatgggttattatctaatctggtttgctgatgataaatcatctactgaattctaggaaatgtaaagtggggttgaatgtaatagcattgctattttgtttattgattgtacatgtttctaagtctttttattgaataaatcaaatgtctgcatcccttgttatctaatcttatctgtacctgaatacatgtggaatagcaaattttccaatcttgggaaatttatcctatcttaagccccaaccaattcccctttcacccccrcccatatactaaaacagttaactatayaacacttcactaaagatttatgtataataaaaaaccttcagagtgctgattgcctaccagttaacacaatgcactcattagtgggtaggtctgtgctcagtagatggtgatactgcatggtatcaaaccatattgcacgtctttgtgcactgccctgaacatatgctgtcatgcaaggcaggaaatggtatgttaaatgctaaagctacatccaagttggaccccagtcgttagtgctctgggtgataggcagaggatcactctgggagtgtgaagggctatacccccaggaaagcacaaaggtgatgatgtgatgattgtgcttgacacagtggagaatcctgggccctggtcccaggatgccttggaggctaaagagtgaagcacactctacatcttcttaccagtacttgcaccaatgtcaccaacttacacattcatttagcacattttcagtcagaacaatacattttggataaacaaaattctagaggattcttgagttttcaaacaccagattggtaaatgcagtacttatatctgtaactcacaggcacagtgttcattttacaaaccaaacacgtcagtccatgtgagagaagatatttcaatcaggcccatagtgaacaaataggacacatttctgggttcaagggcttctgaaagcaacatatcactctggaagttctcaaattctaagcattctaagctttgtggttctctgtgtcaataattaatagtaaaaaggtctttccaggagaaatgttgaagctttttatttggtctgaaagcttcacataagccccagatggcaggtcgtcctgccttggaaatctccttgcagcatctgtcacttcaggctgccttcagggctcatgcaatgttttgttttattttattttgtaaycaaactttttgcaattcagattattatttaaataaatactatgtaacagttcactctttctctctctcttttgccagagtaagtacttatgattgtggagaaaaaatttcaagctggttgtcaacattttttggccgtccttgtmatttgatcaaacaaagttcaaactctcaaaggaatgcaaagaagaaacatggaaaaggtattacattttgaattggttcgtagagaacaggaaccctggcttacccttgcacacatcaaaacagcycatgaactgcacttacgggtgacttgctgatgtatggaaagcaggggtcatcagcctttagcagaaacctactgcagtagccccaggtcagcaggcraaatgggctccaggatcttcttaaggaggctgaggagggcataaagycagctgtccagcctctgcccaaacattcagccttagtcctgcatgttcaaaagcataattaatccaattgtattaaataaaaaccctaatagcttgctatgtcctcagattggatctggaagcaaggaaacctggcttgctagtttttagctctatcaccaatcaatggcgtgaccttggtgaatccttgaaccccatggtgcctcaacttctatagacctcagctcctcagactttcaaaagtttccacaatttttcccaccttaagccattgttaggatgaagtgaggcagtagagatgaaagtactttgaaagttaacagtcccaggtgtgcagaaaagatcattttcatgtgtccgctcaaatgtcacctccttagggaagcctggctgactaccctcttcagaacagcaccctgtacctgaatctgcagcaacgtagcaaccttccctgtctcatttttctcagtggcacatttttttcacattcttcttgctatatattttgctcacttattttgttctgttttccttttagtagatgtaagcaatctctatgaggatagggattgttgcctgtttttttcagtgctgtctccccatgcttaaaatagcacctggcacatagttgctcaatacatggctagatgaatgaatgaatgattaccagtttgttcagatattacctggcctagtgatcagttcccagaggaactagtttgtaatccaaatagcatttagagtttgggtgtggtagctcacacctgtaatcccagcactttgggaggctgaggagggaggattggttaagcccaggagttcaagaccagcctgggcaacatggcaagactctatatctgcaaaataagatacaaaaattatgaaaccgtatctcttcaaaaaatacaaaaatgagccaagtatgctggtgcatgcctatagtcccagctacttgggaggctgaggtgggaggatcacttgagcctgggaggtggaggttgcagtgagttgagatcacaccactgtastccagcctgggtgacaaagcgagactctgtctcaaaaaaaaatttaaaaaattgctaggtgtggtggcatgcacctgtagtcccagctgcttgggagactgagatgggaggatcttttgaacccaggagttcgaggctgcagtgagttatcatcacaccagtgcactccagcctggctgacagcaatattttatgtttcatgtttctaaaacataaataaaccaaatggcatttgaccatatatggactgaaaactgggtctaaggccctgcatagtttaacctacaaatccctgaaagtgtatgctatagagaggagtcaaaggatgtaatgtacttagagtttttaaagttctgatgattttcacgccataagctgttaagaatttgagttgctgtgtgatagaaaaggggaatagatttatactcattttattgaagttagatggtggtggttggggtatggataagcttagagacatgattaaagggagagagaaataggcatttccaggggtagaggcatgaaaggagtaggatttgtcaggacctgtgtaccacccttgtaaattatctggagaagtgagcagcagtgaaatctctaagtgccaattattcatagcacccattgcctacctggggtttactgggtttcaggaggctggctgagatagttaagccttagtcctggtcctttggagtctccgttggtgagatcaattgccagcagatagcaatgctgcaacgtaagagaygtaataaaggtctatgcgaagggcagaatcctctacacctggaatgagtcacagagggcttcagggaggaggtgagtttggagctgcaacttaaaaggagagtaggaggccaggcgcggtggctcacgcctgtagtcccaggactttgggaggccgaggcgggcagatcacgaggtcaggagttcaagaccagcctggccaacatggtgaaaccccatctctactaaaaatacaaaaattagccgggcatggtggcaagtgcctgtaatcccagctacttgggaggctgaggcaggagaattgcttgaacccaggaggcagaggttgcagtgagccaagaccacgccactgcactccagcctggtgatagagcaagactctgtctcaaaaaaaaaaaaaaggagagtacgaatttttcaggcagtcacaggcgggatggttaccagggagcagcatggcagggcttggcattcatgggctcagagaagggtttagagggtcagatgtgagcaggggagtgacgggggatagatggggagaagggttgagtgtgccactgaggagtcagtagtcctttacctgtggctgcggaactcactggaggattctaagccgagaagcttcataacactgcttatgttagaaagtcagccctgacttggcgaggtggctgcatckagtgggaaactcaggcagtaaaggcacaggtgggaggcagctgggactgtcctggtgggagatggggccttggtggaacaaaggtggtaggtgcagaggaaagaagaaagcctgtcttcctgctccctgcacgatgcagaatcagggagtgtcagcttgtgactgtttacacttagaggacaccccttagggtcccatgttctctggcagtctaagccattggtcttgaaacagtttttttgagttggtataccttagaaggattttttaaaactatattcctcactcatactaaaatttttacgttgtcatctaaattttaaaaatagtttaaacagctacaaaggatgtgatttccagtatattgtaaacattgtcattttaaatttaaacttgtacattgttcttttcaacaaagccagtagaatctcaatactgcagcatttttttaaaccacaacaatttgaatctcgtgagtattcattacaaaatacattatctctgtgtgtgtgtgtgtgtgtgtgtgtgtgtgtgtgtgtatagagagagagagcgagagggagagagagagagaacaaactgtcctttaatagtcagttttatttctttccttttcatatatatgtgtgtgtgtatatatatatacacacacacatatatatatgaacgaactgtcttttagtggtcagtcttttatttctttccttttccttctgcaacttgtatttcctttccatgccctcaacagaattttatcttagtgttatatattctgtgcttggaaatctttcattgactactaccctatcatacttctgtgaaattaaaatgtgtatataaattgacatggataaacattttttaaagtttactgtgattgtaagagtttaagtgctaggaaatttcttctgcattgagttcttattttttattttttatttttaatagagatggggtttcgccatgttgcccaggctggtctccaacttttgagttcaagcagtcctctcaccttggcctcccaaagtgctgggactacagkcatgagcctttgcacccagcccataatttttcgtagtacacrgttgatcaaagcaamataagtatattataacttttgaaaaataattattaaacgtaagaaaaaaattagcgaaaatgagcctcttaatgaggtggctgggcaccctgccatttgttcctattcccatgaatgactgtcactcatggccagaatagctggtgctcagcctcgggtctcttctgagacgcttaaataaagggctagggaaaggagtttcgttagtgcagtgtcactcaaaccttgcttctgaagtatgtgaccgaagcactggactctaagattgaaatgcctttcatcatctgtctcttgacaacttaattaggtcctgcagttttgtggagagcaaataattggaatccatctgacctacaggaggatgatttgcccaagctttagagacttttattttctcagctcggactccagggttttgaatggggcttttgtcttccactctggagattgttggtccctgagggagtgtgctttaggagaccttggcctttcctctgtgaaagaggaagggtctttgtggacagggctgggattgcacctcccttctctggcagagccgttttagcaaagaggatatatgcaagtggcagatctggagggcagttctctcaaaagtatccgtttgcgtctactctggggtccacacaactgatttggaaacagctcagtaggtcctggtccaggcaaaccttttcttcaatatcttggataatgatagtgatgccgggcctgccaaagggagatgggaactgggtgatagggtgccagctattctgaatacacttaatattttctttcaatagtttcgtcccccttttagtagttttttttttttttttagacagagttttgcagtttcactcttattgctcagactggagtgcaatagtgtgatctcggctcactgcaaccttcatctcctgagttcaagagatcctcctgcctcagcctcctgagtagctaagattaaaggcaagtggcactgcgcccagctaattttgtatttttactagagatggggtttctccatgttggtcaggctggtcttgaactcccgacctcaggtgatcctcctgcctcggcctcccaaagtgctgggattacaggagtgagccaccgcgcctagccctcccttttagtagtttttaaacatctactatctatttctaaactcaatatctggcacttgcccaagggcaaacagcttttccctgattagattcagaagctcttcctgggccttttgccctcaccagggctctctgccttgctccgtcctatccagggaaaggatgcrcctgctgtcatccctcctcctcgaagtcttgcctccaagtctaatttgctggaacaatttcatctcagcatttttcattttatttttttaattttctaaatttttttgagacagagtgttgctgtgtcacccaggctagagtgcagtggtgtgatctcggctcactgcaacctctgcctcatgggttcaagtgattctcctgcctcagcctcctgggtagcagggattacaggtgtgtactaccacacctggctaatttttgtatttttggtagagacagggtttcaccatgttggtcaggctggtgtcgaattcctggcttcatgtaaccctcccacctcagcctcccaaagtgctgagccactgtgcccagcccttattgttattttctccacrttattttaaacagagtattctagaatctccttttgcctctttattgagagatatgcaccatgcttaggacatttttattattgccaggacatcactttttttcccttgtagaaatagtctctaccttttaaaaaaatacaagtctatggaaacatgattcactggcattctgagaaagcaactcttcttttaaatgctccatcattttcagatcaacttcctggtacaatggccaccctttctctggtgaatgaggcacagtatctgctgatcaacacatccagtattttggaacttcaccggcaactaaacaccaggtaagacctcatacctygggactagcagacaagcataaccatttgccactgggagcagggcctggcacctgcctggagcggagagatctgagagtcatgaagttcagccctgcttcatgtacagatgagaaactgaggccctgagaagtaagcaggcccttttgtccagcttccattcatctttatagagggttatcttttatcttacaaagatcctttttgatatcctcaagatggttaatggagaacccctagctctcactgtttaatcattcaatttcttaatgtttgttttaattgaattgccaccaacttgactaacttttattgcccaccctcccactatcccctgtccccgaggatctctgccctacttcacacagtcattttaaaggctaaaaaagagtggttatgaaagcttttaaagttgtaattgcaggcacactttatttgaaagatgcaccacagatggaattagcacccctccctgcccactcccacccagtgctctcccaaggaccctaacagcattgggaggtcagctccagaaagggtcatggttgggccaaccctctcgttgttctttagagcaaactgaagtcccaaggtagccaggcaatgaggaaaaatcacccagctctcatgccacagggtgactgggacgggctcctcattcctggtccacaggccagagatgagtgttgttagtggctcacccctaacagcactgtgaactgggggtcctgtgactgtcttgcaccacgtggtcaagtacacacacatacatatttgcaaagacatacaaatacagtttaataaagctgactaagccacctcgtccgcctctgcagggatgggctatttgtagtcactcttgtttctatccattgttgaaaatatacaacatcattctcatactgtggcccagctcgctatctttgagagcaaaagtgtgatgcagycacatgttctctgggtattcactgagttcttctggcactgagggacccttctcctcaggcatccagagtcctggaaaaagtgggtctgcagttttttggggttcttcgtgtggaaagataggaggtggggagaggcttgctgtcaccccagttcctaccaggaggggccrcgttccccaccatctggtttatagcagggtggacccgctgggcagctgatccaagagcagagctagggtcccctgctaggtatttctctgtgctttatttgcaaatttgagggactctatcatgcacatgttaaccatgatagcttttggacataaaacatgcccttttacgaagcccaaagtgagggtttataacccagagagttgatccagaatcaaaggatttgaggactggaaaagtgctaatcctcttgttgcagatgaggaaattgtggtcctcataggttgtgggagttgcccttagtaagtggcaaaaccagactcaggtatcccggtctctggcttttcatacrttgtttgccattcaaaggagattgggactcctccttcccaaccccatagtctttcaaccctgtctctggcgcatactctaaccatgcctgaggatttacctcacaccaacttaagcaattaaaaattgattgaagcacaaaaaagtgcaaaagtcatcagtacacagttaaatacagttttacagatgtatacggctatgctccatcattttcagatcaatctcctggtacaacagccacccttcctctgttgaatgaggcaaagtatctgctgrtaaacacattaagtgttttggatcttcaccagcaactaccactacctagatcaagctaagaatgtactccagaaacctcccttgtatcccatcycagtcagcctcactgaaggtcaccactattctgacttctttcaccatagctagtttcacccattcttcaacttaatatggtgggatcatacaggatgtgttcttttgtcagagaagttttaagatgtattttcagtgcgttcttctgggtgggggtggggggtgcagagggccattttttttggaacctcatggcaataaataaaaattacaaaaataagagttacaaaaataggctaggcatggtggctcacacctgtaatcccagcactttgagaggctgaggtgggaggatcacttgagcccaggagttcaaacccagcctgggcaatatagtgagaccccatctctaaaaaaagtaaaaataagttagctgggcatggtggcacatgcttgtagtcccacctacttgggaggctgaggcaggagaattacttgagcctgggatcttggtcaaggctgcaatgagctgagattgtgccactgcactccagtctgggtgacagagcaagaccttgtctcaaaaaaaaaaaaaaaaaaggtatcagaaaaatagcagatgttacactgcaaatagaatggaaattaggaaatactatcttctttatttataatgttttaatacccaaaaaaaaaaaaagagtgagatctcaacacctgtgaaaagaagggggraaaaagggaatgagatctcagtgcttcttaggtctttgatcattaagcctgttgacaggtttttaaatgccttatgccgccccaccttatagaactggtgtgttctcagaagttcctttttcactggagttctgttcttctgatttccaaagtccttcatctcttcagctaagatctgctcgccctttgcctggctcttgtgggactctcactggagatgggaccgtatcccaggggaggccctgatgcctgtttagcagatgggtgtctcttggccttgcactcatggtaaaagtctgttttgattatccagggcacaggccacagtagagctgatgaagttaggtgttacatggcaggcatgatgaattattatagtggtacaattatytgccatcctccccctacttactctttttggttgctttaatcagtgatgagaatggaaaggaggaattattctcactgaaggatctcagcttgcgttttcgtgccaatattattatcaatggaaaaagggcttttgaagaagagaaatgggatgagatttcaattggctctttgcgtttccaggtaagtttggggaagttctattatccttcctccagggttgtcaatgaagattgacctcaatcccagacctggatagctgcaggtgggactccctcccagtccttgtctcttaactacaaaatcttggtgggaggttatgtaagcttagccttctaagacaccccatggaataatccatcctttatttcccaagaggatggtagcagtcagtttcgcacacaccacagaaggtgtgcgagggctcgacactgcctctgtgctgtcgttatgtccagacttaaactctggttttttggaatgcttgtgtcatgagactgtcatcctcctgaaacttgttggactttgtggcagtctggagcttgtggagggaggcccagaagcctggcggtgcctctttgcccatggccacccactcttccacacgcttcaccttttctgcctttgctggtggctgggaaggagattgtcagaggcaaagccaccacgatgtcctctgtccctggctttggactcccaaaacctttggctatgggcttcaaagatatgagaaagaggcgaaaggtcttaggctaaaatctgtgctcctcacatggttgacaaggccctacgagatcccatgctgccactgtctctgagctcatcaccccttccctctctgcctcygtcacagtgaccttctctctgttccctaaacagccacccttcctgccttagcccttgccatcccttctgcttrgcatgttgtccaagggtctcagctcagatgtcaccttcttggaaaggatgcccctgacctgccgcagggtcacgttctgcttattcctgcagtgtgtgggagggtgagaccaagtctgttttattcyctgctgtacctctatggccttgaatgacactggcccagagtcagtgctcaataagtaattgttgagggaagaaatggacagaagagataaggaatatctaatgccagagaatgtgctctgttctttagtgggggctgaaattatttttataatacaggctgaacatccttaatccaaaaatctgaaatctgaaatgctctaaaatataaaactttttgagcactgacatgacattcaaagaatatgaccactggagcattttggatttcagattttcaaattaggaatgctcaactggttaagtataccagagatatataatgtaaatattccaaaattwaaaaaaaaatctcaaaatgcttctggtgtcaagcatattggataaggaatactcaacctgtggtagtgtaattagccactggtataaactgactataaygagctaccttgtattcaggctctgcactcagaaggaacaccactctaacatctaggaaagcagtaaacagtcatttgaatctttattaaagaattttagagatctggggtataggaaataaattgcatggcacaataaaatgttccaatgatgtttttgatgtttttaactccctagacttcctcttaccctgacagtggctcccccttgacaagcaatctatattatgtcctacattctctcccacaagcccatctcaggcactagccctcctgccgtttccctcatccctccatccttacttactcttccttattttctatccctgtgtctctgccatgttttttaaaaaaatgcctactgttacacatcctgctgggaacaaaatagacactaaatatacattatcaaataggtggagagtgagaggaagaaaggaagaaaaaaaagggaagagaactagaactagactgagattactctcagaaacttacctggcaacagtagcacctgtgcctctccaggtatctcgagacataaatataaggaagactctttaaggaacctttctgagatgacttagcaggctttgctttctttaggtcaccattcttaatagaccacaactagtaaaaatcaaaatatgcatgccctttgactcaataatttcacttgtagaaatctatcccatagaaacgctaatacaagtattaaaataagtataaaattattttcaccagcctgggcagcatagcaagacttcgtctctctctacacacacacacacacacacacacacacacacacacacacacacacgaaaaattagccaggcacggtgatgtgcgcctgtagtctcagctccttgaggtgggaggattgcttgagcccaggagctcaagcctgtagtgaatcaagattgccccactgtactctaggctgggtctcagagcaagatcctgtcagtcaatcagtcaatcaataatagctatatgcattagtccagcacgagcattaaagagcataagatatggttaatactgcacctttcttttttttgagacagggtcttactctgttgtccaggctagagtacagtggtgcaatcttggctcattgcaacctctgcctctcaggttcaagcaatcctcctgcctcagcctcctgagtagctgggactacaggcgtgcaccaccacacctggctaaattttttatttttggtagagatgggatttcaccatgttggccagactggtttcaacctcctgggctcaagtgacgtgctagcctcagcctcccagtrttgggattataggcataggccaccacgcttggcaatactgtgcctttcaagaaagtaaatgcttggctgggcacagtggctcatgcctgaaatcccaatgctttaggaggccaaggaaggaggatcacttgagctcacaagtttgagaccagcctaggcaaaacagcaagactttatctctacagaatattaaaaaattagctgggcatggtggtacatccctgtggtctcagctactcaggaggctgaggtgggaggattgcttgagcctgggaaatgaaggctgcagtgagctatgatgaagccactgccctccagcctgggtgacagagcaagaccctgtctcaaaaaaaagcaaatgctcaaaagatgtttgttgatgataatactcagtgccgaagcaattactgtgaaactagcacatctcttttggaaaacaattttttactggatgtcatcaagtcataaatattttttattcctgttgaccttataatttcattttgggagactgatactacaaaaaaaatgaaaaggaaagacagttatgtgaattaggcctttattgcaaaattattgatcacaggaaagcattagaaactattcacatggcttcaaaggagaagaactaagtgtttcaacccatggaatgccaggccatccattgtgaaaattgcaaaatgcaaggatgaggtggctttctatgtcctgactggaaggatgtccttgcatattkcagagtaattgaaaaagaaacccaagtgggctctgagatcccagcgagtgtgtttacacaggtgcacatacacagttgtatgcagttacatgacacagtctgggatggtctgggatggtttggatgtcctaggatggccggggacaatctgggatgtcctgggatggtctgcagcccatgagcagcacctgtctctgtggatggggagagggggatcactgctgttgagtgctttctcttttaattcttcaagcttctgtattgtttgacttgttttttaatgaatatatatgctagtaaacacattttaaaaatactagttgctaagaataccagaaaagaagctttaaaatgaagattttttaagaaaattgtttcttttgtattggtgtttggggctgggtgcggtggctcatgcctataatcccagcactttgggagactgaggtgctcggatcacctgaggtcaggagtttgacaccagcctgaccaacatgcagaacccgtctctactaaaaatatgaaaattaggtgggcgtggtggctggtgcctgtaatcccagttactcaggaggctgaggtaggagaatcgcttgaacacaggaggtggagtttgcagagagctgcctgggtgacaagagtgaaactccagtctgggtgataagagtgaaacttcacctcacaaagaaaaaaaaaggtaaaagaaaatagtgtccagaaaatgcccctttcttctgctagtttgagaaactgttctaagagggcctttcattgaagtgacaggatttttacagaagttgttgcctgtcgggtggctgctagaggctggggctggtgcaagctgcagggccctggcatcctttctgcaggagctggccccatgcatcagctgttttctaggcaaagaggtaagaggtaagagggtgyaggagccacactggctcctcgaggacacagctttgtggcgttacaaaagcctcgttccactgcagggatcctcgtgtataatagtgatagtttccastctcgagcacggtcaagtgccaggcctgggcttgagtccttgtatccctgatgtagttctcaccaaatacagccaagaatctagacaaggaaacgatatctggagaggtcacaggtttgccaagtccttggtagagctcctttccagcaagttctgggtgcttacgtggcctgggaatcttgacttcggtaccacagggagcatatatttccrctgatttagtacccagtgcagaatgtgagcgtcaacctaaaaaaaaaaattagagctttgtacagtgccagtatcagagccaatgaggtttttctgaggtgtgattattgctaattgaaaacttttcccaattaaaaacaaaaacaaaataaaatttaaaaaacacaccagagaaaatgatctcctaatgtgacgaatttattcaggagtaagcaaaaaggattataaactaggatgcatagctatggcaagccacaggtgcacctgaagaggagagagtaagggaaagcttttattggcaaaaataaaktcatacaagctgcttgaaaacagaatttattggttcctggggctcacagccagaattggcatcagttcattggtggagacgctgttactgggcaaatgttcctttaagagcatcttatctgaactgctgcagtcctgaagaatgtctagtgataaaccctgtctagaaatacgtgcatacatgcaagacatggatcatgaaaagcatgagatgcatgaaggacatggaggaatttcttgtgggattattttagaaagtccttgagacagtcgttatctcagaaatgcaagcatgaactccctgccttcgtgccatcctggctccaatttcttygggtctaatcagtgatttcatcctggtatctgcaactttcacaccagtaacaggaacaggccaagacacatccagattaggtgagtgtttctaatttcagtgcataatttgtatttgcccgtgartgagctgaggagaaaatggttatgagaaaatagttttaagaaaatcaagtacctttgcactttttacatgtgcaataaaagaagcatctcgttattgctgagctgcatgctttctttttgatgtttatattatgggggattttaagctccaccagacagtatgacctgtattaagaaattgtaacaatgcgttttaagtattgtgtatgtgtggcatgtaggcgtgggtacgtatggwtatatatatatatatatgcatacagatatgtatattaaaaataattttgtttcctacttattacagttacaaaaacaattccccattttatttaaaggtttttatagattccttttaatacgtgcatgatataattttaatgcctgaaccrtatacatcatatatatgtagcatggtttacttaaccatttctctccactatatgacgttaatgatgttaacaagtttttcctattatgaacaatgtgaggataaatctttgtccatgactgtggttgggcttctcgttcctttcttaggttggatttttagatgtgaagttgctgggtcagcgggcattgacacatgaaagttctctctgatgaccttctcacaggggccagcgctggctctgcgacctcctcctcctctttcttctttcttgctctgttgcccaggctgcagtgcagtggtgcgttcttggcttactgccacctccgcctcccgggttcaagtgattcttcttcctcagcctcctgggtagatgggattacaggcatgcatcaccacgcctgggtaatttttgtatttttagtagagacagggttttgtcatgatgtccaggctggtcctgaactcctggcctcaagtgaacagtccgcctctgcctcccgaagtgttgggattacaggtgtgagccaccatgctggctttctgcaacttttctctttttccaatttgtcttcccagtcactgagtgctttccttcctcaaatccattctccaacatttcctgagaaccgtcaagatctcagtccctcttttctttgtctgcaaagaccttaagcagtggtcttttagctgacaaacaaatgcagatgattccccagcagagacggtgaacaggtgccccgttctggctctccatagttaggggactgggcatttctgtgtgattcctccctctgaggtgcaaggctctggtcacttttgtggcaacgctgtgttttccttctcacctgccaggttttggggccttgtcacagatgccagatgatttgcatcgaccagcaaactgggcaacgaaaccagcatgttttccaaaaactttctgagagtcgtgaaacaaaggtaagcgtgattgcaaaatatgacacctggtttccaatcctggtgttatcaataccagaactatgttcataatagcacagagttatttttttaaatgggggatttgctgcccatccaaagctgttgggctgccattaacctatccttgtttgtagtttcattttatttttcctttccatccaagttctcacttttttttgttttacttcatgtatttttatgctttccaatcttgttgaagagatatggagtacaaaaaaaacaagtaattctgttgtcttgatcattattttctttaacacagagagctcatgaagagtaaagtgccttaatgtgaatagagtagctgcatagaaagagtcagtacatttcattaaactggaaatacattcattaagcctggaaattcattttcttgagggttaaaacaacaaagtgttgttatgaattccagattatagaaactgaacttccaatgtgttgattctttagaaagatttattttcaggcttatactttctgttaggactttttgttttcaaagaattccaggaagccaagaaaagcagtcaggctacatagaacaattcttgaaaattaacagaaataatgcaaacactgtatctacttccaataataagctggcaagttaattcatggtaaaatgtgctacattgtttcctgtgtttcttcaaagccagggttttgtttcacagtatagacatttgatttatgtaagttttcttaccaatatgggatagaaatggcctgcagagtagtgcatttgactgttacagcagcatgtctgtcaatgcaggctgtgttgtctggggtgtggggaccttgagcctgcaccatgcaggttgccaggagaagaaagaagaaggcacaaatacaatactaaggtccatgaaaatagtgtttctcagcatcactgcaattttcatgtgcatgatgaaccttttatttttaaattttggaataattttagatttacggaacagttgcagtgagagtgcagaggctgcacttttcacccacatttgtacaaatcatgaggaattggcccaatcccctagcctggggcctggaacatgagggtgtccaacagatgttatcacaagaactaacagatcggagagcatgtcaagtcctccaaagggtcctgagtggttcacttgcattgatggttaacattgagcagacttacctactcttcattttggaccttccatccttattcaggagaatttgacaaaattaacttgcatcattctttctcaaggaaaatgcagagttctgccactgtcttccccaaaaggcttttacatcagrcagcaaacaggaaatgggcctgatggtggtcacaagctgagagtaggaagaaagtccttctgcaggaagttcagggcatgtgggacagagatgtgcccagcaagaaagaggtgtggggtgaccacagggaaaggatgccttagaatgagaatctttggggtctaaagttaggattctcttaatgttccagtgcattctactgtgtaacagataggagatatcaagtctcagtatatgtctttaaaaatctgacttgattttagttaaacattaatatttacaaagttattttaattgctaaaataatctagccttttttgttgttgttgctgttttgttcacaggtgaactttggcatgtacctgatgcatgcatcattggatttatcctccccatgtttcctgtctgtaggatctcaggtgctccctgygttgaaagagaatgtggaaggtcatgatttacctgcatctgagaaacaccaggatgttacctcctaaaaaaaatttttagcatacattaaagtttctcttttacagtgatctctattattgttaagatctgcaacttggttcagtagaacttgatgttttgaataaggagagctctttttctttagaggcagggaatgctctcacctgcttccttctgcctttgacttctcaccctgcaaatttgcactggctgtgctcaggagagcacttctgaggcctcaggaacgaatgctgcacccacatccagtgaggctcctgtaggtatttgaagtataatcacttgtaatcagatgaaatttttaatgaagttcactgggaagattgaacttactgcgggtccctattttgccattttctcacattgttactttgtttttagagagcatctttggatctctccaacccrtttgtagtgaggaagggagtctatgcccagtgatcctgggtatgagaaggtgctcctctcctcccatgtacatgatggtgtgggtttatgctcaggggcccagagggtaacttgtgaccacattccttgaggggagtttctaccagaatatttatattctgagcaaaggcacaggccagcaattcctttcctgttgcttcccatccctggcctccgtcctcatcccccactgagttgatgcactgaggatggctcacgagcctgaagttacactcagtgatggctgtgcttatgcaggttgtcatcctcccctccacaagcccacaggatggtgttggtccatcacccgagagcctccaaatcctatcgagggaggaactttggcattcaggaatcctgtctgtatcatctttgaccactgctcctgcagcctccagatgaaaatgtccagtgaggaaatctcattctctaatgaagttacccatcccgctgagtttctaagaagtttctccctgtgcggagcttgtgtgtgccttatctgcttctgcatgacttccagcctggggtcttaccctgtcctctggagcaatgcagagtgagtacatccactccacattcattctgctggcgtccttctgaagcctgctgtccatgtgtgaacccagtcccttcatcatcttccccctggatggttgtatttttccagtcacttctcccccaaatgtctgcctgctgcagcccactgcatcttttgaaagcctgtgccaccccatctctcctgctgctcagttggagagcaggctccaggctcaggcttccctaatttatctgttcagagcctgtgggattcagggtcagtttgtttcattatcacatttgtaggactttgtgttgttcccagcactaggtgagatttgaaagatgaggtgtgctctgttctcaaggattgttgagatggagcctaatgattgcacactcacgtgctgtgaagagttaagggtaaaaagtacaactctgactctggttcctgagatcaccgaaagaagaggcaaatgaagttaggtggggtggggtggggtttattgttttgaactgtttattaaaaacgcaacctcttcaaagactcagcactgccacatcatatgagtggacttgtcctcatcagctaactgataggagaacaatgccctaaagtaatggatttatccacctactcaggccagtttcatgcaggagggaactttccagatggcacattgccccatttccaagaccttccgctgacaaatgcatcatattaattatgatggaaaacaagtaagaaggcatgctctacaaaaattaggtcacttgcccaggtgcggtggctcacacctgtaattccagcactttgggaggctgaggtgggcagatcatgaggtcaggagatcgagaccatcctggctaacacggtgaaaccccgtctctactaaaatacaaaaaattagctgggcatggtggcatgcacctgtagtcccagctacttgggaggctgaggcaggggaatcgcttgaacccgggaggcggaggttgcagtgagccgagatcatgccactgcacaccggcctggtgacagagcaagactccatctcaaaaaaaaaaaaaaaaaaattaggtcacttttgtcatcaagaatatgtttttcttatccacgtctatgtcaccttttgcagtagatactttcatgactgatttcaggctttttgtttttttgagacagggtctcactctgtcacccaggctggagtgcagtggcatgatcacagatcattgcagccttgacctcttgggctcaagcgattcccctgcctcagcctcccaagtagctgggactacaggcacacatcaccacatccagctaatttttttttcttttttttctttttggtagagatggcatctcactttgttgcccaggctagttttgaattcctgggctcaagccatcctcccgccacagcctcccaaagttctgggattacaagtgtgagccactgtgcccagcttttgatttcagacattttaatgcagatcctctcctttacagcactattatttggttatctacttataattactgatttaacattgatctgttttcactagactgtaagctccatgaggacaagtcctgtgccagtatatctctagtgtcagcagacaatactcaaaatttgttgacagactatttaaagctgcccctatttttatcattaattgattgaatattaattaaatatattttattaatttaaaatgaattttaaatgcattttttctttagtgtctaccttcaatatttcttgtatgaagtttcagctaaaaatgtactttgtgtatctgtagagtggcttcatattcagagtttatggacatttatgattttatgtcccctccttggttcttatctcctggagttcagccttatgtgcttctcaaagtgtataacaaaatcaaagacaatgtcatgtcccttgaatttaattctaacaccaaaccttggtgttagagtcacaaaaagtccttttttaaaaaaacttggtgagaacagacaataacttgtctttctgggcattcgcgtcatggtccttttagccagaagagaggttttcttttgcatagtttggtgagcatcaagaatcctttaaggagggtggcggtgctgacttctccccattgagagtcagcctcatcccctcctcagccttgtggatggagaagaacaggcagtgatatacattttctgctgttgaaagatgtccgcttatccttctctttcagtgaaaagttgcttttttattcaatatgtactgaacaggttctagagtttcagaaacaaaagaaacagaaccaacatttatagatctcactatagaggcatcactaattggggaaagacagactaggtaatagtcagatgtgatatagtatgtttaagctataggatggcaggtgcatgagtgttggttgtattattctttatttttttgtatgacttatgatattcatgataattaaaacgttttggaacaattcatctcaattttctttgctttgtttaaaaagcaaacattggccaggtgtggtggctcatgcctgtaatcccagcactttgggaggccaaggtgggtggatcacttgaggtcaggagttcgagaccagccttgccaacatggcgaaaccccatctctactaaaaatataaaaattagccaggcatggtcgtgtgcactagtaatcccagctactcgggaggctgaggcaggagaattgcttgatccctgggaggcggaggttgaagtcagcggaaatcctgccactgcacagcggcctgggtgacagagtgagactccgtctcaaaaaaataaaaatttttaaaaaatgaaataaaaattaaaagcaaacattgagcaagaaaaggtgccagcctgctgaggtaccatctctgtcattgtaactacgccaaaggcagatggatgagagaagggacctgcccttaggctgaaagatttgttatgttggtagctggtggtgttgtctggaacttatgaattgtattttccttgtagctttttcagaaagcaagctatttttttctcttattacagctactaaattttgagttattctcacctttattcattttttaaaatgtgggcctgcaaaagtatatctagtactataacaatatcttttttcctctaaatttttattttttaatttttgtgggtacatagtaggtttatatatttattgggagtataacaaccccttaatagggagaaacaacatttgaggggagggaaaatatgtatacaataaacagagtggggtcacatgataacattctaggcattttgtcagaggtggacctaaaatttgaatctgagcatgctggtatcttcaaaagggggaaacatgggaggccgaggtgggcggatcacgaggtcaggagatcgagatcatcctggctaacacggtgaaaccccgtctctactaaaaaatacaaaaaattagccgggcatggtggcgggggcctgtagtcccagctactcgggaggctgaggcaggagaatggcgtgaacctgggaggcggagcttgcagtgagcggagatcgcgccactgcactccggcctgggcgacagagtgagactccatctcaaaaacaaaaacaaaaacaaaaacaaaacaaaacaaaaaaaaaaaaaacgggggaggaggggcggggcggtaaacatacagtcaacaaattcacaatttcccagaagataaaaacaaacatgtttgctcagggcaaagtggtgctcagcgcttgacaagaattttgtctttcattaaggacaatcttatgaaacttccattcctggggcggccttagcaccagcctggtgggaccggaccagccagccagcctccccaggcagctcgctgagaatgggagggccagcccagtggcgccatgatcctcctaccctgtaactcccacagtaactagctgctctacaccggcttcagccaagaccacggatgccttgcttgtgggatggaaaacggattctgagtctataacaccaatccattaaaataaaaagagaaacaaatttctaggaggaagagttggtcataatgaaatgttattttgctgcaactatttagctttagttgttggtggaaaaaagccaaaataccttcccaacaaagtgatgatctgagatgactgaaaaagaagactgttaatgaaatagaatttgctacagaagtcaaggcagtcaaattgcagcgagatagaattgtggttgttttggactccatgattaaggtgtttgcactcacacagaacccccatcagttgtacatctttgaaacctcctaaaaccctaaaggcctctgtcctctgtcccaatagcaacaactctcttctggccttgccaggcatgcacacgagccatgttcagctcgtggactgggccagcacagagaagccacctgtggacattcccgctcctgagggcatcctgagctgcatgatactcaacctgcagggaacaagaattgcaaccacactcgcaaaagggacccttataagaatatttgatacctcatcaggacatttaatccaggaactatgaagaggatctcaagcagctaatgttttctgcattaacttcaatcaagatgagtccttcatctgcatatccagtgaccacagcacagtgcacatttttgcagctgaagacccagggaggaaaaaacagtccaatttggtgtcagctagtttccttccaaaatcctttagttgcaaaggggtttctccaagtttcaggttcccttgggctctccatgcatttgtgcccttggaacagagccaaatgtggtcactgcgatttgtgcagatgtcggctactacaaattcctattcaaccccagaagggaatgcatcccagacatctatgcgcagtttctagaaatgatctacgacaagctgtgattcctcaaccatgagtgcaacagcacccaacactcattatccctgaaactcctggggttggtgccagtgccccatgggactcttggatcacgggctggcgggtctgcccagggaccttggtctgaaaccatacgtagttgtctgatttcctaagaaggactcccattttggtattaaagacagaatcctcatcaaggtactacagacactccgtggctctaagtaggccatgctgactgcctggctgtccccgttagttctgctgggactgacagggtctgcaaacaaacctgggggctgggtcgagaggatgggcaaattcaagggtgtttttgcaacagactccatcat

SEQ ID NO: 10663 - DNA, 55996 bp, Homo sapiens
  misc_feature (1)...(55996): n = A,T,C or G, or insertion/deletion polymorphism (see Tables 1-2)
gtttttaggtcacatagccctctggctctgccattccttgatgcatgcctttgggcaagtttattaacctctctggacctgctcctcaaccaaatatggaatatggagagagtaatacctagggccataaggtcttgtgggtttgaacccctaacttactggctgtgtgaccttggtaagttacttaacctcatgaagtcttaatttttccatctgtaaaatgagaatagtaaatgtaagtgtacctccctgtctcggggtctcttgtgagctttcaatattagaacatatgtaaatctcttatgatagtaccagggagaagtactcataagagtagctcgtatttagaattaagaatcaaatatccttcaatatgtgaagtgctcagcacagtggtgcagaataggacttctatgattggggtcccctttcctcgcccaggtcaccagctgtcaagggatacctgaccaggactctgtcagcacctagagagggcaagacttaccttcccacaatttaaaggatatggttgggtgtaaggggctggggtggaaccttccttttgsagggatccctcagcagcgacaagatrctttcccctgtcctggagaaaagccattcagacagttatcragccccttttgtgagtcaaactctagactcaccccatgagcttaactgacacttcccccaagcagcccctaaggcttaggcccttcactccttcccccaactctgcccatggcactactgccttttctcacctgtgccacctgcagagggcaaacagcaggagcagggtgaggtgggcagtcaacagggccaggtggaaggctcgatgcaggaagagcrcctctgggaggaagcgccagttcactgtccagtggaacagaaactggcggccaaggtcaaaggagcgggacaggtagccgctggggttctccagcaggaagggcagccccagcaccacctgaggattggtgtgatgtcagcagagctgccaaggctcattcccaatgrccagccttcatgctactcattgaggggtgtgggacggggatgtaggcctcagaggttccccaattcccactagaaatagcaggaaaaccacgttccccaccccccggcccaggccagtgcctggggccaaagaagctcaggaggcaggtcataacaatgctttaaggtgtggattcaccaagtcataactgggcagagcaaggaaggctctcagaagccaggcagggtggctcatgcccaaaatcctagcgctttgggaggccaaggcaggaggattgcttgagcccaggagtttgagaccagcctgggcaacccagcaagagcccatctcaaaacttaaaattaaaaaaagcaaaaaggctctcagagaccatcaaatttaataccctattttacagctatggaaactacagcctagcgatagtggctccctagctcagaatcaactccaaaaccctgtctcttggctttgagggagtctcagggatagagcccctcaatcaagacaagtggcttctccttgattagaaagaggaagggtgagatgggggtacctgaaggccagcacagattcccagcttggggagggccccacggaagccaaactgtgtgaggagaagaaacagtaacccaggggcgaagagcagcacattcatcttcacagagactgccaggctggggtgagcaggggagaggaagggtggagatcagctccagggccatgcacacaacacccaaagacataccccccaccatcaycacagcaacctcccccccgccgccacgccaacaaactccaagatgggacctacactcacaactgttggagggaagagcctggagtaggcaggaggcagatacatagtctctatgcctactagatgcgaatgagcatatactgagtatttagaatgtgaaggactaattccaacaaggaatgctgtctgggaggaagacaggatggaaagagggcatgtgtgtatgttgggggatggcagggcagaaactttctatagatcctggactcgctttgtggagccctgagtgacccatgctgtcttggctactcctttactccctctgctgcaggaaattgggaagagatggaaatgcagaaaacgagaggggaccagaaaggaagaggtgttgacctgaaaaagcagcarccccagccccagcgctgggccagcaggaggttgatactgaggaagagcagcaccatggccactgggtcattgaagagccgcagcacaaagatggagtggacacggtaagaggcgcagcacatgaagaaaaagacgaagggaggtacctaaagggaaaacacagtaaggtacaaggtcagctcagcaagcctgagccatccccaccacccagccctcccaggctggggccctctagccctggtagcatggactcaccttgcaggtctggtgatagatcaagaagacaagcagcaaggtagccaggtagagcacagcaaagatgttctgggccatgcggatgtcagtgcctcggctggtggcatagtacaaccccataaagaygtacacgaaaccagctgggtacctggaagatgagagaaaatgtgagcctgggtcaggtcacacagactagtacctaaccagcccctcacatcctccctgaacttcctgtccccactcacacaagtggtccggtgtcaccctgcagttgggtatagtcataggtaccattgatgacgccttctacctcggccatgtaggccttccagtcaatctctgtgtctggaagaagacaagatgatctggttacttctgagtctagaacttgtctgccaccctccccatgcctccagaccatcaaaacacagactttcagccaattcccagggctttactacctcttaatctaactctttatctgacattctctgggtgagcccaggcatctcaaactcaacatttctataagtgaatttgtgatctttcttcccattccaatctactccttttcctgggttccgcaaatggcaccaccgacctcttagctaccaggtcacgaacctgagtaacatctttgatactccctcctctctcatttgcaacccttcgtcaacaagttctgcctgttcctcaccgtaaatatctctatctcatccttctctgctactacatactcaaatttgagcctaaagtaatctctagccccaatgagtatacaatagcctgctaattaggctcctgacttctactttcaccctgctacaatatattttccacctcgtacaccaaagagctcctcctaaaatacaaatcataacaggcctctgcttaaaacctctcaatgattccccaagacccttaagataaagaaaactctgtattattcccattttttgaaggggagcctaagaattaattaggttaagtgactggcttaagataattgagctaggatggtggagttgggattgaagcttgcagggtcccaagttcttaattatcatgctatcttcttaacaaagctttcaaattccttcatgatctggcctcagtttctgcattcccatctcttactactcccttcacttgatttctacactctagctctaaaaaaatcatttcagttcctcaaaggaaccaggctgtcttcttttttttttttttttgacagagtctcactctgtcacccagactggagtgcagtggtacgatctcagctcactgcaacctccgcctcccgggttcaagtgattctcctgcctcagtctcccgagtagctgggactacaggtgtgtgccaccatgcttggctaattttttaagttttgtatttttagtagagatggggtttcaccgtgttggccaggctggtttgtttgtttgtttttcttttgagacagggtctcgctcagccacccaggctggagtgcagtggtgcgatctcagctcactgcaaccaccatctccccggttcgagccattttcccatctcagcctcccaagtagctgggattacaggcacttgccatcatgcccagctaatttttctattttagtagagacagggtgtcaacatattggccaggctggtgttgaactcctgacctcaggtgatctgcccgcctcgggctcccaaagtgctagaattacaggcataagccaccgtgcccagccaggctggtctttaactcctgcccccaagtgatccgcccacctcagcctcccaaagtgctgggattacaggcatgagccaccgtgcccagtctaactgaattttttttttttttgacacggagcttgctctgtcacccaggctggagtacagtggcgcaatctcggctcactgcaacctccacctcccgggttcaagcaattctcctgtctcaacctcccgagtagctgggattacaggcatatgccaccacgcccagctaatttttgtatttttagtagagacaggatttcatcatgttggccaggctggtctcaaattcctgacctcaggagatccacccgcctaggcctaccaaagtgctgggattacaggcgtgtgccgctgcgcccagcctagctggagatttttaatagaggatcctctgtccacagcactccttcccctcacctttttcttctttccttaaatagctaattcctaccttccaagggtggctctatgaagcctttgctgactcctccaacctggtttaagtgacttcctatgccctttatggtatcctgtgttactactaccatgattatgatgcattataattgcctgctaacttactgtccaggcccgagttagaaatgcatcctttttctttttttttttttgagacggagtcttgctctgtcgcccaggctggagtgcagtggcgtgatctcggctcactgaaagctctgcctcccgggttcacgccattctcctgcctcagcctcccgagtagctgggactacaggcgcccgccaccatgcccggctaaattcttttttttttttttttttcagtagagacggggtttcaccgtgttagccaggatggcctcgatctcctgacctcgtgatccgcccgcctcggcctcccaaagtgctgggattacaggcgtgagccaccgcgcccggcagaaatgcatctcttattcaccactgtacctctctctggtaaccagcataatgctaggcatataataagcactaaataaatatttgttgaattaagagtctttagcaagaaagccaagtgccttaagcctagagtatagtttcagcctggaaaggagtagccaataatgcctaatggactcaagtggtcacaagatgccatcattgagaagggacgttcaaagatcacagaactgaacacatggaaaaagctgagatccaggaggagacctgaggtgtccaaagccacagagaaaagcagcagcagcagcagtacaacaattttggctcaaatctgacttctaagctggtttgcaggctgtaagttcagtgcagaaggccaatctctagggtatccacctctgccatgcgggcagattaagatccggttttctgtagagcaggcttggcgctcaggtaagggatatggatgggttcgcaattgacgagtgagtggatacagagtctggtttggagttccaggtctgagatccagtttgggtcgcgggttcaggtctccctccctcccctcccctccccctcggcgcactcacatgccaccctgtgaatgacccagaaggtgatgcccacctccgccaggcagaggcaggcggccaccagcagcgtgtagcgcggctcccgcagcagcaggcgccgctcttgccaggcgcgctgcagccattgcttgcagagtccctctgcctgggccgcggaaccggaccggccgcgtttccgcagcccagccgccatcttaacggtgcgccgcttgtgtgggcccaccacccccggaaacccgaaccttcgacacttaggttccgcttcccgtgcctggcgtcccamcaggctaagcgccgatccgagtagccagtcttcatttactccactaaaatgtaatttttctgcatttgtctcctctgatgcactccacgctccataggagcagggacaatgtcttactcctcagtttatacccagccctgggtacacaggcgctaatttagaacgaatgtccagaaaagcaacattcctgcctacctcccccacaaccgctgaagccagcattctccttcgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccarcgccccgccttctgcatcctgccttccgtattggctgaagggccggcggctctggctgccmggcggttgagagcatggcctctccaggggcmggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggcwaacaggagtaagagattgttggtcccggggccctctggagaaagacagtccctcagagtttgagcgttgggggtacccaagaccctgtccggaccctcgggaggcaggcagccttggggaccggattgctcagaggaccgagatcaagtcctagcgctaattgacttgtaaaacttaggacaagtcatgaacccgttctgagctttagattcagttctagaaatggtactgcgagttcacatcggaggcggcacgcgcaggcacctcgagaataatgcccagcgcttttctttttgcccctgggcactgggagccagagtcacctagagagagtcctgtctgaaacttggtcctatgccttagagagtgagaacagcaccctctaggggtggaggggagattgccgcccagggtgatacgattccccaaagggagacgtgctggaggaaaggtagggctctggggtgttcggctgacctcttgaggttctctcctagtgtcagccttggaggcgctagtaaagtttgaatgagcaacagattttcttccaattgtcgtttttactttgctctttgtaaaagcctttgtatgtttaagtgaagtctttaataaataaaaaaggtatatgtaatatatatgtaaggtataaataacaaatctaatgtgtgtgtctattccactcagtttgagaaatagaacattactagggatagaaaaaaaagtataatttagtggttaataacttggctgggcgcggtggctcacgccattaatcccagcactttgggaggccaaggcgggcggatcacctgaggtcgggagttcgagatcagcctgaccaacatggagaaaccccatctctactaaaaatacaaaaaattagtcgggtgtggtggcgcatgcctataatcccaactacttgggaggctgaggcaggaaaatcgcttgaaccagggaggcggaggttgtggtgagccaagatcatgccattgcactccagcctgtgcaagaagagcaaaactctgtctcaaaaaaaaaaaaaaaaaaagaaaagaacttggactctgggctggcctcatgattcatgctcataatcccagcactttgggaggccaaggtggaaggatcacttgatcgcaggagctcaagaccagcctgggcaacatagtgagatcccatctctacaaaaaatttaggccagagcagtggcttatgcttgtaatcacaacactttgggagaccaaggcgggtggatcatttgaggtcaggagttcaagacaagcctggccaacatggtgaaaccccgtctctactaaaaatacaaaaatcagccaggtgtggtggcacgtgcctgtaatcccaggtacttgggaggctgaggcaggagaatcacttgagcccaggaggtggaggttgcagtgagctgagattgcaccactccactccagcctgggtgacagagtaagaccctgtctcaaaaaaaaaaaaaattaaaacttagctgggcatggtggcctgtgcccatagtccgagttactcaagaggctgaggcaggaggatcgtttgagccaggagatccaggctgcagtgagctgtgatggctccaatgggctccagcctaggcgacagaatgagaccctgtctcaaaacaaagcaaaacaaaaaacaaacaaacaaaaaaccaccttggactccagaggcagtgaattatgttggaatcttggctcggcttatactggctgtgtaatcctggacaaaatacttgaatttctgtgcttccattttctcaaccttaaaaacataagcatatttattaattgggctttaagttgattaaatgagcatgaaggatacctagaacaatgcctggcaaaatgaaaagtatattcaaggttctstgtgtggtcctcctaaaaccccttctccccacaagtaaacactttcttgaatctgtgattttaaaccattgcacttatttatagatttaccttagatctgttttctcaagctttagtgtgtatcaaaattacctggggaactagactgcactgtgagattctaattccagggatggtctaatgtgggtctcaggaatctgtatgttcaacaagcttcacagcagattcttatgctggtgattggcagagtaacactgccttaaaatctgcttgactgstttttcaccaaactgatgctttaaaaaaaatctgcttaactgggaactatccttttctggataggaggggcaagaagtctaaaaatcaaaaggggaatttctagaatccccaagatgtaagaacaggacccacaacttgggaaatactctacgttacattccacctcaacagacttaagttgagtgcctgataagagccagagaatgtgctgggccctttctaacttacttaatccttatgacaacccctgaagacaagtcaaaagtactaagagacttactccaggttaggggtctgtaaactttgtttgaaaatggccaaacaagtaaattttttaggctttgcaggctacacagtctcttttacaatgacttggttccgctattgtagtggaaaagcagctacagacaatacaaaagtgaatgatggccgggcagggtggctcacgcctgtaatcccaccactttgggaggccgaggcgggcgggtcacctgaggtcaggagttcgagagcagcctggccagcatggtgaaaccccgtctctactaaaaacataaaaatcagccaggtgtggtggcaggcacctgtaatcccagctactccagaggctgaggcaagagaattaattgcttgaaccagggaggcggaggttgcagtgagccaagatttcaccactgcactccagcctgggtgacagggtgaaactccatctcaaaaaaaaaaaaaaaaaaaaaaaaagtgaatgagaatagccatgtttcaatataactttatctaacaaaataggtggcaagctgcatttggcaacccctgcactcattgtcttagattgagttccccagaagcaaatcctgagatgaggattcatgtccaagttacttgtcaagaatgtgctcccaggagaattggtaagagctagagggaacagagaaagggaagaagcaaagtttccctgaaggtagtttcagcctgaagagtcacagatgtacaccattagaagcaaacacacaccaaaacccagggatataaaaataaaaatcggtaaaaagactcccagggcatctggtcagaacactgacagtgtccactactgtcatgcagcaaggaagtggtaaagtaagggtgctttgtgacaccacacagatgggagtagggaggcatctggaactcttaaaactggtaaaatgactacattgtgaattatagcctaatggtcatatggatatagctaacaatggaatgtcacgactgaaggtgagtgggcctcttgaaaactgggaggcagttgaacacagtggtttaagagctctggctctggagcgatagaggcctgggtccaaattctggctcttccactgactatgtgaccttgagaaagtttcttaccactttcctcaattttcccatgtagaaaatgggaatagtaataatagtgtcttttttttttttttttttacatggaatctcgttctgttgtccaggctggagtgcagtggtgcaatctcagctcactgcaaactccacctcctgggttcaagcgattctcctgcctcagccttccgagtagctgggattacaggcgcccaccaccacacctggctaatttttgtatttttagtagagacggggtttcaccatgttggccaggctggtctccaattcctgacctcaagtgatctgcccgcctcggcctcccgaagtgctgggattacagacatgagccactgtgcccagccaatagtatcctttatatggctctaacatgaaagtaaactgaaataattcttataaatgcttaacatagtacttggtgttcaatgactgttagctattattatttttattgaaaatgggaatcagagaggcagtttatccaggactgttcagagaacagagtaccctgttggaagactcgtgtgtctggtccctatggctgagacatcctcatagcaaatgaatgtatatggatggctggccccactttgctgttattgagcttctccaatttgttatgcttgcttgacttcatgctctgtaggaatcttcttgtttttttagagacagggtattgctctgtccccaggctggagtgcagtggtgtgatcttggcccactgcagcctcttgaactcctatgcttaagcgattctttggaatcttttgatcataatcaaaaattaatttggaagcagccgggtgcggtggctcatgcctgtaatcccagcacttcgagaggcggaggcgggcagatcacaaggtcaggagatcgagaccatcctggctaacacggtgaaaccccgtctctactaaaaaaaaaaaaaaaaaaagaaattagccgggcgtggtggcgggcgcctgtagtcccagctactcgggaggctgaggcaggagaatggcgtgaacctgggaggcggagcttgcaatgagcggagatcaagactccgtctcaaaaaaaaaaaaacttaatttggaatcaatttgacttccaatttagatttcctataaagagaaaagggactggccagaggattcaactcctgttcccatgatggctatttttcttgttataaattagtaaattggcattctggcttatatttcaatctcttggtgttgagttaggatccactcagctctaggccctcatgtgatgtattcttggatatggatcaattctccaaggctctacttccctcaggctccactttggaaggcagtggctttcccaagccccttcttagttgctggccccaaatctctgagtcaacagaatcaaaagtcactgcttgtaaaaatgactgccccagtgaccagcttttgtttccccttcacctttggtaaagttatcttggaagatgccatcctgtactaaggagaacaaaggaaggaaatctggatttgtccacagtttggcagagctctacaggtatatgaggtcaggtgtgggggtaatgaagggattgtgggtcagcaaacccagtgggatttcaacctggaactaagtcaggttctgccacccttacccccatcccatgtgctgtatctatcatggctttttgtggcttcaactttgggtagcacatgttgggttttcctaggcaagatagttttccttgagccccagggcttgaagaggaacatgggaaggggcagctggggagcaagcagccagctgcctctgggtacattgtccaggtgccaaaccctgatagattagggctatcccaactgctgatcccatgatcctcttagggaggcaagtggggattaaaggaaatctaatcccaagagctgaagatccccagtggggctatcaagagctgtcacccagctccattgtcaagctgggactggccataggagggcctggaagaggccactggatcttctaaggaagtcatgcccattggactatagatccacatccactcctctcacctctatcccttctccatcctgaccctaccccctttgggactgctttccaggcacttcctaccagagtgttgggaagttgtcaagactctgttcttcaagactttgcttggttgtcagctccccggaaactcttggctgactcacctgaggtgaggtccagaccttcctgtgtgctctcacagcctgtctctattgaaacactcatcatgttttgcagcaactgtctgatgacacatttgttcctactggagcatgagctccttgagggcagggacttttattcatgggcagagcctaatatgtagtgctcaatacatacgttaagaattgcggccaggtgtggtggctcatgcctataattccagcactttgggaggccaaggcaggtggatcacctgaggtcaggaccagcctgaccaacatgatgaaaccccgtctctattaaaatacaaaattagctgggcatggtggtgcgtgcctgtagtcccagctacttgaggttgaggcaggagaattgtttgaacccagcaggcagaggttgcagtgagccgagatcgtgcctctgcactccagcctgggcaacaagagtgaaactccatctcaaaaaaaaaaaaaaaaaagaaaagaaaagaaaaaaagaattgcaaggaattagtcagctccactgtgtgtccccacctagtttccccttcacttgttaattctgttttggaaaacaaagtagaataacccctaacatgaggccttcccagggttgatatcttctaaggttttctaagaggttggggattaggataatactaatttatatcattattatgctactgataatattatggtcctaatgataccagtattatccccattttgaatttgaggaaactgaggctcaaagagttgaatgatttgccgtggctgtgtgactaggaatatcagacccaaatctctgaactcctaactttagagctccttcagctactctacagttcttaattctttttttttttttctttttttgagacggagtttcgctcttgtcacccaggctagagtgcaatggcacaatcttggctcaccgcaatctccgcctcccgggttcaagcaattctcctgcctcagcctcccaagtagctgggattacaggcatgtgccaccacgcctggctaattttgtatttttagtagagatggggtttctccatgttggtcaggctggtcttgaactcctgacctcaggtgtttcgccctcctcggcctcccaaagtgctgggattacaggcgtgaaccaccgtgcctggcccctagctcttagttcttaagtttaatgcatcatatcctgtatatggcctacgtattattatcttcatttttctgaataggaaatccaagttttagccaggcgtggtggcacgcgcctgtaatcccagctcctcagaaggctgaggcaggagaatcacttaaagccgggaggcggaggttgcagtgagccgagattacaccactgtactccagcctgggcgaccgagtgagaattcatctcaaaaaaaaaaaaaaaaaaaaatccatgtttctagtatttaaacaacttgtcccagcccacacagctaggagtgatagagccagggtttgcacccaggcctgtgcgattccaaggcttgtgctttttctgcactctgccacctcctctcagtactagagggtttggattgagagaaaacggggccaagagtggatggatattcagggggaggtgagaaccaaaactaacgtagctcttttgctacccattccctcccaccccaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagggagcaacaagagaggaaagcagatcaataggtggggctgcggggttgaggtttcaggggactggaagaaatcagaagccagaagcatgttttggagcaagtagtgggtcgccctcaggagtgtggctctctgaagggagggaagggttaagcggggtcgagatttatagaggcggctggagtagtcaggctcacaaaggctgacatgtggttactgggttgccatagggatgaggtagcagccaggttcctgacaggtgacagagactgccaaggtgagcagttataggaaagtggtgcccctatacctgatatcactcctatacccttccctgaatagaatatagccctaatcccaaggaatggccaggggcagagaaagtggctcactctttgccatggaaagcctgagctacagatgtggggtggttcctgaggtttgactgggagagcatctggagcagtactgacctttgagaacctgaagatccacttctcaccaatggcttctctgtctgccttgcaggtgagccgcgtgcttgtccctggaggccggttnatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctytgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaarataragggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccrttgttcctggggcctgttactgatcctcatctagccttgatttatccacaggagactgcaggctttgaacctagattgctttatgtttctcaccctagctccatccccaacactggtgaccagtcacgcctgggttgtatctctacccaaggaggccacatcataatgaggttcccaggccagcctggcctgtctgtcttacttggcaaccgtccctcaccagcaacatgcacctgagattcccaagtacctgccccccctcccattttggcctggctcctgagacctaagcagcggccacacacacacagagggggtctgtgtttattcacacactcctggtacagtgaggatggaggaacatttacgaagggcacccctgggttgagaacatctccggggccacagatgtcatccaaaggttcagagcagtccccatttgggttcccaggggcaagacgcaggggtccaaggtaaaatcggatctgggcccttggaargtgatgataccttggggagaaggggtctgccagaaagcctcctggggtcaggcctgggcagactggccatgtggttggtaaccgtgtcgggggcttgtctcatcccagcctcaacacccatcctatctgccaggcgcagaagagcgtggccgagactgaggggagggcaggaaccatgagcagagccagtaaacaaagagtcggatataaaaatacaaatgtgctgaggaagtcccttagaaagaggctgaggctggggtcacgccagacaggggtgggggcgaggaacggcccggaggactgggctcaagtgggtggaaagctcatgcaagtacgcagccaaacatccctggccgcgcgcggtccgacaccggcggccgcccggtctgcagaccagactggccggaggggggcggggcaggggagccgtgcgggagggggcgggccgggggctgggggccgcgggtctccgtgtccgttccggtgtgcggggtggggctgcggcccgaggttttaaagtgcatgagcgcggcggcgggttccgggcgggtccgcgccgccgctaccgcggccgccgtggtgctgaagcggacagctccggagtgcctggcggcggcggcggcacggccctgcagcccccgcccgcgggcgcctgggccggggcgggggggcgccggcagccgcatcgccggcccgcgctcctggccgctgcgaggctgggcccggagcccgccgcccgagccggcgcgtctacactccggacggcggcttctcccccatccccttcagcacgtcgtctatccggtcatcctcgatcaccactgcgcagggagaaagcgcgtcagccgcgcggcctcggggggcggcggcgatgagaatgagccccgcgtcctagcttcccgcgcagctactgcccgtggcccagcgacgcccctcggaaccctgtgccgcggtgtcctccccgtccgaactcttctggagacccaacccgccgccaagcctagaccccctcccctcccgatggcggaacgcccctcttccaaaggctccagctattctccctcccagtgcgagccctcctgccacctgagccttcctccctctgagttgatcagaaacctcttgctcacggaatccccctcttcaacccgcacttcaacagatccccctgctcaaatggggctcaaaccgagtatccagctggtccagccctctcctcaacctgagccctctcgccgctggaacccctcttccgatcctggcaccaacagagctcccctccccatgcaaacaaccaagacaagcggacccccggcctcctgccctctcttgttagacgtccctctcgacccgaaggttcttcgtattgtccaccgactcagtatttgatcccaaagaatcagcccgttaccccgtgctcccacttccgtgcagccccaaatgccccgaccggcccctccccctcgcccgggtgccagggctctgcttccagaggtggcgagcatcgaatccggggcaccgtgttcccgggagaagggaagagggggacacacactgcagcggggacccccccctccagcccgggcyggagagcggctggtgcgctggtctgcggcaagagctgcgggcactcggcggggaacggcagccgnggggcgcccggcggagggtttctgggtcaggcggcgactccgggcccgggccgcgtacctcgcttggctcggccgatctggcccagcttggggggtcgcttggcctggttgcccgcgaagaaggagttggtgtcctgcaggcggcagctgaaggagaggtcggagccctcggggtctgcgccgaagcggcccatcttgtcttcgctgtagggcaggatctcggacatggcgggcgcggggtgggcgcggggcgggagcgggactgcggcggggcgcgggcggcgggcttgctgccggaccggccctacctcagcaggggagccggcggaaggatgaagtcatgcagcatccggggctgaggagccaagcggggcctcctcccccgcgcctccgcctcccgggccgctgggcaggcggcggcggcggcggtggcggggaccgggcgggggcgggggcggggggcgggggtggcggcggcggcggcaagagcggaatgacgatgagcgcccgactgcggcagagcacggcgggcggggcgcggtggaggcggggcgggcactggccaggggaaagaggcggggccgggggcaggagcgcgcccagctaccccgggaacagaggcagctggagtgggaggttcccgcactgtggcggggaatggccagcacgtgggtcttggggaatagtaccagccaacccggccgggacctcgcggggaggggcgggaccgaaggggggtgggatcgagcctggtactggaggagcttggaggagggtctgacccctaggctgggagaggcgtgcaagggggactgggagcaggagggcaaaagctggccgggcgcgttggggcgggaaggcggccgcagggctggcaatggaaagcggggagcgggaaatgcgcggggaggagactcgggtacagggtgactggggaaggcacgaacccacagcgcgggaagagctcgggccagtgggatggtgcccttgccgctgacgcgctcttgtactagttgctctgctggtcttaagtagatcgtcagggtccgtgcgcctctgagtgccggtctgtgtctctgtctccgcctttgtgtgtgtcagtccatctctaagtgtctgtatctctctgtctctgtgccccgtatctctttcgctgtgttatggcctttgtctatgcctgtcccttaagtgtctgcctttctctatctatctccattcttgactcctgtatctctgtgccagtgtctccgtctcctgaatctgggtatttcagtctctcctaggaggggtctatagaaactgggccgacgcgcgcgcaccagggcagacacccccagccctagtccggtggctgtagccccccgcggctctggagtggtgcgctcgcagtgtaggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgangggaacatgccctcttctccccttgcctcccgcccccacaacccccgccctggctggccgtcacccgcggcgtcacctgcttgccagcgcgcaggagctctggcgcaatcactggccttggggaggagggggtgtctcacatgcggcgacagtgacggcagcgctgaaaacggtaatgatcaccctgtacgttcattccacactccaggcgaacgcgctttccttccttaatctggccaaattaccaaatcacacagctggtgaggctgccttgtagtgggtctccttccaacactttctcgccaggtgttaataccggagacacagggacaaacgcaatggtggctgcccagggaactggatggggggggcggtatgccacaggataccttgatgccagcctcactcaagggcccaggcctgggggcccatcactatgaagccctcctctgctctgtcctagtctccgggatgagggccacagctggaggtggaggcccagcctggagtgagaggagccctgaaactggaaggacaataaaggcggaagactggggtcwctgraagagagtccagaaaattccacatacactggaagttgtccagtaatgggttccaatcctgactcccactttctcagtgaccttgaactgaaggacccataatcatggttttaaaaaattaattcgtttgtacttaaaacattttaggaggccgggctcagtggctcacgcctgcaataccagcactttgggaggccgaggtgggtggatcacctgaggtcaggagttygagaccagcctgatcaacatggcaaaaccctgtctctactaaaaatacaaaaaaaattagccaggtgtggcacacacctgcagtcccagctacttgggaggctgaggcacaagaaccgcttgacctagggtggcaaaggtggcagttggcggacattgggccattgcactccagcctgggtgacaaagcgaggcgagactccgtctcaataaaagaaagagagagagagagagagagagagagagagagagagagagagagagagaaaggaaggaaggaaggaaaaaaattttaggaaaattaagaaaatcacataacatctttttttttttttttttttttgacacggagtcttgctccgttgcccaggctggagtgcaatggcgcgatcttggctcaccataacctctacctcccaggttcaagcgattctcctgcctcagcctcccgagtagctgggactacaggcacacgccaccatgcccagcttttttttttttttttttttttttttttttttgagatggagtctcactctgtcgccaggctggagtgcaatggcgccatctcagctcactgcaacctccccctcctgtgttcaagggattctcatgcctcagcctcctgggtagctgggactacaagtgtgtgccaccactcccagctaatttttgtatttttagtagagacagggtttcaccatgttggccaggatggtctcaatctcttgacctcgtgatccgcccactcggcctcccaaagtattgagattacaggtgtgagccactgcgccctgccagtctttgtattttttgtagagatgaggtttcactatgttggccaggctggtcttgaactcctgacctcgcgatccgcccgccttggcctcccaaagtgctgggattataggcatgagctaccacacccggccttataactatatatatatatatatatccttctagtcttttcaccatgtgtctgcatgatatgatacctctgtaagccccatgttctagtctgaagcatggggatgataaaacctacttattaaggaacgttttgctgggcaacattcatggctcacacctatgaattccgccactcagaaggctgaagcagaaggatcgcttgaagccaggagttggagaccaggctggacaacataactaggccccatctctaaataaataagtaaataaataagcaagccgggtatggtggtacacacctgtggtcccagctacttgcaaggctgtggtagaaggatcacctgggcacaggagtttgaggctgcagtgagccataatggtgccactgcactctggcctgggtgacagagcaagaccctgactcaaaaaagaaagaaaaggacagttttgtagatgaaactgtcctggggtaaagtgggttgtctcgggaggtagtgagctgcccctcacctaaaatgccaaagaagaggcatgagggttcttgccaaggatgagataagagtattgtgtgaggaattgaaacaattctcctttctctctgcacaatgagggagattggaaaaatgacagtttaatccagaattcacttggttacctccttcttaaataattatattcccgtcccggccgtgcctgctggatcatggttaaagcaaaagtcctaagtacaaacctgtggactattaygatatataagcttcagctatgttgtaaaaatgtggggatttctttaaattctgctcctctctttaaaattctgatattctgcttccttcccatgagaggaaaatacattttcactaaaatgaaataaagcttgtatagagttgcgtgacagtgcattgagtctctcaattggaagtccctcaaacctagtatacttgtccacgtgctctacacagataacatgccttttgacaattgagtattagtgacacttttagtcaagtggaaactgtagacccctgtagtggattgaatagggactcccacaacaattcaatgttcacctgtaacctcaaagtgtgacccagggccaggtgcagtggctcatgcctgtaatcccagcactttgggaggccaaggcgggaggatgacttgagcctaggagttcaaaaccagcctgggcaatatagtgagacgccatctctactaaaaaaaaaaaaattagttaggcatggtggtgcatgcctgtagtcccagctacttgggaggctgaggtaggaggataacttgagcacagaagctagttgacagtgagctatgactgtaccgcactgcactgtagcctgggtggcagagcaagaccctgtctaaaaaaaaaaaaagtgtgaccttatttggaaatagggcttttgcagatacaattagttaagataaggtacagtcaggctaggtggctaatgcctgtaatcccagcactttgggaggcccaggcgggtggatcacctgaggtcaggagttcaagaccagcctggccaagatggagaaaccccatctctactaaaaatagcccagattgtgccactgcactccagcctctgtgacagagtgagatcctgtctcaaaaaataaaataaaataaaataaaaaaatataggccgggtgtggtggctcatgcctgtaatcctagcactttgggaggccaaggcaggaagatcccatgagcccaggagttgaagaccagcctgggcaacatagggagaccctgtcttatatagaaagaaaaaaataaaaaataaattaagatggggttatactggattatggtgggccctaaatcccatcaccaatgtgtttataagaagagaacagacacacagggaaaaaggccacatgaaagacgcagagataggagtgagggaactacaaggtaaggaaaaccaagaattgttgggagccaccagcagctgaaagaggcaaggaagaattctttactagagtcttccaaaggagcttaaccctaccaacaccttgattttggacttctggcctccaaaactggagagaataagtttctgttgttttaagcccccagttggggtaccttgtacaacggccctaaaacacaaatacaagctgtaaaatattttggggtaggtgggtgtggtggctcacacctgtaatcccagcactctgggaggccgaagcaggcaggttgcctgagctcaggtgtttgagaccagcctggctaacatggtgaaaccccatttctaataaaagtacaaaaattagctgggcatggtggtgggcgcctgtaatcctagctactggggaggctgaggcaggaggattgcttgaacccgggaggcagaggtagcagtgagccaagattggccactgcactccagcctgggtggcaaaacaagactccatctcaaaaaatataggccgggtgtggtggcttacacctgtaatcccagcactttgggaggccgaggcgggcggatcatgaggtcaggagattgagaccatcctggctaacacggtgaaatcccgtctccactaaaaatacaaaaaattagccgggcgtggtggcgggcgcctgtagtcccagctacttgggaggctgaggcaggagaatggtgtgaacttgggaggcagagcttgcagtgagctgagattgcgccactgcactccagcctgggtgacagagtgagattccatctcaaaaaaaaaaaaaaaaatacatatgtatatattttttgggggggtagtatttttactatcatatctcatgatcatgtttctccttccttagactttctctgggccttttgatcctaccctatccacctgatggaagcccacaccatgagggtatttctagggcccattctatttaaaagaaactgataaattactgtatcagtctgttttcacactgctgataaatacatacctgagactggataatctatacaggaaaaagagtttaatggacttacagttccacatgactggggaggcctcacaatcatggcagagggcaaggaggagcaagtcatgtcttacacggatggcagcaggcaaagtgagagagcttgtgcagggaaattttctcttatagaaccatcagatctcatgagacccacccactatcacaagaacagcacaggaaagacctgcccccatgattcaatcacctcccaccaggtccctcccacaacacatgggaagtcaagatgagatttgggtggggacacagccaaactatatcaattacaaaaaaaagaatgagaaagatctatgtgaacagacatggtaaaatcctcaagacctgccaaaatgtcatcaaataacaagtttagagtagaattttacatatgtgggaaaagtacacatacacacatatgtatacacacttacattcacatatatacatacagtatatgtaggaacataaatgcacataaaagaaagatctgggcaggctcagtagctcacacctttaatcccagcactttgggaggctgaggcaggtagattgcttgggctcaggagtttgagaccagcctgggcaacatggcaaaaccccatctttattaaaaatacaaaaattagccaagcatggtggtgagcacatatattttcagatgctcaggaggcaggaggattgcttaagcccaggaggtagacgttgcagtgagctgagattgtgccactgcactctagcctgggtgacagagtgagaacatgtctcaaaaaaaaaaagaaagaaagaaagaaagaaagatttggaaagatacataccaaaacgcaaatgatagttatctctgaggatggtaccaggatcccaacagaatgaatttcatcttttattcaatataattctggagtatattacatttgcaataaaaacgtttaaatatattttacattttattatttaattttctttattattattattatttttgagacaacgtctcagttccatcacccaagttggagtgcagtagcatgatcttggttcaccacagcctcaacttccatggcttaggtgatcctctaccacatctggctaatctttgtgtatttttagtagagacggggtttcaccatgttgccgaggctggtcctaaactcctgggctcaagcaaacctccagtcttggcctcccaaaatgctaggattacaggcatgagccactgagaccagccttaatatatattttttaagggcttaaaaccagtgatatagcacatttatcaaacattatactctagccccagacaaattagttgcctttgaaaggaaaatagtgggctgggtgcagtggctcacacctgtaatcccagcactttggaaggctgaggctggtggatcacctgaggtcaggagttcaagaccagcctggccaacatggtgaaaccccatctctactaaaaatacaaaaattatccaggtgtggtggtgggcacttgtaatcccagctattctggaggctgaggcagaagaatcgcttgagcccaagaggcagaggttgtagtaagccaagattgtgccattgcactccagcctgggtgacaagagtgaaactccatctcaaaaaaaaaaggaaaatagtgtagcagttaagaacatgaagcttagattcaaatccaggctctgccctctacctgcttgtaactttggacaagttattaagcttctctgtgtcttaggttcctcatctctaaaatatggacaatgatattggtagaacccatcttataggctatcgcaaggattaaataagttaacatatatataaactgcttaggtaaatgttggactatagaaatgttattattatacagaaaaacataaagaaaaaataatgccatcactagatatatttataattaatattttgttgtatgtactcctaatcttttttgctttttttgtttggttggtttgtttttcttgttttcttttttttttttaaggcagagtctcgctctgtcgcccaggctggagtacagtggcgtgatcttggctcactgcaacctctgccttccgggttcacgccattctcctgcctcagcctcccgagtagctaggattacaggtgcctggctaattttttgtatttttagtagagacggggtttcactatgtgggccaggctggtctcgagctcctgacctcgtgatctgcccgcctcggcctcccaaagtgctgggattacaggcatgagacaccacgcccggccttgtttgatttttgagatagggtctcactctgccatcccttctggagtgcagtggcacaatcatagctcactgcaccctcaattttccaggctaaagtgatcctccctcctcagccccctgagtagctgggactacaggtgcataccatcatgcccagctaattttttttaaaaatttttaatagagatgaggtctcactatgttgcccaggtctcgagctcctgagctcaagcaatcctcctgccttggcctcccaaagtgctggtattacaggcatgagccactgtgcctggcaattccaattttttttttaacctatgcttttataccttctgcttaacaaaaatgagattttgtaaccctttttctcctccgcttaactgtatgtggggaacattttcccacagcataaactcttcttgtctatcatttgtaaatgttgcatagcatctcatcatatggatgtttaattcaacaagccctctactcttgaacattgaattccctcctaattttttgtttacgattataaatagtgctgtgatgaacaaatgtcgtaggaaaaaaatggccacattattttgtacctcctccaatcaagaagtagcatctatttctccagccctgaatgggcttgatcatgtgacttgctttgcccaatgtggacgttggtaaatgtgttgcaagcagaggcttgaaaaaagtgtttatggccaggcactttggctcacccctgtaatcccagcactttaggaggccaaggcgggtggatcacctgaggtcaggagttcgagaccagcctggccaacatggacaaactctgtctctactaaaaatacaaaattaggaatggtagcacatgcctgtaatcccagctactcgggaggctgacacaggacaatcacctgaacccggaggcagaggttgcggtgagccaagatcgcaccattgcactccagcctgggcaacaagagcgaaactctgtgtcaaaaaaaaaaaagtgtttatggccgggcgcagtggctcacgcttgtaatcccagcactttgggaggccaaggctggtggatcacgaggtcagaagatcgagaccatcctggctaacatggtgaaaccccgtctctactaaaaatacaaaaaattagccgggcgtggtggcgggcgcctgtagtcctagctactccagaggctgaggcaggagaatggtgtgaacccaggaggcggagcttgcagtgagccgaggtcgcgccactgcactccagcctgggcgacagagcaagactccatctcaaaaaaaaaaaaaaaagtgtttatgtactggggcttgccccttctttgttgctgagaatcttaaggccaccatatgaagaagcctgggcaagcctactggaagaggagataatacacagagacactgttcaggcatcccagctgaagcccaaaaatgtaaatgaagccattctagaccatgctaaaccatccagctcctgctgagctggccaatcccaaaaaatcacagaacatgagaaataatcaatgtttgttattttaatccagtttgagatgatttgttacacaacaaaagctaattgataaaactatcccatggataatgattatttcctggaacaatttcctagaagtaaattttctgggtcaaagagtatgcacactttcataccttttgattcatattgccaaaaaggttgtatcaacttctaagctaccagcaatgtatgagtgttcatatcttccatctttatctatactggactttgatgtttcttttgtttttgagatggagtcttgctctatcgcccaggctgctgtgcagtggcgccatcttagctcactgcaacctccatctcccagattcaagcaattctcctgcctcagcctctggcgtagctgggattacaggcacccgtcaccacgcccggctaatttttgtatttttagtagagactaggtttcaccatgttggccaggttggtctcaaactcctgacctcaggtgatccgctcaccttagcctcccaaagtgctgggattacaggcatgagcaccacactgggcctcatcgatgtttcttgttatcttcatgactacattgtgtttgtaaatttaacacacaagccattgtccattccctctcaattcacaatcaatttagaccaaaaaaaaaaaaaaaaaaagattatccatgtaggaaaaaagaccaaaaaaaagattatctatgtaggaaaaaagatcaaaaaaagattatccatgtaggaaaggaagagtagaaaagagagagagaaaataggagaataagagagaaacagagtcaaagatgaaaaatacagagaaagaaaatagaaatataaaacagagcaacctccaagactcttatacatagggtatttaacatgtagtcggaaatagttatggggggctgggcgtggtggctcaggcctacagtactttgggaggccaatgcaggaggattacttgagctcaggagtttgagaccaaattgggcaacatagtgagacctcatctgtataaaaaaaaaaaaaggccaggtgtgatggaatgcacctgtagtcccagctacttgggaggctgaggtgggaggatcgcttgagcataggaggttgaggctgcagggagctctgataatgccagcctgggtgatagagcaaaccctgtctctaaaaattggaaggaaggaaggaaggaaggaagagaggaaggaaaggggaggggaggggaggggagggggggatggttacgggtctaaaaataatttgggtcatgaaagagacttgaaaagaaaatgcccatttaggccaagcctagtgcatctgagagcagtgtaaaaataggtaacaggctctatcatatgtggttgcatttaattctcacagcaactctctgagacaggggtgattattcccattttatagatgagaaaaattaacagtcagagctttcaagtaacttgataaagatgatacagctgataaagaattgagcccaaatttgagcccaagtctgcctgtcttggaaatttatgtatttccacttattcttcctagaagggatgtagcaaaacactagcaactaatgcagggaggaagtgtagccaccttttgattcatattgctaaactgcactccagaaaggaaccatactccctgggtttgaatcccagctctgccacttacaacctgtataactctgagtgtttctatgtctcagtttcctcatctgtagaatggcttcataagtgtcatgagtgcataagatgtaaaccacttggagcagtggctgccacatagtaaagtgctgtctaaacttgctatttgtagtatgctgttgcagtgaccctgggaatatttctaatgatcctgttgccaggtggcccatacgtagtagctttcattatgcaatcatgcaccacataacarcctttatgtcaatgatggactgcatgtataataacagtggtttcataagattataatgctgtaagccaggcgcagtggctcacatctgtaatcccagcactttgggaggccaaggtgagtggatcacttgaggtcaggcattgaagaccagcccggccaacatggtgaaatcccgtctctactaaaaatacagaaattagctaggtgtggtggtgcgtgcgtgtagtcccagctactcaggaggctgaggcaggagaatcgcttgaacccaggaggcggaggttgcagtgagccaaaatcgtgccactgcactccagcctggcgacagagcgagacttcgtctcaaaacaaacaaacaaacaaacaaacaaacaaaacacattgcccattatgtgtcatgcactgtcccatatactttacaagtactatttcatttaattctcacaactagcctttgaagtaggtattagtcttttttttttttttttttgagacagagttttgctcttgttgcccaggctggagtgcagtggcgcgatctcggctcaatgcaacctccacctcctggttcaagcaattctcctgtctcagcctcccgagtagctgggattacaggtgcgtgccaccacacccagctaagtttttgtatttttagtagagacagggttttatcatgttggcctggctggtcttgacctcctgacctcaggtgatccacccacctcggcctcccaaagtgctgggattacaggcatgagccaccgtgtgtggcctgaagtaggtactctcatttccattttacaaatgaggaaactgagtctggatccagaatcttttatccttactgtactgtactgtctcctgtttaagaaccatgcaattttggggtgcaaaatgccaacaaaagcaaatgcaacacttctcagcctgcttcattcatcatctactctttctcagccgcaagaacattctgcattagatccactgcagcaagttgtctgagaactgaggtgagtgtcaataaatggattatgggccaggcatggtgacttacgccataatcccagcacactgggatgctgaggtgggagaattgcttaaggcctggagttcaagaccagcctgggcaagatggtgagaccccgtttctataaaaaaaatttaaaaattagccaggcacagtggcacgtgtctgtagtcccagctactagggaggctcaggtgggaggattgcttgagcctaggaatttgaggctgcagtgagttatgaccatgccactgcactccagcctgagcaacaaagtgagacacccttctcttattttatttatttattttttttgagatgaagttttgctctttgttgcccaggctggagtgcagtggcatgatctcagctcattgcaacctccacccccctgggttcaagcgattctcatctcagcctcccaagtagctgggattataggcgcccgccaccatgcctggttaatttttgtatttttggtagagacggggtttcaccatgttggccaggctggtctcgaactcctgacctcgtgatccacccgcctcggcctcccaaagtgctggaattacaggcgtgagccactgcacccggctgacacccttcttgagagaaagatgaaagaaagaaagaaagaaagaaagaaagaaagaaagaaagaaagaaagaaagaaagaaagaaagaaagagagaaaggaaagaaaagaaagaaagaaaggaaagaagagagagagagaaagaaagagagagagagaaagaaagaaagagagaaagaaagaaatggattatgtgtttgctacccactcaagccttctcaggtcaaattcttgtactttctcagtgggggtggaggatggggagaggaagatgaagcgcactctcttttccttttttttttttttttgaattgtaaaacactaggcacttttcagtgcaacagactgcaataacaccaggcctgattaaggaatgacaatatggaaggcagatggcagatgcatgggtgccacactattgcttttcagttaaatattgcttggtgttagttttttttctccttgtaaatctcccaaataaaacggtttgctttccccaagttagaagtgttagcacgtcttttctttaaatatctgtgcatggctgtttttttccctgccaatttgtcaccatctgtaaccctccctttatgagacgatctgatgacagcagttatcttggagagtagaagtgtggtcttgaagcgccatggaagagtagagtcagtgtaggctgtgtgtgtgtggagtgtatgctccccctgcacttggtgtgtgtacatacagaaacacagtgtgcgtgtgtgttggctctgggtgtgttgtgcgtgtgtacactgtgtgtgagtatgcagtgtgtgtacattctgtgggcatctcgtgtgtgtgtggactgtgtgctgggcgtcgtgcctgcccgtgtccttggcgccttggcgtctatgcgttctctgcacataggtaggtaccacgtgcacaccctgaatgtgagtgaactgcctgtgtgctatgtatttgccggctgaagaggggctgtgtggactactgggggaagacgttcctcaggagggcataatttctctaaagtgcttaaaggggatggagagagcctgaaatttgggggaagtaggccaaggagtattagcaacgtctgggcctggttgaatttcattacttttcctaggaaagtaaattatgggtggcttgaaggagggtgctgctgagatggggggcggaccatgaagcgtggaggggtctccggtgttgctggagggcagctggagcctgcggagagcctcggcgcgctcctccctctcccccaccctccccccaccccgggcggggctccgcgtggggcggtggactcgggcgggggggggggcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgggagctggcagcaacgtgagtgggggccccgggctccacgggaggggactgggtggagggggacgaggcagaggggtcggccgcggaggggcaggcggtgcccggctcgcggaggtaaggctgcctcccgggcctggtggaggggtgatagagagaccccgggcccgagagcagggcaggtgggaagggaagggccctcttagcagggcggaggggtccgcgaggcagggagcactggggcagggtcgtgggcaaatagccctctctgcctgacctcggttggcaaccccgactgtctggcagatggtggagtacaaacgggccacgcttcgggatgaagacgcacccgagacccccgtagagggcggggcctccccggacgccatggaggtgggcaagggggcttcccctttctcaccaggccccagccctggcatgacgcctggcacacccaggagctctgggctgttctggagggtcayctgcccccacctccgctccatctctggcctctgctctaggactatggtgaggcgatgctaagccgtgacgttgcacaaaacagactcanggctcaactcactggctggcctcattgccccygggcccagagttaaccctgtggctctgaaaactgcctgtggcttcaccctctggtaatcttggatccctgccctgcatctcagtcactctctgtccccctgtgttccccaggtgggattccagaaggggacaagacagctgttaggctcacgcacgcagctggagctggtcttagcaggtgcctctctactgctggctgcactgcttctgggctgccttgtggccctaggggtccagtaccacagaggtaggtgggcccacactcttcgtcagtattcataactaggggttctggaggcctaagggcctctaagattttcacttgtgggaaccaagccttccctgcagaaaagcccccggctttgctttctcttcccaaccttcctgctgtcatggcccttgcagagtttgcctcttccagacagacagactgacagtctcctaccctccggccatgttccctaccacagacccatcccacagcacctgccttacagaggcctgcattcgagtggctggaaaaatcctggagtccctggaccgaggggtgagcccctgtgaggacttttaccagttctcctgtgggggctggattcggaggaaccccctgcccgatgggcgttctcgctggaacaccttcaacagcctctgggaccaaaaccaggccatactgaagcacctgcttggtgagtggggctgttagggaggccttgggccacctatgtgccttgtgcccagcacagggcctggcacttagcaaataggcagtgtcyatgaatgaggaagtggatggttctgtgaacactccagagggtggggaggcagagagcaggggactattgagaagtgcagatgggtttgatgggggcagaactctgggtacaatggagggccgcttctctgcactctgtttggagcactgtcgtggtgtggtagacaccagggagcctgtactgcttagatatccttgggtctccatggacagggagaggaagccacggcttgctgtttcagacactcttcctgggtctgcgttagcaggactgctcattgacaaggcaaggagagaaaccgagcaagggccagggactccccctcagcagttaacgtaattgccacctggatcctgtgttctgccccacagaaaacaccaccttcaactccagcagtgaagctgagcagaagacacagcgcttctacctatcttgcctacaggtggagcgcattgaggagctgggagcccagccactgagagacctcattgagaaggtagggccactgagccngttgagggcaggggagcaggagaggccttgagagaggagatggcccaggaacgctttgggagctcctgcactaatcattccacttatggtctctacatagattggtggttggaacattacggggccctgggaccaggacaactttatggaggtgttgaaggcagtagcagggacctacagggccaccccattcttcaccgtctacatcagtgcygactctaagagttccaacagcaatgttatccaggtgatgagctgggaaagggtggggagagacttagggacactttgctgagcccagacttccctctcctgtgacaggcaggctgggctgaccccccggccccacccctaccccygctcgggaattcaggttcccatggtggggaaagcgaggrgctcacctcctttccttgacattgcaggtggaccagtctgggctctttctgccctctcgggattactacttaaacagaactgccaatgagaaagtaaggaacatcttccgaacccccatccctacccctggctgagctgggctgatccctgttgacttttccctttgccaagggtcagagcagggaaggtgagcctatcctgtcacctagtgaacaaactgcccctcctttctttcttcttttcttcctccctccctcyctttcttccccttttccttccttccttcctcttattcttctagtaggtttcatagacacctactgtgtgccaggtccagtgggggaattctgagatataagtttccgagccattgccacaggaagcgttcagtgtcgatgggttcatggacctagatagctgagaacaaagctcacaagagggtcctgaggattcaggagagacttagggagccagcaaagtcttcctgaagagattgcatttgagccaggtcctgtagaatacataggagtggatgagggcatgctgggtagaaagaagtttaggccaggtgcggtggctcacgcctgtagtcccagcactttggraggccgaggtgggtggatcacctgaggtcaggagttcgagaccaggctgaccaacaaggtgaaaccccatctctactaaatatacaaaaattagccagtcgtggtggcaggcacctgtaatcccaactactcgggaggctgagacaggagaattgcctgaacctgggaggcggaggttgcagtgagccaagattgtgccactgcactccagcctgggtgacggagagagactccgactcaaaaaaaaaaaaaaaaaaagaaagaaaaagaaagaaggaacagtttaaacaaaagtgttgatgaggctgagcacagtggctcacacctgtaatccccgcactttgggaggctgaggccggcggatcacttgaggttaggagttcaagaccaggctggcctacawggtgaaaacccgtctctactaaaaatacaaaaattagccaggcatggtggtgtgcacctgtaatctcagctacttgggaggctgaggcaaagagaatcgcttgaatccaggaggcagaggttgcagtgagctgagatggcaccactgcactccagcctgggcaacagaacaagacttcatctcaaaaaaaaaaaaaaaagtgttgacgagggaaaggctaggtgtgtctggaccatggcaaggggtccactgtggtaaaatatagaactcaaggcagatgagaggctggagaggtgggcaggaatgggttatggaggggaccttgaatagcacactacggagtttattctgtagctcccggagagccattgcatgctccaaagtagggagggagcgcagtgctttgggaagtcagtttgtttggggtgtgaagagtagatgtgagaaagaaagcctggagatgaattaagagcntctgcggtactccgtgctctgagtcaggaaggtcccaaatgaaagaggtggcagaaggaatggtaggaaggggaggatgtaagcgatatcatcaagtcagaatcatgagttcttggtgcccggatgttagaggagggaaaaggtgaagatggctgaagctgtacactttcatgatggtggaatggaggggtcccttgggaattaggggtgtctctaggaagaaccagcttagggtacattgagaaagaggagacagtgcaacatcacaggaataggagagactttggagtcagacctggatttcagtctcagctctgctgcttggtgcaagttgattaatctctctgaggctgttccctcatccgtaaacaggggatcatagcatcaacctcatatggcatttggagtaggttaggggtacaaacttatgctcctgcatgtggcagatgctcaatcagagtgtgggagctgctccttttagacatgtgagtttgatgggacctgggcaccttacatacagagaggtcagcaggcagctgggaaagctgtgtggagtcctgaagagagaataagcgtgaaaggacccagaggcctgaggggcatctccttagaaacctaaccaggccaggcagggtgtctgtaatccaaacactttgggaggccaaggcgacctgattacttgaggtcaggaatttgagaccagctggccaacatggtgaaaccccatctctactaaaaatacaaaaattgggccgggtgtggtggctctcacctgtaatcccagcactttgggaggccaaggcaggtggatcacttgaggtcaggagtttgaaaccagmctgacyaacatggtgaaaccccatctctactaaaaatacaaaaattagcccgacgtggtggcgggtgcctgtaatcccagctacttggaaggccgaggcaggagaatcgcttgaacctgggaggtggaagttgcagtgagctgagatggcaccactgcactccagcctgggcaacagagcaagactctgtctcaaaaaaaaaaaaaagaaagaaaaggaaaaagaaacctaaacaaaggctttgaagaggtgagacaggaggaggacagagaaaggacagaaggagatccttgtattttaagggcagtgggagagtcagcaaaagagattgctgtggagtaggacaaccatttgtccttctgtcattcattcagaaacatctgctgagcatcccttggccagaccctcctctaggcatatggtgaacaagacacttctactaccctctgagtggaggagaaggcataaaacagttcgctacacagttgtcctgtttccagttgttgggactattatagaggagaagcatagggttctgagagcaagtgtgaccaggaacctgcctagttccagggtgcggataggctgcaatgaagggagagggctctacaaaggcaacaggttatgcaaaggctccaaggtgggaaggcatatggccagcccactggccattctcaatggatgagggagcaggaggggcatgcgggccaaggccttctggacaggcccatagcctcacactatgcaggagcattgtgggccaaatttaggattcatcccgaaagaaatggaaagggaaactcaaaagtgatgtgaacagatgtgtgattttgacatcatctgagtcaggggaggagataatttttacaatttgggagagaaccacatccttcaaccctttggaaggggcaagaggaaagacttcggtttggctgtcagcatgtcactggttgccttcaggaagcctcctgtgctgggatctagagaaagatgcaacacaaaaggttaagataggatgaaaactaagagtaggctgggtgcagtggctcacgcctgtggccccagcactttgggaggctgaggtgggcagattacctgaggtcaggagttcgagaccagcttggccaacatggcgaaacactgtctctactaaaaatacaaaaattagccatgcgtggtggcccgcgcctgtaatcccagccactggggaggctgaggcaggagaatcgcttgaacccgggaggcggaggttgcagtgagccgagatcacacacctgcacttcagcctgggcgacagagggagacgccatctcaaacaaacaacaacaaaaaaactaagagtaaagcagggttcaggagagtctcaaaagtaagcactaagctgaaggtgaggaggtagggagagaaggggtaaggtgagatcactggtttagctaaccatccccctcaggagctgggatgactgggattggtactcaaacctcttcctctgatgccagcagcaagtaagaggagaggtgagagacaggaggaatttgaaatacacagaatgaatattaagggatctaaaacttcttggtaagtagaagaagagatggcctttggcgattagtggagcccaggtgggccttcaggttgagtgggaagtggtttctgggaggagggttaagggaattggcacagagcagtgttgagtgtctgtttgcaggttttcgccctgttattcaacagatatttattgagcacctactctgtggcagacagctgcgcttgggtctgaaattacagtggtgaacaaagcaaacccagccctgcnttcatggagcctcagggccagcaggggtgaggccacatgagtttgtactggacccgagcagggccagggccgccatggccctggggtcatcaggcctgggccacattctcactctgccatctgctagtttgtgatggaagtcaagccgtgtcatcttcccaagcttctgccctggggtgtgaaatgggactcatcttcacttcatgaagttgctgtgtggggaggaaaamatacactgtatggaaagcctctaatagagagtctgatgtatgtctgcagaagtggtcactaaatatttcttctccatgcttttctctcccttggagaccagcgggtagtggagaaagcagctagcttgaggcctggcaggatgggaggtaatagaggcctgaggacaccatggccccgatcccctgtgaggtccagtcagctgttcagagaaggcacatggtcactgatgggctgggacaactagcagggatctaggaaatgagaaggcaaagcagtatgggaagtaggcccatctgctggacagacatttgcagagcacttactctgtgttctagtccctagagacagcagtgagtaagctgctgtaacttggaacaatgctctgctggaactcaccttctccttggmgaaatagatgataaacaagtacagaagtaagtaaacatggccgggtgcagtggctcatgcctgtaatcccagcactttgagaggccgaggcgggcagatcacctgaggtcaggagttcgagaccagcctggctaacatggtgaaaccccgtctctactaaaaatacaaaaaattagccaggcgtggtggcacacgcctgtagtcccagctacttgggaggctgcagcaggagaatcacttgaacccaggaggtggaggttgcagtgagccaagatcgcgccactgcactccagcctgggcaacagagtgagactccatctcaaaaaaaaaaaaaaaaaaaaaaaaaaaaaagaagaagaagaagtaagtaaacaatacttagccaatggaggtaagcagtgtgtcagaaatgaaacaggtcatccagaaaggcttccagaaggatcaagcagaagagatattgggcagaggtggtggtaagaacagatctcagccttgggcaggacttgttgctgggctctgaggatcacccgggccttgacaggtgctcactgcctatctggattacatggaggaactggggatgctgctgggtgggcggcccacctccacgagggagcagatgcagcaggtgctggagttggagatacagctggccaacatcacagtgccccaggaccagcggcgcgacgaggagaagatctaccacaagatgagcatttcggagctgcaggtggggcaggcagggggctggagacaactgagaggggccagccttggcatggaccacccagcttccctccatgccatctccccaaggcagccagtcctttcctcattcccttgcttttctgtgctccccagctgcactgctgctgtcctggggaaaaaaatggtgtccatttaggccacctctcactgggtcatcctttggtccctttcttgcctggggatgcatggagggattgtgttaaaaatgtgtaacagtttgtatgagatgtccacaaaacaatcagaataggctgggcatggtggctgacatctgtaatcccagcactttgggaggccgaggcgggtggatcgcctgaggttgggagttcaagaccagcctagccaacatggtgaaaccccatctctactaaaaataaaaaattagccgggtgtggtggcacatgcctgtaatcccagctactcgggaggctgaggtagaagaatcgcttgaacctgggaggcggaggttgcagtgagctgagattgcgccattgcactccagcttgggtgacaagagcgaaactccatctcaaaaaaaaaaaaaaaaaaaatagaagtgaaagtttccactgggggacccgtactgtgccaggccattaacactttagatgttggattatggaaaagttgggatggagtgtggttctggaggagaagccagtacgtgcagggtgttgggagtggtattttatcaattgttaggaaaatatttgaatatctaggccccagctgaatgtcacatgtagtggttatccttgtataataagtggttgggctcccagattggaggtgtccaggcctggaaaagggtatattacaggaaggatacaccatgaagccagtagttgttgctatggcaatgggaagggctcccaggctacagcatacagtgggggagggttctgctggaagcgagtcgggcaggcaaggcctgagatttttttctttcaggctctggcgccctccatggactggcttgagttcctgtctttcttgctgtcaccattggagttgagtgactctgagcctgtggtggtgtatgggatggattatttgcagcaggtgtcagagctcatcaaccgcacggaaccaaggtgtgggggtagcccagggtgagggtgggttctgtggaggtctccagcaaggctgggcataatggacaggcccagccacacagaacaacatttggtaatgctatgggccttccaaacattgaatcagaatgtctatgggcttttcctctgcgctagggttgcagggtgctccctgtgatctctgtccccccactgctctccaacctgacctctacaggcaggtgtgtggccccgggaccaaagaggaaccccgggacagcttccacayatgcctctcgggactcctgcaacttgcatgttnctgggggctggtttgaggggtgtgaagggcatcccacctgcccttttcttattttctggtctggttgtcagcatcctgaacaattacctgatctggaacctggtgcaaaagacaacctcaagcctggaccgacgctttgagtctgcacaagagaagctgctggagaccctctatggcactaagaaggtgggctttctgattttgcctccacgttctgatccagtctaaccgatgctgcataccttcagtgtgacaggcaccatgtgcctcatggtgcacaggtgcatagtatggagcgcagaatttggaagcaagccgacttgcgtttcaatcccaactcattcattttctagcctgtaggaccttgggcagatcacctagcctctctgactctccatttcctgctctgtaaagcaggaataacttggagggttgtcaggaagagtattagctgagttaatgtaagtgaagcacctgcacagtacatggtatgtataggcactcggctttgatgaggaggatggagaggatataataaataagtgagtatttagtttcaagatgccccattaagtggggggagtggacatgtaaacaaatacattatattttgtggtgataactgctcacactgagtgaaagacttttctgctataggacagaggtgggacagcacatttcacctggggggatggtggggaagggcatcagagaagccttctctgagaggtgccatgtgatggaaaagttcaccaagaaagccggggagaagggcattccagggacaaggaacggcatgtgcaaattcctagaggccaaaaggagcatggtggctttacacacgttctggcatgagcttgagaagagggcaactgagagacggggtttggtaaggtgggcatggggcacttgggaagggatctgaatattgtattgggaagtccggccttgattctttcacagatggggctccatgggagtagcatggagaggagaaacacagttgggttatgtatgaaatgatatttctggtggctaaatggaagatggaggggagcagcagggaagcggggatgagaatggagtcagggtgtccagttaagaggcaattgcaggccaggcttggtggctcatgcctgtaatcccagcattttgggaagccaaggcaggtggatcacctgaggtcaggagttcaagaccagccttgccaacacggtaaaaccccatctctactaaaaatacaaaaaattagctgggcgtggtggcaagcaactgtaatcccagctactcgggaggctgaagcaggagaatcacttaaacctggaggttgcagtgacctgagactgcgtcattgcactccagcctgggctacaagagcaaaactctgtttaaaaaaaaaaaaaaaaaaaggcaattgcagactgagtgtggtggctcgtgcctgtaatcagcattttgggaggctgaggtgggtggagtgcttgagctcaggagttcaagatgatagtgttataggtcagggaagtggtaatcattttccccgtccacttgagtggatgggaaagatgattaagaaatcaaagcaggcagggcgccgtagctcatgcctgtaatcccagcactttgggaggtcaaggtgggcggatcacttgaagtaaggagttcaagaccatcctggctaacacggtgaaaccccgtctctactgaaaagacaaaaaatttagccgggcgtggtggcgggcgcctttagtctcagctactcgggaggctgaggcaggagaatggcgtgaacccgggaggtggagcttgcagtgagctgagatcgcaccactgcactccagtctgggtgacagagtgagactccatctcaaaaaaaaaaaaaaagaagtcaaagtagtagaaactgctgatagactgaatgtggggggttagggagatggaggaagctgagtgactcccaggtttcttgcatgggggactgactggatataaaattagttgtgggccgggcacggtggctcatgcctttaatcccagcactttgggaggccaaagcgggcagatcacttgagctcaggagttcaagaccagcctgggaaacatggtgagaccccttctgtactaaaattacaaaagaaaatagctgggtgtggtggcatgtgcctggggtcccagctattcgagaggctgaggtgggaggatcgcttgagcccaggggacagaggttgcagtgagcagtgattgcaccactatactccagcctgggtgacagagcaagaccctgtctcaaaaaaagacagatgtggcactgagcaaacccaggactcttgtccagagctgagaagggctgctagccccagtgacagagaaaggccctctgactggaggacacagccatctctagggtcctggctctttgtcctttaacagtcctgtgtgccgaggtggcagacctgcatctccaacacggatgacgcccttggctttgctttggggtccctcttcgtgaaggccacgtttgaccrgcaaagcaaagaaattgtgagtctacaagattctttcaacactatgccctcaaaattgactgttcatgtatgtgcagacatatagaaaaacaacgggagccaggcgcggtggctcacgccggtaatcccagcactttgggaggccaaggcgggtgaatcatggggtcaggagttcgagaccagcctggccaacatggtgaaacctggtctctactaaaaatacaaaaaattagccgggcrtggtggcgggtgtctgtaatcccagctacttgggaggctgaggcaggagaatcacttgaacccaggaggcggaggttgcagtgagccgagatcgcgccagtgcactccagcctgggcgacagagcaaaactctgtctcaaaaaaaaaaaaaaaaaaaagaaaagaaaagaaaaacaactggatgtaaattgatgaacaaatgaagtagtgctgctttgggcagtgggattataagagtcctttaaagttgtctatgtgtttatgtttaactatataactagaagaaatatttatttattaggatatgataatggatgtgcttaaagtattacctgtaaggatgtttatggtttttatggcaatgttgtttataatagcagaaaatgagaacaggttaaatgtccaactatagggtaaaggaaaaataaattgtkgttaggatgggttgtgaggatccttaaatggctgatatatctttcagcaaaaaaagtaggttacaaaaaatatataccctatacaacataattccatattttatatgcatatcaggggagggaaaaactctagaagtgggtaatcaaaatgttaaaagaacttatctatgaatgagtgctttataactggtctgttcttcaattctcaattttccaaattttctgtgaatgtcctcttttcataatcagataaaaatcattgcactaggctgggcgtggtggttcacgcttgtaatcccagyactttgggaggctgaggcgggtggatcacgtggtcaggagttcaagaccaacctggccaagatggtgaaaccccagctctactaaaaatacaaaaattacccgggcatgatggcgggagcctgtaatcctagctacttgggaggctgaggcaggagaatcgcttgaactcgggaggcggaggttgcagtgagccgagattgcgccactgcactccatcctaggtaacacagccagactctgtctcaaaaaaaaaaaaaaatcattgcactatattaaattataatataatttgatgaacttattgtcaattaaaatgtgtacttaattaagaaaaaagccagccacaatcccagtacctttacaaatggtgtttccttctcatcgtctccaggtgctcagccgtatttctttagtctagacgttcccatttcccctgggtggacagggatggggcaccaagggtggatgggtggggcagggatgcattcagtgcaggggaaggctgactttacctcctccctcccaggcagaggggatgatcagcgaaatccggaccgcatttgaggaggccctgggacagctggtttggatggatgagaagacccgccaggcagccaaggagaaagtgagcrgtggctagggttggggcgccatcttgaggtggggttcaaggatacagttttgctaggaacctggggaaggaaacaaacccttaacctggtctcttcaggcagatgccatctatgatatgattggtttcccagactttatcctggagcccaaagagctggatgatgtttatgacggggtgagtacctacgctcatcagtactgaacttcagccctgtagagggcactgttccctgggcttagaaattggggctcaagcactgggaaagaggtgcttgtcggtttcttttagaggcagatggaggtaaccagcattgttaaaatgttggctctgtgacaggctgcaggccaaacagcagtgaaatatagtgctaacgagccaagatttggagtcaagcctaatcaaattctgtttctacctctaactttgtaaccttaacaaaatctctctaggccttggtttcattttctgtaaaatgggggtcctactagtgccttcctcatagggttgttgtgagataaatgaatacagtatgtaaaaaaacagcacccataacataaatggcctttaaatattgccaattatggtttactagatattttacagttgaggaaactgaggtttggagagatactaatgagtagccaaactggcgctattatcttctccaatggattctcttgctctctttctacttcccacctttcccacagtaygaaatttctgaagattctttcttccaaaacatgttgaatttgtacaacttctctgccaaggttatggctgaccagctccgcaagcctcccagccgagaccagtgagaatgacggggtggacatagacactaggggtggcaggagaggtgggggaaggttcctgggatgggggaaaagggtggcaagactggtcccagaccggcggccccatacccttgcaggaggtagggcagggctgttgggaggggagcagtgtcaggagagtcgggagcctcagcccctcactcttcctccgccaggtggagcatgaccccccagacagtgaatgcctactaccttccaactaagaatgagatcgtcttccccgctggcatcctgcaggcccccttctatgcccgcaaccaccccaagtgtgtctgaagcaggaggggctgggtgctggggcctgggcctgtggttgagctgggagcagggctggaggtgggattcagaagtacccccgccatgtcctcacttgctattcctcacccaccagggccctgaacttcggtggcatcggtgtggtcatgggccatgagttgacgcatgcctttgatgaccaaggtaggggcccatggagtcgtcccctctagcctagaattcccagtggctcctgcaaggccttgggacattgatgtagccccaagggccctgaagtctgtggaccagggctggtgggggcactgctgcccccaagagacgagctctggttttggtggggtgcaaaggtgagttctcctcagggcgcgagtatgacaaagaagggaacctgcggccctggtggcagaatgagtccctggcagccttccggaaccacacggcctgcatggaggaacagtacaatcaataccaggtcaatggggagaggctcaacggccgccagacgctgggggagaacattgctgacaacggggggctgaaggctgcctacaatgtgagtggcctgaccagccctccagcggctgaggcctgctggcctggggtgaaaggtgccgggtgggtgggggcaggcctggatgggcttgttgcccactgttctgtccccaggcttacaaagcatggctgagaaagcatggggaggagcagcaactgccagccgtggggctcaccaaccaccagctcttcttcgtgggatttgcccaggtatcaccctctcggaaggcctggggtctgcccytttgtcctgctccctcctgagtatgtcattaggagaactctggggcacgtgtcaaacgggctggtgaatggggctgaggctggggcatgaaaggtgggctgggaaggcccatgcccagagcctccggccagccagggcccacaaaggcagcctgaagaggcctgagcgggagaatgccttggtaggatttcgcatagttcaaagggcaaggttgtcgtgcttgcggggcacagggtggcgaagggggcaaacgttcatcctcacgctgttcctgtgagggagacatgcaggaaacgaaagctcgggacgcagagtggcctgtccrgggctgcccaggaatagagtaagtggcagagcaaggacccaggcagagcctccgctgggcagccacagcaggcagcttctggggctccgctttttcccctcgtcatgtccatgctgggcaacccgatgtccagggcagttttggaaggaacttgggaggggctgcagcggtggtggtttgtgcccctgggatggctgtagctgactctaaggcccggctccacactagacaccatatgcccccatgtctgtcctggcccgcaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctggatcaggggagaaatgsccagctgtcaccagacctggggcagctctcctgacaaagctgtttgctcttgggttgggaggaagcaaatgcaagctgggctgggtctagtccctcccccccacaggtgacatgagtacagaccctcctcaatcaccacattgtgcctctgctttgggggtgcccctgcctccagcagagcycccaccattcactgtgacatctttccgtgtcaccctgcctggaagaggtctgggtggggaggccagttcccataggaaggagtctgcctcttctgtccccaggctcactcagcctggcggccatggggcctgccgtgcctgccccactgtgacccacaggcctgggtggtgtacctcctggacttctccccaggctcactcagtgcgcacttaggggtggactcagctctgtctggctcaccctcacgggctacccccacctcaccctgtgctccttgtgccactgctcccagtgctgctgctgaccttcactgacagctcctagtggaagcccaagggcctctgaaagcctcctgctgcccactgtttccctgggctgagaggggaagtgcatatgtgtagcgggtactggttcctgtgtcttagggcacaagccttagcaaatgattgattctccctggacaaagcaggaaagcagatagagcagggaaaaggaagaacagagtttatttttacagaaaagagggtgggagggtgtggtcttggcccttataggaccctgtgccaataaacagacatgcatccgtcagcctgtctctcttccttcagtcctgttttcatgtatccattcactcattccaccagcgtctatagagcaactactgtatgccagccactgtcgtcagtgctcatttactcactagtggatacaggggactgagatttgaagcccagagaagacagagaaagagaggcaggatggaggaatggaaggaagttgagtctgactgggcagaatacattgtctgctaactggtggccatagcctcatccccagctgttctacagctggaaggatttgctgctttcctccactggtgcgtgcagccaggcctgacactgagtgtgggtaactactgggccagggtcaacttggaagatgggcggcccttaccctgcagtggtgggaagtcctgggcatatcactccctgagctcccagagctcaaagccctggcctctgcttgtagctgaaaagacaaacatttccttctagcctcaaaggctcagagctcccaagagtcagccattccacctacacacactcattaggcctaccaagtgccaggcacagagactgcatatatggcctctaccctccagagtgagggagggaaaaggaacgttgattgaatacctcctgtgttccaggcacctgtgctaggtggctcatttctttattcattcatccatttattaatttatacattcataggcttattttcaaaaaaaattgctttatcaacaatgtgtcaggcactggtgatacacaaatgaataagataggtgaggtggtgcgcctgtagtcccagctactcgggatgctgaggtgggaggattgcttaagctcaggagttcaaatccagcgtgggcaacatagcaagacctcatctcttaggaaaaaaacaaaacaaaactgatgaatgagaagtttcttcttcccttaggtgactcttcttctgttggcactttcgccttcatgagctcacctaatccttgcaacaaccgcccttttcaaatactctagtctccattttacagatctatccctaactacttcactgcagtcaaagagagctggactgaaatggaagctctgatagttttgtgagcttcagcctgttccctaaactccatgaacctcagtgtcttcacctatgaaatgagaactacagcaaaacagtggaaagagtccaatctcaattctctttattttttattcttgagatggagtctcactctgtcacccaggctggagtgcagtggtgcaacctccacctcccaggttcaagtgattctcctgcctcagcctcctgagtagctgagattacaggcgcgtgccactacgcccagataatttttgtatttttagtagaaatggggtttcaccatgttggccaggctggtctcaaactcctgacctcaagtgatccacctgcctcagcctcccaaagtgctgggattacaggcgtgagccacaacacccagcctcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttgaaccgggacctgggaggtggaggttgtagtgagctgagattgcgccactgcactccagcctgggctacagatcgagactccatctcaaaaacaaacaaaaaaacacaaaaaaaccttagtgctctccaaggtgcaagtagggatgagtttgttcagtgtggaaggggaggagtgaagctctggttatgattgctgctggtccttggccccttggtgaatggcaatagtatgtgtcccacaatctttccataaagagctgtatgtggatctctgtcatgtgacctcaaagtgctggctggccacaaaaggaagaaagtagccaactgctcagaaaggagaaaagtgtcctgaggaactccatgacccagggaaagcacagcctgagtctctaagagcatgactccagggtaaatggctgcgtgtattggaaagaggaggccatcacatctgcaggcctggtctagctccagctctgccacccttgagctgtgtgacattaggccttcaggtctcagtatcttctgcagtctgtaaaacaagtgaattggatgagacgatctttgaggagcatttctgctttaatgctctaaaaagtgaatccatgggcttagcaaattccggaacccaaagagatagtaagtgactcgtgacattcagatgagatttataatgtcagacagcataatgactgaggagacaggcttggcagataaagccttaccctttccctgacacctaatttcagaggccagcttaggattctgacaggctggccagtgggttattaaaacctcatattgcaaaaaggtcaaagtgtcaaatgatgatgatgatggctagccttaatttactgggtcactattttgcttaagcttgtgctaaacactttaaacataccttctcattaaatgcacacaatgatttgcaaggaggttctatcattgtctctattttacgaatggagaaactaagggaaaagatcacgtaacttccaatgtcagacaagacagattgcattaaagttagatttggaactcagatgcccttaatcactatcagttagtcttccaacacgacagaatttagactgaaacacacacatctgtcttctgggcaatttcatcatgcttctgagtgggaccatcaccagcaggtgcatttccatgcaacccagattccctgggcaaggcacatgtgacaaccagacagcttcaggaaacctaagcacacattgagctgaaatcaagccagggaacacctgtttgttgaacactctgcaggtgcttggttccagaggcaagccaaggtgaacatcaggtaagagatgtaacctttacccttagtagccctgtcaggctgagtatgcgtatgtgatatgctctggtgtgtccaggcagaaggggaaataagggatggtgctcctcggtggacacagggaagcaattataggtaaagtgctaggccatcccttatgcagtcccattggtaagtctaactaattcccatccacaataagctaacatatgccaagaagtatgatttcacacccttgatagcactttggaaatgtccgggtggaagagagtccctcataaaaataagcacagttttctgcaggattggaggtcctattttttttttttaattaaaaaaagcaggctgggcgcagtggctcatgcctgtaatcccagcacttcgggaggctgaggtgggtggatcactatgtcaggagttcaagaccagcaggagaatcgcttgaacccgggaggcggaggttgcagtgagccgagatcgtgccactacactccaggctgggcgacagtgggagactccatctcaaaaaaaaaaaaaaaaaaaaaaaaaaaaaaaaaaaaagcagttttagtgggtctatcatgatttacaaatggagaaacctcatgattttccagtgcctagttctggcctccaaagacagctcccagtgggttgttattatacacaaagatggcctgaagatgaatgcaaagccattcattcattcattcattccgcatgcatgcattctgcaaatatttatcaaggctcactacaagccaggcgctaggctggaggctaggagcataaagatgaataagacacagttccaggccgggcgcagtggctcatgcctgtaattccagcactttgggaggccaaggcaggcagataacttgaggtcaggagttcaagaccagcctggccaacatggtgaatccccgtctcgactaaaaatacaaacattagcggggtgtggtggtgcatgcctgtagtcccagttacttgggaggctgaagcaggaaaatcacctgaacccgggaggcagaggttgcagcaagctgagatcatgccactgcactccagcctggacgacagagcgagactccgtctggaaaaaaaaaaaaaaaagaagaaggaagtcatggataaagaggagttttagaaaaaaatccctctacagatgactgaagaaagcatgaaaatgtatggacaccgtgaagccagagatagaataggcagaacagttatggactgttgaatttttgtctgcagaccagcgctgggggagtcattggcaatggcaatggaaggtcatgcctagaatccaagcactgagtggaaaagagcaacaggtatttaaaatggattcagacctttacttccgtatctacacaaacatttacccaacattcactctgtgatatgttgtactaggtgtctttttcttcaatgtgtcagaacccataaaataagattgctagaagactcctgagtgttcccactaggtgaaagggagaagagatacttccttttttctcaccttacacgcacacacacacacacacagctgaagaagaaactctggggtttgcctaaaacagtcaagggctttgaagactgaaagactgagctttaaattttgattccgscgggcgcggtggctcacgcttgtaatcccagaactttgggaggccgaggcgggcggatcacctgaggtcgggagttggagaccagcctgaccaacatggagaaaccccgtctctactaaaaatacaaaaattagccgggcgtggtggcacaaaaattcaacagtccataactgttctgcctattctatctctggcttcacggtgtccatacattttcatgctttcttcagtcatctgtagagggatttttttctaaaactcctctttatccagctactcgggaggctgaggcaggagaatcacttgcacccgggaggcgaaggttgtggtgagccgagattgcgccattgcactccagcctgggcaacaggagagaaacactatctcaaaacaaataaataaaataaaaaataaatcctcattttactacttgatatgatcttctctgtaaaatggacctaaccctaccaatctcaaaagattgtaagaagtgcatggaatcactcgaaagcagtcctgacataagcgcgtcagtcacacgcctctaaggcttcacagggaaagacgagaagatagaggacgaagaccttgtcttgttctgcttttagctccagaacttggcggggagcacagggctttattgatcgatgtcaactccacctggctccccaaagtatttaaaatggtagccacgggaatagcagagtactctctttcaactggggaggaatatcaaatgaggttaataggccgggcgcggtggttcacacctgtaattacagctctttgggaggctgaggcgggcagatcacttgaggtcaggagttcgagaccagcctggccaacatagtgaaacccccgtctctactaaaaaatacaaaaattagctgggcgtggtggcgggcgcctgtaatcccagctactcgggaggttgaggcacgagaatcacttgaacctggtaggcggagtttgcagtgagccgagatcgcgccactgcactccagcctgggcgagagagcgagcctccttctcaaaagcaacaacaacaacaaaaccaaatgaggttaatattccacagtggtgtggggctagacacagttacacagactttatacaggcggcaatcaagcgtcctggacktcaagaaatctagtttgtctgtcgcgccacgcagtcaactggagtgtcactgtgggttctatttacaccgttatgagaaaaacctgtggcggagtaaaactcggtaactccgctcgcagaccgcccatctacagcagtgagcgaacccaaaccccacacggccaagtcccgcgggtttcaggaaactccgaagaggtcgggggccaggggcgactatggcgcgggggaggctgggaattgtagtctccacctgcctccgagggcggggtccgagggcggggctctcaggccga

SEQ ID NO: 10664 - DNA, 49371 bp, Homo sapiens
  misc_feature (1)...(49371): n = A,T,C or G, or insertion/deletion polymorphism (see Tables 1-2)
ttcaagcaattctcatgcctcagccttctgagtagctgggattacaggtgcgtactaccaccaccagctaatttttgtatttttagtagagacagggtttcagcacgttggccaggctggtcttgaacgcctgacctcaagcgatccacccgcctcagcttcccaaagtgatgggattacggcgtgagccaccgtgcccggcctctccttgctttctgactgtgtctctgttctgtgcctgtttctttctccctgccctggtttctgtctctgtggcccaggccctctcctcatccttggcccctcaccaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcaggtgagcctctgtggggtgctccagtgctgggagagacagctcagatgggagtgtggagacaggaggatgagaatttccactggggagggacattgtgtaggaagagagctctggcggagaggattgacctgggatgggactgtaattgcagaagtgagagaataccataggggatcagtctggggaagagtgaatctgtgtgtgtttgggaatccatcaattcagcaacgatttacggggcacccaccatgtgccaggcataggggatacagtgatgaacaagacaggccaagtccctgccctcgtggagctgacattctagcagcgatggcagacaataaatctataaaaatggacatcaatggccagctgcggtggctcacacctataatcccagaactttgggaggccaaggcgggtagattacttgaggtcaggagttcgagaccagcctggccaacatggtgaaaccccacctctaccaaaaatataaaaaattagccaggtgtggtggcacgtgcctgtaatccccgctactcgggaggccgagggaggagaattgcttgaacctgggaggcggagattgcagagagcccagatcatgctactgcactccagcctaggcaacagagcgagactccatctcaaaaataaatagataaaaatgcaaatcaggctgggcactgtggctcatgcctataatcccagcactttgggaggccaaggtgggaggattgcttgaggctaggagtgtgagaccaacctggacaacaaagtgagacattgtttctacaaaaaatttttaaaaaattagccaagtatggtggcatgcacctggggtcccagcttcttgggaggctgaggtggagggatcacttgagcccaagagtcaggggctgcaatcagctatgattgcacccctgcactccagcccaggcaacaaagcaagactctatctcataaaatattaataaaataatctaaatcaacaccaggcaatgataagggctatgaataaacatgaagctgtgtgtggctagagagtgtcaagtcgctggagaggggtcattcagggaaggcctgaggaaggacctttgagcagaaataacagaatgagcagtgcagattggtagggacaagcattcaggccgagggaacaggcattgcaaaggctctgaggtgagaggatgcctgaggaagtgcagggagccacttgtgcctggaacagagtaaatgagggggagaatgggaggagatgagggtatggaggtgacaagggcaggagccacagagggctccgagcaggggagggacatgactagcttcaggtgttcacaggctccacctggctgcccgtgggagcacactactgggataggacaggagcagggacctctgggaggggcgtgctgatacggtccaggcaggtgacgaaatggaccaggaccggtgtggggcagaggatagggcaaggtgagatcaggctctggaacagttttggaggcagaggcaacagggtttttaacatttggaattctggggaggaaaggattctctgaaagggaagaactcagcaagggctgaccctcctgaaacggggctgtcctgaggctctggacgggcaggcagcattgatgcctgcaccaggcctgacttcctgctctccttgtgcccctcagtctgtgccgacaacaaccacgtgcggacatggtctgtgactcgcttccgcggcatgatttccacccagccyggctccaccccactcgcttcctttaagatcctggctctggagtcggcagatgggcatggcggctgcagtgctggcaatgacattggtgcctactggctcctggccttcccaccccactgacccccttacctgacccctgttgacctccgctgattcccacttgcggccacctgacccaggagcctgcaacgattggggtgtcctgatccttgaggcacctgagctccactgactgccncaaccccccagccctctctggccctgcccaactctaacaacctggggatgggactggggtcttggggtggtgggtttcatcagtggggaaggaagtctgaggctgagggaatcccagctggccctgacccctgcccctgcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagccaaggagcattgaaggagcaaaggctgggagggaggacaggcctggtaggtttgtcttctggtatcaaaggtgtgacaggtgttggtgggactgacctggcgcagtgccagcccagtgcaggcagggccaggttgaaggcacagggggtggggtcagggtgggatggggggcccaggcggagggggaggggtgggatgggggcccagggggagaggtcggggtgggatggggggaccrgggggaggggttggggtgggatagggggaccaggggcaggggtcgggatgggatggaggagacccagggagctgtaggagccttgcttcagctgggaaaggggcctcggaggatgttctggatgaagggactctgagcagagacctagaggacaagtaggaaggagcagaagaaagaaggcaggggaagggggccccagcctgagggaactgtatgtgcagaggctgagaagggccaaatagggtcacatgggaaggacacgtgggctcctgggctggagcacagaacaggaggtgaggatggggtgcagatgcgggcgggccttgtcaggctgtggaagggctgaggctttgtcctgtgcggggagccgtggccactgcatgggggatgaaaggaggcttgatgggaggccaggagcccagggaggaggccaggaggctgataggaggtgggggagcagctgggacgggcctcaggtcttccctgcagtgggagcagggaagagcagaagctctgggagactccctgggtgtttggggctgcggtgtccaagagctgctggacccttgggactggaactcaaaagcaggctagggatggataaagattgggatggcccctggagaggcaggaactgcagccacagtggtggggactgggacgaggaagggtgagaaagcgagggtgaccacctcccccactgcaccccccagggtgtgctccgtgcgctcygtggacggctcacccacgacngccttcacagtgctggagtgcgagggctcccggcggctcggctctcggccccggcgctacctgctcactggccaggccaacggcagcttggccatgtgggacctaaccaccgccatggacggcctcggccaggcccctggtactccctgccccaccccaatcccgtcccaagccccacagcctcacccagaaccactctccactgccaactgcttgatctctctcccaggcccttgccctctgaccccttttcctttgaccccctctctgctccccatcccttcctgcccttgtttttcaacccctgtctcagcctctggcccccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccctcatggggctgtctccccagcccctcaccccgcatctccctcaccaggtagccacaactccactgccccttctgtgcaatgaggggagaggggacagcatggtgttcccggggacagagtggcccagctgccccgtgatgacgtgcacttactgtccttacttcctcagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccmcccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttytggaagccaaagtcascctccccaataaagtcctcactgccaacatcttgcttattcttagcaggtttgggactccccaggaaaggggtggggaagatgtgggacccaacccgatatatgcaaaatcaggaacatctacctctcttgtttaagcaaagggaggccaggcatggtggctcacatctataatcctggcactttgggaggccagtttgcttgtgctcagaagtttcagactagcctgggcaacataacaaaaccccatctctacaaaaaaatacaaaaattaagcaggcatggtggtgcatgcctgtggtcccagcttcttgggaggctgaggtgggaggatcgcttgagcctaggaggccaaggctacagtgagccatgatcacaccactgcactccagcctgagtgacagagtgagatcctgtctcaaaaacaaaacaaaacaaaaaaggtgttgcaggggaggaatgtgttggcttttactctgccttcaggcatggctggatccggggcttcaaacactaattcagaatatctttttttcttttttcttttcttttttaaagtctcactctgtcatccaggctggagtgtagtggtatgatctcagctcactgcaacctccacctcccgggttcaagcaatcgcaatcctcctgcatcagcctcccgagtagctgggattacaggtgtgcaccaccatgcccagctaatttttttatttttagtagagacagagtttcaccatattggccaggctggtctcgaactcctgacctcaggtgatctgcccacctcagcctcccaaagtgctgggattacaggcgagagccactgtgtccggcccagaatatctttttatctcctaacttcacttacctctggaatacatcttcaatcaggttttctctctgtggcaaggtgactctaagcagctgcttagcaactctttcttccctagcaacagcaaaaatcacaagactgattttcattggcttgaattaagtcaggtggccattcctgaaccaattactgtggccagtgtgatgaaggccttccattattgcagcctggatcatgtgtcctgctgtatttttagtagaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgmacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccacyggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaaggtgagtgcctctgaaaccggggtgttctgaaatagctgtgcacctcaaaccctarttttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacarccagctactttttaagtttttttgtagagacattgtctcactatgttgcccaggctggtctcaaactcctgggctcaagccattctcctgccttagcctcccaaagtgctgggattacrggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgcygtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccaggggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagyctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctycccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtscgggcttagaaatgctcttagaaatcragtcttttgtttttgtttttgttttttaatcacttttaaaaggctttaaaataacgtattttttcaataaaatcktacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcggccgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccamccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttrcactcctcgggcgcccggcccccggccccggctntaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccrttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctggkctggcsatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccawctgcaggtgagctggctctggcagaagygggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcycagcattttgggaggctgaggagggtggatcaccaggtcaggagttcgagaccagcctggccaacatggcgaaaccctgtctctactaaaactacaaaaattaactrggcgtggtggcagatgcctgtaatcccagctacttgggaggctgaggcaggagaatcacttgaacccaggaggcagaggttgcagtgagctgagatcgtgccattgcactccagcttgagcracactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcatrggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgyctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggcccygcccttccctgacccgcctccacccagctccagcctccctttgaccccacccctacccagctcccaaactgccagtttctatcgggncctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccstatccccaaactgctcctttcttctctagcccctaccccaccttcccttagcttggtccccaaagctctcctttctgcccttgcsctaccaaaccctgccctccacaattgcctctctcactgtgcccctctccggctgtcctggccggrtccccatcctggctctggcccaagcttggtcccgctcccgcttccctctacccctgcctccttgcgtcgcttctcccgggrctgtctgccccagtcccagccgcctggtctgtgcctacagatgtggacgagtgccacsgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcayggggactacagagacagaaccagccaggcagcttagtagggattggtggaggatgcagagtcagatgatggtgacaaggaggaatagagatggggtcacggggacagaatgttggagrgtggaaagccaaagtgacagaggtcagggaggcagaggggaacaagtgaccccgggccccctgccctgtgcagatgtggatgaatgcacccagagcscaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaargtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggcgtctgtcttcctgggaagagggagcagcctgaggcaagtccagaaggcaggctcaagactggaatgctggggtgggtggtgatggccatgggaatggattcaggccccttcctcagcctcattggtcccmtctgccccagatgtggatgagtgtgcccgaagccccccaccctgcacctacggccggtgtgagaacacagaaggcagcttccagtgtgtctgccccatgggcttccaacccaacrctgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcaggrcctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttsatttctgatccctgtctgatccctctcctgactccaaaatcctggcacaggtagttcctagaaacctagacccacaggacttgcaaccatggtccccggaacccgagaaccttggycagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgsgtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgaygagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccawctctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcrctagcgcttgcaacgcggtgctggaggctgctcccttggggactgaggaggggcgccctgcttcccagacttaggcggagggaaagaacaccctctcnccgtatctctgtagtggaaataagccgccaccgtgtccatgtattttcttgtgtcaggatcacggccaagcctcccttccagccgcagtccattcsccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctntgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctgggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccrgtccttctgcggtgcccacgccgtgtgccagaacctgcccggctccttccagtgcctctgtgaccagggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacncattatatttgaaagctsagactttcggacctttggaatcatagaagcttataaccactgagtccctctcccctgttgtctcctgcttacagatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgatggggaaagcccaggggggttttggaggaggcgcctggcccagcatgagaagaggattagggagttcttcctgtaggagasgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgtttttttttwgaaawttttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctyggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagygggtgatatggaggctgggagctcagggaacaggctggggcaggggcctggacaggagagracagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctrgaatgcagtggtgtgatctcggctcactgcaacttccgctcccgggttcaagcgattctcctgcctcagcctcccaagtagctgggattacaggcatgcgccaccacaccyggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagygtgagaggtgtggagtctggttctgccactgatggctgccaccctctgtttccctatctatgccagcctcagtttccccatctatgatagtggcggggctggggattcagcccacactgggctaaagctccttgtctccccaggcaygttcccaggctcgcagccccaggcacctgctagccccgttctgcccgccaggccacctccgccacccctgccccgccgacccagcacacctaggcagggccctgtrgggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcnggtgggcatgggcagacataaggctgagaggtgggcactaacaggcacagggccagagggrcttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctcyggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagayaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccabtgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttwtatatatatatatatatatatatatatatttttttttttttttttttttttttttttttgwaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgsctgggctgctcagcaggggaagggtccagcccctgggaggacctgagtgccaggcccactctgacacatgctgtctccacctacagatgacaatctgggagtgtgctggcaggaagtrggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtsccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagmttctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggtgagcaytgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcacyacaggggacgggccagcscaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcngtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccrcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttctccaagtctaccccagtttgtgctttgagtcactaaatgacattcccttcccttctgacccctagtttcgtctgtctctctgcctctcttggtctctgtcttccttctctctctgtctctgtcgttctatctcatctctgtctctttctgatttgttttctctgcctaacctctacatcctgtcttttcatttctgtttctgcatgcgtctttctcttttcccttctctttgtttggttctttcatctcgagagcaatcttgcctctggattttttttttttttttttttttttttttgagatggagtctcactctgtcacccaggctggagtgcactggcgccatctccatccactgcaacctctgcctcccggtttcaagcgattctcctgccttagcctcccaaggagccgggattacaggtgcacactacaacccaggctaatttttgtatttttagtagagacggagtttcgccatgttggccaggctggtctcaaactcctggcttcaggtgatccacccaccttggcctcccaaagtgctgggattacaggtgtgagccaccgcacccagcttttattttttagagatgaggtctccctatgttgcccagtctggtctcaaattcctgggctcaagtgatcctcccacctcggcctcccaaagtgctgagattatagatgtgagccaccgtgcttggcctagaagtcttaagctgtcctggaacaagtggggcaagagcagggagcaggagtccctggagggccaaacccagacctgacgctccagctaggagttggctgtggatggagtatggagcggcagtcctgacagctggaggcgggaatgagctctgtgtgtgatggtggagtgcccagcacggacctcctccatgtgccctgcctgcttactggccatgttcctagtccagactcctcctccctaaaaaacaagaacggcctagatcagcataaacttagggcaggagtaggggtcggggatcgtgggtgatcaacttggcactgggccaagctgggaaaaaaaaaaaaaatgtacctcagccaggcgcgatggctcacacatgtaatcccagcgctttgggaggcccaggcaggcggatcacgaggtcaagagatcaagaccatcctggccaacatggtgaaacctggtctcaactaaaaatataaaaattagcccgccatggtggcatgcaactgtaatcccagctatttaggaggcggagataggagaatcacttaaacccaggaggcagaggttgcagtgagccgagatgacgccactgcactccagtctggcgacagagccagactgcatctcaaaaacaaaaacccacaaaactgtacctgtcattcttcacccacctgtcaattcttgtgtccccagggtttcaaactcatatgctgcaaagaccagaaccggaatgttagcaggaagcagggaaaattgaggcacacattaccttctgcctaaggcttggttagactaggaaggggaattttccccattgttaatacttttttttggcctggcggggtggctcacgattgtaatcccagcacttcgggaggccaaggcaggatgatcacttgagctcgggagtttgagaccagcctggcaacatagtgagaccccatctctacaaaaaagtagctgggtgcgatggtacatgcctgtagtcccaactacttgggaggctgaggtgggatgattgcttgagcccaggaggtcgagactgcagtgagctgtgatcgtgcctctgcattccagcctgggtgacaaaggcataccttgtctccaaaaaagttttttttaatgtatatttttaataactatctgatattgtttggctgtgtccccacccaaatctcatctcaaattgtaatcagaattgtaatccggggaaggacctggtgggaggtgattggatcatggggacagtttcccccatgctgttatcgtgatagtgagtgagttctcacaagatctgatggttttataaggggctcttctcccttggctcgctgtctctcctgccgccttgtgaagaaggtgactgcttcccctttgccttctgccatgattgtaagtttctgaggcctccctagccatgcagaactgtgaatcaagtaaacctctttcctttataaattacccagtcttgggtggtatctttatggcagagtaagaatggaccaatagggccgggcacggtggctcatgcctgcaatcccagcactttgggaggctgaaacaggtggatcacctgaggtctggagttcaagagcagcctggccaacatggtgaaaccccatctctactaaaaatacaaaaattagcagagcatggtggtggatgcctgtaatactacctactcgggaggctgaggcaggagaatcgcttgaacccaggagccggaggttgcagtgagctgagattgggccactgcactccagcctgggtgacagagcaagactctgtctcaaaaaaaccaaaaacaaacagaaaaagactaatatagtaccctatggggcctatttggcctatgaggctccagttttaatcctctaggcactgctgaaattgcataaattgtggattggaggctgcttcctgacctgatctccagcccacccgctgagtgtcaggaggggtcacatgcccagcagcctcctgtgctacatcggggaatcatactaagagcgcctaccctgcaggattggtggtggtggttaaatgaattgtcatatatgtgcttagaatgtcacctggtacagagcaagggctcagtcattgttggcataaccctgggcctcccaggatatgctgagccctgtggctgggcagatagtaaggtcttgttcttttctcttttcctttccttcttccttttcttttctttctttctttctttcttttttttttttgacatagggtcttgctctgttgcccaggttggagtgcagtggtgccaccatggctcactgcagcctcaacctcccaggctcaagtgatcctcccacctcagcctctcaattagctggaactgcaggcatgtgccaccatgctcagctaattttttaatttttattttttgtagagaggggaccttactgtgttgcacaagctgatctcaaactcctgggctaaagtgattctcctgcactttggcctgccaaagtgctgggattacatgtatgacccacggcacctggcctggctaggtctttttctttaccaattctccctcccagggtggaggaggaggccagaccccatccccttcaacaggacagtgagaaacacctaacacaaggccttggtggggaggagtgtcagacaaggagtggctcaaggctccacaaaggggtgacagttgcacaaaactgtctgtaccaaaaatcattgaattatacactacacatgggtgacttgtgtggtatgtgaatcataagtcaataaagcccttctttaaaaacgccgactctacaaagcgtttcagaaagttaccctccagctgatacagggaacccgacccaaccactaattcctcagtcattcattcaacaaatattttcctgctttgcaataagtgaattcgaggaacacaaactttaacccagccttggggggtggttagggagggctcctggaggaggagatgttggagctgagagttgattactgtagggaaatgagcaagatgaaaggggtggaggtgcctataatcccagctactccggaggctgaggcaggagaatctcttgaacccgggaggcagaggttgcagtgagccaggattgcaccgctgcactccagcctgggcaacagagtgagactctgtcagaaagaaagagagagagagagaggaaggaaggaaggaaagaaggaaggaaaagaaagaaagaaagaaagaaagaaagaaagaaagaaagaaagaaagaaagaaagagaaagaaagaaagaaagagagagaaaaagaaaagagaaagaggtggagaaccatgttccaggtggaggggacagcacttccgaaggcctagaagtaagagagcaagtgtctgttagatgtctttcctttggtatctaaggcctgtattggacaacaatggtgacaatcttggtgcctgagaaatcccaggcccttgccttcatgggggacaccgacacatcaccacacatgagagcctgtgctgtatgggggaggcacaggcaggggtcaggctgcggtgggggaagatcagagggcatgcatgcccagaggagacacttgatccagtctgagagatgatcagggaaggctttctggagaaagagacaaagctctgaacagtctctgtttgggcgtctagatccctttgagaatctgtcgaaagctcattcacagaagaaaaactcacacaaacaaaggttgcaggcaatttccaagtattctcatccttcctcggaatcttctgtgggtatcccattcccaccccgcccccacaaccaccttgctgcataaatgtcccaggaattgcgacagggctggccaacagtgctggaaaactgcaatcgaatttcagcatcctgggagtgggatctttcttctgagatctcgcccgccgccgggcctggagggtgtgccccatggatctaattgttatcctgcctgcatcccctgcactaacccccagacctggcgttggggcttctggcactggccgggaccgacgcgttctcctctggaatgttcagagggaggtagtccaggcggtcaccgcgctcgccagacaagcaacgcagcgccccccgatggccaccgcgcgccggcgcagcccaagccggctgcgccccctagtggccgatgctcgtaaagtcttcagcgagccccgagcttttgctagccagcccttggttttgcaggctggggtcatcgtcgttgtcatcgttggcatcatcatcatcatcatcatcatcatcatcatcatcaatagctagtaggcttggcgtggtggcccacacctgtaatcctagcactttgggaggccgaggcaggtggatcacttgaggccagaagttcgagaccagcctggccaacatggtgaaaccccgtctctacaaaacagtacaaaaaagcaaccgggtgtggtggtgggcacctgtaatcccagctactcgggaggctgaggcatgagaatagcttgaacctggaaggcggaggttacagtgaactgagatcgaaccactgcactccagcctgggcaacagagtgagactctgtctcaaaaaaaaaaaaaaaaaaaaagctatgatcatccaggcagtgattcatgcctgtaaccgcagggctttgggaggccaaggcaggaggatgtcatgaggccatgagttctagactaacctgggcgacagagcaagagctgtctctataaaacaaaacaaaatgctatagaccagacgcagtagctcacacctataatcccagtgctttgggaggccaaggcaggcggatcacctgaggtcaggagttcgagaccagcctggccaacatggtgaaaccccatctctacactttgaaaaccactactttaactgtctctcccacagggagagctgcctccttcactctcagctcatttggttcacatgttgaccctactggaagactccagacctggccagtgagagaatcccttcccttcagcctttgcaactggcttagggacaggtgtgtccctgaagctggactgatgagcattggctctggaactactgctgattgttgaagaaggggcttcctagacatactgtgctgaaagggcacaggcttggaacactgggttcttacatgggagaagagctggcctgaaaatgcagccaacacgaggggaagcagcgctgggagaggaacagagagactggtgcctggcgcacgtcatctgcacctctgtctcacccttctccagaacatttctttgcatcttacatcaaatttgt

SEQ ID NO: 10665 - DNA, 123504 bp, Homo sapiens
  misc_feature (1)...(123504): n = A,T,C or G, or insertion/deletion polymorphism (see Tables 1-2)
atgaaattaaggctcataaatttaaaaagttcacatcatgagttaagccacagagagatgatgggaagtatctaggagttaggtaaagggcttcacactatttctagtctgtctgtgaaagctttctggatatgttggtgtttgagctgtatttcatgttttgttgtaaacatcctgtgatagattaacattaggccaccccaccatttataacaaaactaccattaatgtgcaaagaattaacattgttgtgtcaggaaaaggaaaaccaaagtgaattaggaagaagcagaaaactgttagtgtttgaaggaagatactgggtcccagatggagagaaccatcagcctggggtcaggttggagccacacccctgagtcaggcacatagcaggtgagtaagcaggtgcctgctgcagatgtgtgtgcagcccgtgagatcctccccacgcttccttagcagcaggcgtgtcaactgaaagacacttcactcggggagaatgactttcagacatgaggaatggttgtcacgtgagtccgtgaagtgctcacattcttttaacagcatactcaacaagtcaacagtttataccatttgattttaaagatttcaaatgaatactgagcatttcctggtaaaaggcactttttaatcaacataaaatgtcaaaaggaaataacttaaatatttttcaggatatgatgttattcatatcatagacaatggactagctttattttatagaaactggagaaaatggaaatgtatatttcataacactcagtgtcataactctccctattcctacacaggttatagtcttgccttttatttttaacaatctgatggtaactggcataatgtactcagtattctaagttgtatttgttgatggcgatatgtcgtattactaaagaaagtcttccagagttaaatgtctgtttgtaagttaagtcaccatatatatacatgtttattttttctgcatgtatattaagggatatttgtcttatttagatggagtgctgtaaaattcaagaacagtgcccagcacttcgtgcctggagttccctggggatattctcagggcgatgactgaccattaggaacccccgatgctctcactactccattcctcagtcatgctgttcaagcctgatttccatataaacgggaagccctgtgtgtctccagcttgtgacgctgacttctggggtgctgtcttggctgtcggaggttttagggacttgaggaggaaagggtaactcatgagcgcctattgccgcaccgtcttgtcttgtaggaagccctaggtggagaacagatgctgagggattgggaaggcagagcagtacattctgagttacaggcggggagcctcagggcagatgcatggggcagccggtggggagacaggattcctgaggagacgccagcttcctaattcgctcagggttagctccagtcagtgtcggcttttaacactgctgagactgtgcctgtcgcctgagctttcctcttagctcagacacctgacttttcacccttggtttatatacagagaattccagcttgaacagaggaataatttgggctttattttaatagcagcgattttctgtgacatacatagaacgtcctgatgttaataaccgccacaaagtcccaccaccgaccttcctgcacacattctctcagactcaggctgttcgggccgagctgcagggccacctgggcccggtgactgcggtggagttctgtccctggcgagcaggcaccctcatctcggcgtctgaggacagaggctttaaggtgagggatggacgctggatggcgttcccgcgtggcacgtgctgtggaaagaactgtggtgacgggagctgtgcggttgcttcacggccacggccgcctgagtgatgttgtttctacctcacttctgcaaggcgcccgctatcctgatttccacagaaacgccaagcccggatgttttgccggggccgctggctgggcttggattcctgacaggacggttctgcggccccggatttcccacaactgcattcagggcctgggagcgcccaggcacgaattcttctccacggcattcccaggcccagagcagaagagccagtcccagggtgtggagggttcagtcggcacaaaatgaggctctagaagaaaatggaatgcgaattcagtttttatccagctgacatcagtgtgcgcctgacagtgtagacctgaccagcgagtgtgcacctgacctgacagggtgtagactgctacagtttccgcttggtgcctctatcttggcagcgttgaccaagtgcctgggaactgtttttcaccttgtttcatttttgtttccaattcttcaaatccaccagggttttatttatggaagtgatgttatttttttctttttgattctgacatattttatggtgttactacatttttattatttttgtgctcattttattgttttctgttttagataaccatttgtgttgactaatctgatagtgaatagtactgttagcttcacctgttgcaataatggcaacgttgttacctcttctaaagaatcctgtgtttatccaaaggtctgggaccattgtacaggatcattaatatacagttcatctgtgttatcaggtaaatttaaaactttcatgttttctgtaaataggttgtgtgtaacccactttttctagagcatattacagggcataagatggagctgggacattcgagtggatctgaatgaggcaatctcagacttacagcccttcactcccgtccacacagggagaggattcacttaacagtgaatgtccttgatgtttttcacttaaaattaaatggatgcttggagtctgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgagcttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcggtaagtgacatgaaaatgccacttaaagcatatacagatactttggtgacctggtagagttattgttatatcttctcaaagatttaacattctttctgaggttaatgtatccatgtgtggactatggtgctgtaatgacttaaaaacattgctttctatcagggtgaagcacatttcttggaagtacgttggaatcttttttctgaaattaattatatggaattactgttcggttgccaagaacaatgatacacttgatctttgatttcatttatagtttaattaggatatgtagtatttttcaatattcatttatctaatgctcctaaattactgacagtttagagtaagttttaaatgaaatgacatcctaggcaacaatttttttttaaggaaacaagacatccatttacttgctgttttcatcactaagtccataattttattatttctggctgactcaggaatccttctgctccaagtgcaacgtcgattaaacggcagtgctgccctccctctaggctataaagcagccggagctgggccgtggtttaagcccaccaggccttctgtcgggaggtgggatgggattcctcgggacccatctgtggtggactcaccgggcagccttttggggtgatgtccccagccttcattgtgtttatggggttttcaacatttgtattcatgtgcaagttttactttttggtgaagaaattattttggaatagttcaaacttgactaacagaaatactgtaagtaaatattaygtgtaaagagataagtaaaactgacagttctcgggttaattggtaccaggcacttacaaagctaaattttccgatgttcctttcaccagcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttaggtgagccttttaagttcatttcacaaagcctggataaagttgctgtttttataatttgaaaaagataattttgaaaacttagattttttttttccttttgacaaagttgaccgctgttgccttgtcttctcacccagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcagccagccaggtgggttgctcagaccctccctcaggcctcccacttggcccagatctttcaccaggcgccatgtcaagggccctaggtcacacaggggagagagagatcccaatgtaggagaagccaagggctgcaacctcagaaaaccactgaggccctgcaggtcatgtgaggggtgggccatcagcagatggaggcacctggtgtgggtggggacgggggtgagaggctttggtgaacagaagagcagaggcaccaaggcagcagctttgcagctatgggttgctttcctgcagtgggtgaccaaggagggcaggtcatgctgatcagaaaggtacactgcatgactcagatgccacctgcacctacccagcaccctccacgtccccacctggcctgtgaatcttagacgccacctacacctgcccagcaccctcacatcctcacctggtctcctgcrcatcncagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcaggtgcrctttttatctcctgtactgtcacaaaggagctgaccctctcctggaagaaaatgttgattttacttttcaatccaggggccacctctttcattggtgtgtgcagctgacgtttcatattacagaaatcatctctgggctcacagcctacactctcttcctcattctggttactcattctttcttttaggttgtgtttttttgtagatgactttaaactatttcttttcatattaggtctgaaattacttttatccagtataccaattttttcctgatgttttaaaccttggtttttgttatttatttgataatatctactgctgaaggaaatcttaaacttagttttaggaaatatgaagttaagttctttcaattgattatctcctctttcccactcccttgctctggttctgcacttgaagttgcattgctcccaggtagcytcatgctgggtgttaccttagtgctttcctcgatgcgtgatctgaytgactccatggtgcatacacatcatcctgggtgttacctttgtgctttcctcgacgcgtgatccgagtgactccgtggtgcacacgcgtcatgctgggtgttaccttagtgctttccttgacgcgtgatctgaatgctccgcggtgcacacgcatcatgctgggtgttaccttagtgctttccttgacacgtgatctgagtactccgcggtgcacacgcgtcatgctgggtgttaccctagtgctttcctcgacacgtgatcygaatgctccgcggtgcayrcgcrtcatgctgggtgttaccttagtgctttccttgacacgtratctgagtactccgcggtgcacacgcgtcatgctgggtgttaccctagtgctttcctcgacacgtgatccgaatgctccgcggtgcatgcgcgtcatgctgggtgttaccttagtgctttcctcgacgcgtgatccgagtgactccgtggtgcacacgcgtcatgctgggtgttaccttagtgctttcctcgacgcgtgatccgagtgactccacggtgcacattcactgcagcatctctgtgtggcagtcctcagcctttaaacttgacggatgcatttaagttcacttcttagattctcaataattctgtccctagaagaaagccagcttccctctacaagtgmtctgggaaaaggagagcaggttgaagtaacatttcctgtactgagacttgcaccctgtgatctctcactcatcccaaattctgcatgtggatggtaagtatcaaaaactttgcctrtgccacataaaggaaacctcttaaattccttagatgaacattaggttcattttctaagaatgactgagataaaaccaaattattttggtctctgattattagtaacttcattcttgggattgcatgttttaaatcttaaagttggtaaacttgggcaatgatacgtaagtgtctttaataaaaggaattggatgatttttaagtttattaccaaagtctrggcagatctttgcctctgtgatacaactttttctttagaaagaggaaatggtgattggaatggcctagactttcccatctaccgctgtgctatacattacacatttaaagttaaccccagactaattttatttatttctgtgctcagtagaaatattattacatatttggcaacataaggaagtactgtttaactgtgattcaagaatatattacaattatgtttacttctcctccccaaaatgcttgagattagggggcaaccttgctttgaatggccttggccgttgcttgtctttgtctctgtgcagagctgcccctggagcagaatattccctgcttggtccaaaccacagagagtaagcagggtgggcatggaggctggacacggtgctcccggtgggtgcatggacctgaggcattttgaggcttccctggcttacctcgagcagagggagccctcagagctaagccagagccacatgacccattctgttgacgatggtcgttgggtgaaccgtggactggtgctggtggatgcccaggaggagcccagggtgctgcctggggcggagctggagaggggaggtctggaaagcaggttccagctgggggcctctgccaagtccatgtccagcctccctggagatggcttctcagtgtattaacagaccccgttggcattggtattaactctgccgcctcgggccagctactttcctcctggagttggttccttattcacagaggtgggcagcttgtgtggccttcaagtctagtcactcggaggctacctgagcagtggccttggcccaggcactggcactgaccttttctgtaaccttagaagaaaatagaaaccacagaggtcagagcgagcgtcttcacagacattagcaggtgcccaggggatcaccacaaatgcgttggtggcacagatgtggccagcctggcacagatgtggttctcactggcaagaacctgccccrgcccacgctctccactcctgcggagagctcacagccaggccagggggcgcacgtggggcccaacgcccacgctccccactcctgcggagagctcacagccaggccaaggggcgcacgtggggcccaacgcccacgctccccactcctgcggagagctcacagccaggccagggggcgcacgtggggcccaacgcccacactccccactcctgcggagagctcacagccaggccagggggcgcacgtggggcccaaccttcaggaataagattattgkgtattcttttctttttttccttaaatcagtctttcttctgagaacacccgatgtgtgtggatcggaagctcagtgggcttattcgtatttaacctggcaaacctggaagtggaagctgctttgtattacaagggtaagatctttgatttcaacgccatgtaactgtaatgttttcctttgactggtatgtggggtagtgtaagtgtttgtggagaaggccttgccgtgtgaatctgaggatgagatgcttcagtcacaactcagcattgagcacgtgagcacctctgtgctgctggatccgaaggacgagggcccttcccggaccctcgggcactcagccctggagccactccttgcctacatctgccaggccctcgcctggcactccaggccgcccgggccccagcagcgtggaacacctgcaggaacacccttgggaagcccctggattctccaccatccttagagagcctcccagagccccaggctcgcacagcgtaaacccggccgaggcgcactcctctccaaccctggctcccttccccagtttctgccagctccagaaatgtaggaatagtcacctccacccccaccccctcccccaagacccccatctcatccccccacccctcctaactccatggatgccaccagccgcactctttctgcccaggagcccaggcgacttctgaaaagcaggctggattccgtccctctcctccrctgcagcagggcctcctcggcrgcctcccgggcactgctcctctcggtgcctcctttctagccctgaacgctcagacctctgtggggctgtgggatgcatctgtgtcttcacacacgcccttcccttcagccgcccatccctgcccctccccagctcagccaggcgcagcttctccttgaaaactcagcctttccttcccccaaatggtcacagctctaattacacatttcctttctgatctggtgctggacatgtggcttctccaggaggctgagctgcaggtctcagtccgagtcacatcccagcctcagagcggagcctggcatgtgtgacgctcagggcctggtgtgtgtgtggtgtgtgcgctggtgtgtgtgtggcctggggccttgtatgtgtgaggatgtggtgcacagcctgcaaagtgtgtggtggggcctggactgtgtgtggtgggctctgggctgtgtgtggtgggctctgggcagtgactccgtgtgtatgtgctacctccctccccatcatgttcttcctggtcttygctcaactgaagatttccagagcctcagcatcctgctggccggatcgtgtgccctgaggaaccgcactgcggatcaaaaggtcagtcctgagacgcggccctccctgtctatgagacgtgcctctgatttcttctttcttcagagtgatcctgtaacgactggctgagtaaacgggattttgtgtgtaaaaacgttttaggagtgacagggcgatgtcgctgctatgagaatgaagcagctgttaggatacgtgtgcggatgcacgtttcgtctgcttttactgggtggtgtcgctaacgatgttgaaaccgcgtccctgcaggtgctgtgcttgctggcctccctctttggcgggaagattgccgtgttggagatsaacccggccgcgctastcagggctcagcagtgccccagcatggggcagagcctctcggtgccagccaggtagagtgtcttcaagtgtggagtgtgtgtgtgtgttcacyaataagtgccatctggatttctatgttcagaaataaagattagaaaactctgagctctggccgggcgcggtggctcacgcctataatcccagcactttgggaggccgaggcgggtggatcacgaggtcaggagatcgagaccatcctggctaacatggtgaaaccccatctctactaaaaaatacaaaaaacaattagccaggcatggtggcaggcgcctgtagtcccagctagtcgggaggctgaggcagaagaatggtgggaaccygggaggcggagcttgcagtgagctgagatcgcgccactgcactgcagcctgggtgacagagcgagactccatctcaaaaaaaaaaaaaaagaaaactcggagctctgccaatgctatttggaagaaggtttttcgtgctgttgcttctatcttgttgaaaacgaaatagttgatagtttattttaattgaaacactatttcataatagaatgtacattataaaacagcgcttttattaagaatatttttttcctacaaggataagaatacacttgacagttttcattttcagatactgttatgtccacagctgcaggaatcagtcatttggaactgtctttaaagtgtgtgtcactgaggcatttccatcgtatcgtcgtttgcgctcctagtttcatggggcttgtttctgtttcagctcctgtgtcctaccracctctccactgtatctgggaattgccaaggagaagagtaccaaggctgctagtgaacagcgacntggtcagtacagggtgctgtgagatctaagaatacaaggctgatgcgttctcattgtggttagggctgctgcattgcttygcgaattcttatgttaaaatatgcattccgtacttccttccatccttctgtccttcatgtctctgcctctcgtgcgtgttccatgtcyrcygtggtggggaacttgctgggtgcttcgcctcctgaattggccatcactcatgggattcagcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttgacaatatttcctattggtttgttctgagcagcagccaaacaaatccacatgttgcatctttcaaatatgtataaattaactttcactttaagatggtaaacgtcattatgttccctttctttcaaggctcactgataattcttttttcccttcagtgaccagtctaaccctttaattggtcttgtgaaacctactggacctcatttgaaaaacggaggcatttccgcagccgcctttcaccttctgcctggtagctgcctgactgctgggcctcacctcccagaagggccatctccccggccagcgacctggcgaccccacccttgggcctctccccgggccgggctcggctaggctgggctagggttcctgcgtcagtccgtcctcagacatgggctgtgtccttcatgctcccacgcagcccttgagcttgacttcggggacttctggcctctcccttccctaccagactttttgaaatcaggcctcgaacaccttctgtgccattcctgggtctcactgactgtgtggttctgacccgccttgcagatcggggagagctttcaggtggaaggcggggactcagagctgagcctggggctggagctgtttgcttgttcgtcctgccatggcggtccctgctgctgggggtttccagcaggtcccccattcctccgccctgtttccatgaaagayccactgtcggtgtgaactgcccgtctcctgccggtttatgctctgctgccgtcccatcaccatggggacagttctgagaaattgtgagaatgaaggccggggggaggcggccaggctcagccagcattgcagcctctgggccaagctgactcctcggctgggagtggcctctgacctccttcctcctcattaagtcatggaacttctgccttgtaaggaggtgctaattattcaccattgaaaaggcatcttaaattgcaaaagacactatagcagagaagacaacagcaagtgggtgtgaagatggctgagaagagaatgcccctgggctgctgcggcctaatgcggagctgggagctgtcggagctgggagctgtcgcctcctcctgggccatcccagcctcctcctcctgggccctcctgggccttcttggctccttcctcctgggccctccaggcctcctcacgtgatccctcccggcctcctcgttctcagccccccgaacctcttcgtcttcctggaccccacaagccgcctcacatgctttccccccaccccgcctggtctctcttggccctgtcagtctcacctcctaccattcatccttaacaattgacagcagcagaagtcagataaacctccaggtggacacaggcaggtccccagggaaacccaacctccaaaccaaagacagcttcacgtctgaaagccaaaccacatgtctcggatgaatccacagacgggattgagaacctcttttcctgtttggcatgctttcctctgattggcccccacccttcacctattttacatattcccactcctccctaattggtttttgacactgctgtgcccatctttgagttgtaccttttttttttaaccttttttgcatagtcacaaaccaatcaacatgcactcccccattctgagtccataaaagccccaaactcagccacactgggggaccacctgactgagggtagggggctgccctctccgggtcccctctctgctgagagctgtcactcaataaaactctccagctgggtgcagtggctcacgcctgtaatcgcagsactttgggaggccgaggcaggcggatcacgaggtcaggagattgagaccatcatggctaacacgctgaaaccccgtctctactaaaaatacaagaaaaatyagctgggcgtggttggcgggcgcctgtagtcccagctactcrggaggctgaggcaggagaatcgcttgaacccaggaggtggaggttgcagtgagctgagatcgtgccattgcactctagcctgggcaacagggcgagactccgtctcaaaaaataaaaacaaaaaaaactctgccctgctcacccttcagttgtcaggccaggcaggggcatcgccagcctcgggggtctccagctggcaaagaggcaccgagaagtctttcatcacaatgaatcttctcatatgtctaatctgggggctgtttatatgtagagtaatattctttcttaagtgcgttcttttctgatttgtctttttcacttcgtgtctgtgagatttgcttcagttgctatacagcgttctgttgtctggatatactgcggtttatgtacccacgatttattcagtattaacagacgtttggcttgtcccaggctgctgttgtgagcagtctttgcagcaccctgctgtaccctggagccgggagggctgccctgatcttctgtgcgggcagctgctgggctcggggttccccacatggcaggtcgatggcagacgatggcaagggtcttcccaggtggctggccagaggttactccagcagcacacgccgcctctcctgcccggagctcttgccatggctgcatgtcgctggacgctggaatttctgcttacccagtgtgagacaagaatagcactgggtggtcacaggaggacggaaaacccaggcaacagcgaagacaggaacgtggcaaagtaaccacagggcggcagaaaacccaaagcgagggagagagaaggcgaacccaccagcgtgatgtgtcctctgttctcccgggaaaaccygagtaagagacaacgaggctgtgttgggggttacctaaaaatcccctcctttcccagaatacctgatgatgatcccgcactgtcactaaagaaacacccgcaaaagaacacaaactcctctgtgcgcgcttccttctgaacggggctcctcctcctgagcgagccgcctccttctgagcgcccctcctcctcctgagcgcgcctccgtctcctgaacgcgcctccttctgctgtgcgcgccgcctaaccctgtgcgcgcctcctcctgtgcgcgcctccttctcctgtgcgcgcctcctcctcagctcgcctggcttctcacttaggcgtgtgctttcgctttgcagcaaaagctgctgcttttcgcatctaaattcttgctctgaaggtgccaagaacctggaaaccggctgggagtggggtctcaccagcctttggagaccctcctgagccgtctggcaaccagtgacgatacagaggtgtcttatgatttcgtttgcgttttcctggttaaacatgaggtggttattgcttgtgtttaatcagatacgctttactgtcataagcctaatttgcatttattatctcttcgctattattttgtacaggatcttttggattcatgttcttgcgtgattgatttctcaggaactttctgagtttggttttggtgtgccagctccacagaatgagctagggagagctttctctgtttctatacctgaatgcttggtgtaatattttaaattaggtatatgattgattttgagtataaaaccagccttgtatgtcagggataaatcccatgatgtatactctttttgttgtgttgttgaatttggtttgctaatattttattgaggagttttgcatcaattttcattagagaagtgggcctttagttttttgtttgtttctgttttgtttgtttttgtatttgttttttgraactgaatgaagtgcactgtgttctctcaaaggagatttgcgttgctttctaggggtttgggtgcacaaatccacagcttccggccttttaagccacttgtcaaggtcactctgactgcagggccagcagcctgggaccagtacagaccatcacggcacaggcttcctgggctagtcggagaaggtgaagctcgcatagtggccagggacttggcctttctgccctcacctccctgaggccacacaaatcctcagcctgtgtggctggaggtgccgccatccacagctcacctcagtttcaatatcttgtcctcattttcttttccctttttacaaaatgaagcacatatttcttctggcttttgtggcgtttctctgtgggagaggccatctgaatacctaaccagtgtgttacccagataatgaaagttagcattcactttttaaatagcagtaccctcaaaaaattgaaaaagtcctatgtagtaatgatgctaatgaagaattgaaagtgtttattaggtaaataatawggtcttgcacattgtttatgtggtaaagactgatttttgtagtcttgtaaaagacattttctgttcatttacttttttcattataagatatgtataaaataaaacttgccattttaaccatttttaggtgtatggttcagtggsattccataccctcacattgttgtgcaatgtaaaaaagcctttttgaaccatttgcttaattaataacaaaggaatttatatgtatatatacatttctagtaaaaaatttttggaaaccttgactaaccaatattaattaaaatggctaatagttggaatcatactagactgttcagatggttttccaaggttctgactgtttccatggaaagaaactcccctgtgagagtgggctccatgctgagtggcgagcagtgcctcctgcgtgtccaacccacggggtccgctcgtcttgtctgccgccatggacggctgcgcatttgggaagtgagatctgtgcacacaacctgtcgtgaaggagacacgagtctcctgatttcacctttaaaacttaacatgtttgtttctttagcttttcttcttacatacgcttcatttagatcactccttaaaagtggaatttttaaactttttgtcaacaagggtcatctcgtttcagactagcntatgtgatgtactgtggttcgcaactaacgatagcatttagagtttagaacaaaaccttcagtaagaacaattatataaatagttttaatacagagataacttttcwgtagcaagaaagtgattaaattttaacatgttgatgttttgggtgtagtttagaaaatattcccatggaaaattaatggatatgtttcatttacagtaatgctataatcyccaaatttgcctccctctacttacaacacttacccttgtggtaagttcacgtgatgtcagagtttttgtcaactggtagtgctatgcaaaatgtaaaataggctaggcygggcatagtggctcacgcctgtaatcccagcattttgggaggctgcggcrggtggatcacgaggtcaggcgttcaagaccatcctgaccaacatggtgaaaccccctctctattaaaaatacaaaaattagccaggcgtggtggcgtgtgcctgtaatcccagctacttaggaggctgaggcaggagaattacttgaacatgggaggtggaggttgcagtgagccgagcttgcaccactgcagtccagccttagcgatagagcgagactccgtctcaacaacaacaacaacaacaaaacaacaacaacaaaacaaccaacttgggctattttcttatccttttaatcccttgatttaatcttttgctgatgatggttggtgtgacttcagatatgaaacctcttaaatttatggtcaggaattcattctgtttgtgtgaatgtttctgttttgaagagactctgttcttcycatgtccatcatgagatgctaattttaagtgtttgtttcttctttaaaattgcctttccacagctgcacggaacgtcatgaaggaccaacgcctggttttccatagtaaagttaggtcrtctggttatgcgtcagcaccacagtgagtgaactcatgtcaatgagagacagaaatgcacctgcgtcacagatgcaggattttaacacaaatagggacacacatacatccccgagggccacagtatggagagaggacatagcaatagaaacagaagttaaaatgtggtgggttggaccccarcatgccagttagcagcagctgcagcagcaaacgtttcctgagcattcaccatgtgctgggcctcagagcagtcctccgagtccttttctgataacgtggtggtcccgggaggtgaggggaagctggtggggtgtggggctgggagagcatgacgatgctgtaaacaaacgtggcccatcaaggccggacacggtgctcttcttagaacacagctctgccgtaacatcagagcacgataacagagtgcatttaggccctgagtccctgagttagcaagactgctcaaaggcaaggagatacaaagcagctgagaaaccatgaggaggccttgagattccctaaaccttcaggagcccactcctcaaaggcaaatgtgacttttctgaagaaaatgcagacatatcccccgcctcctacctcacctcttgactttttatgtctcttaacatagcggccaaaatggctctgttacctggagtccctgaccgcagcgcacacgcttgtctccctggttggcactcacctctaccaagctcccgtcttcatgtgcccctggccactcccccactcccccactccccccccccgccccgcactgctgtgctccaggcagaaatcccaggccactctgtgtaaagacagcctccaaccctccaagctcttctgtgcccctggccactccccaactcccacccctcccagtggtactgctgtgctccaggcagaaatcccaggccactctgtgtaaacacatcttccaaccctctaagcccttccctgctctgcttgttctctggcttgaacaatggtgactgtgtcttattatctgttctttaaacccctgtgcctgggacagcactcagcaccctggaccctctcataaggcacttttggagggatggatggatggagagatggacagaaggggatggagggatgagagatggatgcgtgtgtgcatggatggtggggtggagggatggagagatgagagatgaataagtggatagatggtggggatggagggatggagggatgagagatggatgagtgggtgggtggatggaggggatggagcagtgcagagatgagagatggatgagttggtggatggatggtggggatggagggataagagatggatgagtgggagcatggatggaggggatggagggatggggagatgagcaatggatgaatgggtgcatggatggaggggatgaaggaatggagggatgagagatggatgagtaggtagatggagggggatggagggatggagagacggatggatgagtgggtggatagatgaggggaaagagggatggagagatgagaggtggatgagtgggtggatagatgaggggatggagggatgacggatgagtgggtggacagatggaggggatggagggatgcagagatgagggatggatgagtgggtgggtggatggaggggatggagggatgcagagatgagggatggatgagtgggtgggtagatggaggggatggggggatgcagagatgagggatggatgagtaggtgcatggatggtgggagatggagggatggagagatgagagatggataagtagagggatggatggagggatggagaggggcggagttgagagatggatgagtgagtggatggatggaggggaaggagggatgcagagatgagagatggatgagtagatggaggtgatggagggatggggagatgagggatggatgtgtgggtggatggatggagggggaatagagggatggagggatgagagatgaatgcatgggtgcatggatggtgggggatggagggatgcggaggtgagggatggctgcatgggtggctggatgaaggggatggagggatggagagatgagatatggatgagtggctcaattgatgggggggatggatggagagagatgagagatggatgtgtgagggatggatggcgagagatgagagatggatgtgtgcgtggatggatggaggggatggaggaatggagggaggggtggagggatgagtgaatggatgggtgatggttggatggatgaattctgctccaatggcatctgcagctttgtatggattccccagttctgccatattaaggcatgtcatcagtgtcaggctttgtgtgggagccccgggggatgaggggttgatagacattggtggccctgagtgccaacctggggctttggacttaaaggaaaagccaagcatcagggtcctattccaggattttaaaggagtcacaggacaatgtgtagcagggcgacatctctgaggtagcatgagagacacaggaggggaggaggtgacttaagggctggaggacaggtgggaggggcccgaaagcatttatgcagacgtctatatctatgtatataatttttttcactgtaaaatataaatctcttaagaancttagacctcttaatatttgagagtgatattagagttttctttccacagtgtaactatgttttcacyaaasaccaacatcaagagtgaggggaaaggatcttcaaggagcaggagcagctgcgcacggtgtgtgatgtagcgtgcattccaagtacatttgaaataacctagacctttccaacactttaactggttcttttccaaacagatataaaaccttatatgtgtacatgtgtttacacacatatgtacacagatatgtatatctatattatttatatatctttttagccaaatttctttcctgttaatttttcagrcatggtctgttcttaccaccttaacaattttgaaataataaatttttgttaaaatttagtttagaaaatgccgtagccgatgctcctccctgtcatgcaggtggattgggtgaaaatgttggggccgttgtagtgccaggtgctcattctgagtgggcgtggcccacgccattggggagggcacctgtccacgggactggctccacactggctgcggctctgactgtgggcatgtcctgcatacacctgggccccttgtgactggacagggaagagcttgggggacatctagggtccctcccagtcctagatttaagattacattgtccgaggagagatatgggctactgcacttaaaactcattttaacgtacatgggtctactttgcaatcactgcattacagagcgccaatattgattttgcccgcattcactgcatttttctgcagccttgctgctgtcctgccacgttctgcctgatattacgcacgtgcttgcagcaaaatgcattcaggccttatgcaggtgaaatgtggcatcagagttccgttcagctctgatttttttggtaattttttctgtgagggccccactgtccagacagagcacgctggctcttctgcatttggctctcttgggccttctgctgggagctgctgggtagcagtggtggcgaggccccaaatgccacccagggctcgggcgtgtgcacggaaggcattggcatgtgcacggaaggcatctgtagatgatttgagtgattagcattacaacgccacccacagcggcatgagactggaaagtgaaattcattttctcttagtgagaaccctcacccycaaatcgtcacagtactcacatgagtttatatgaaacacagcaaatccttgctgttttatatgtaaaatatgtgtcttttttggcaatgtggaatgtaagtctatttaaaagagttatttcctgattttgaatataagagtctaaatatagacatatagataaatattcaagtttactggaatacgattatacatgtagatggggggaagcccacttcgtttcttgcttatgttttacttctaatctcactgtgaatgtctcccratcaccgttacctgtggccttccctcagggaggcataccccntggagtgcgctgtgcccaccaagcccggcccccaggtcgctgccgcccccwcctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttgaagttgcatggcatggtttgtgtctggatgaaaaccgagactgcgtttcaytcgactgtagtgagggtgatctccaggcatctcacccctgcgtgggcacagacactggcactcactcactrgcagcgmatttgctgttctgtgtccagctcctccgrggtttgctctgtttgtcygacccctcctacagacatgttaaggtgggagggcttcggcaggcaaagaagctaatggaacagtcactgcttccctctggagacgcggcctctgctcatggatgggctggaggcgccaggctggggatggcatcytgcaggctgcgcacaggattccttccttaccggaccctcagccgggaccttttcctgcagggctgagtgtgtctcggcttccgtgacagtcgcccgattctcacgtgtgtcctgataatgccttcaccaggcttctctgggacctcagcacttttttctaaatagtgcttgaaagaagggaggagcagcttgtgagagtgctcttgacctcttgacctcagctgggtagttccaccacctgaacgcctctcagaagtgagatttccttgcaggcaagctgtgcccctgcctggggctggacacaaagtcctatctgggccggtaccctgccctaccctcatgccatctgtccagagggttgagtcgcctaagggttaccatgtaccactccgctaaattccctttattttattatataattgtagccaaagaagttttaaagtcattttcggaaattagatgtgtagtattatcagtaaatgtccttctgatctttgatagactgaacattccttcagtgttatctgccctcaagtttgaatattgtgggtgacatctatcatttctttcttttcttttttttttttttttgagacagagactcactctgttgcccaggctggagtgcagtggcacaatctcggctcactgcaatctccgcctcctgggttcaagtgattctcctgcctcagcgtcacgcgtagctaggattacaggtgtgcaccaccatgcctggctaatttttgtatttttagtagagatggggtttcaccatgttggccacgctggcctcaaaactcctgacgtccggtgatccacctgcctcagcctcccaaagtgctgggattacaggtgtgagccgctgcgcccagctctatcatttatttctaccctgtttttggaaaatgtttcaacataactgcttagccaaatatgcctctgggcaatctgctgatttgaggcaggctccaggaccttgtttcaggggccattggcatcctgtcctgggtgcaggggccttttgggtgcagcttttcctgttcacaaccttgaacagcagcctyactctctcatcctgctgctcatcctgctgttcctcttctgttaagggaggatggcgaggatgacaaaggcagcgccttacaaggtgttgggtasaggatgtgagaaaggattaacacggtctggcacctgcagacccccatgccgatgttagtgtttgtgttttagaaccaggttaactagaagttctactcttgcctgtggtcaatgtgacttctgtgaactaggcttttctacagtgtgaccctgtgaactaggcttttctatastgtgactcctgtgaactaggcttttctacagtgtgagtcgtatgaactaggatttcctacagtgtgactcctgtgaactaggattttctacagtgtgaccctgtgaactaggcttttctacagtgtgacttctgtgaactaggcttttctacagtgtgaccctgtgaactaggcttttctacagcgtgactcctgtgaactaggcttttctacagtgtgacttctgtgaactaggcttttctacagtgtgaccctgtgaactaggcttttctacagtgtgactcatatgaactaggattttctacagtgtgaccctgtgaactaggattttctacagtgtgactcatatgaactaggcttttctacagtgtgaccctgtgaactaggcttttctacagtgggactcctgcgaactagggtcttctacagcgtgactcgtgtgaactaggaatttctacagtgtgactcgtatgaactaggattttctacagtgtgaccctgtgaactaggcttttctacagtgagactcatacgaactaggattttctacagcatgactcctgtgaactaggcttttctgtagtgtgactcctgtgaactaggcttttctacagtgggactcctgcgaactaggcttttctacagcgtaactcgtgtgaactaggaatttctacagtgtgactcgtatgaactaggattttctacagtatgacccggtgaactaggcttttctacagtgagactcatacgaactaggattttctacagtgtgactcctgtgaactaggcttttctatagtgtgactcctgtgaactaggcttttctacagtgtgactcctacgaattaggcttttctacagtgtgagtcctatgaactaggatttcctacagtgggactcctgcgaactaggcttttctacagcgtgactcgtgtgaactaggattttcttttttttttttttttttttttattttttttttttattttttttttttttgagacggagtctcgctctgtcactcaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggattttctacagtgtgactcgtatgaactaggattttctacagtgtgactcatatgaactaggcttttccacagtgtgactcctgtgaactaggcttttcgacagtgtgactcctgtgaactagggttttccacagtgtgactcctgtgaactaggcttttcgacagtgtgactcctgtgaactagggttttccacagtgtgactcctgtgaactaggcttttctacagtgtgactcctgtgaactaggcttttctacagtgtgactcctgtgaactaggcttttctacagtgtgactcctgtgaactaggattttcgacagtgtgactcctgtgaactaggattttctacagtgtgactcgtatgaactaggcttttctacagtgtgactcgtgtgaactaggcttttctacagtgtgactcctgtgaactaggcttttctacagtgtgactcctgtgaactaggcttttctacagtgtgactcctgtgaactagggttttcaacagtgtgactcctgtgaactaggcttttctacagtgtgactcctgtgaactaggcttttctacagtgtgactcctgtgaactaggcttttcaacagtgtgactcctgtgaactaggcttttcgacagtgtgactcctgtgaactaggattttcgacagtgtgactcgtatgaactaggcttttctacagtgtgactcctgtgaactaggcttttcaacagtgtgactcctgtgaactagggttttctacagtgtgactcctgtgaactaggcttttctacagtgtgactcttgtgaactaggcttttctacagtgtgacttgtatgaactgggattttctacagtgtgactcctgtgaactaggcttttctacagtgtgactcctatgaattaggcttttctaagaagtctttttttaaaattcttttaacaggagatgggcagtggctggcctgtgggttggccaaccatctgttactcgtttttgatgccagcctgactgggacacctgctgtgttttcaggtaaaacatgtcttaatttcagtcagtatgaacttaaggatgggtctcacttaggtcctggttatcagttgctaaaggacacttttgtttccttcaggacatcagcaaaccaaagccatggcttgaattggagtctaaactagatttactgagatcttcaaccaaacagggcaaacataactcatgagaacagcgtggcagcactttcgtggctgttgccctggaggccaagagccattcatttgtagagttttaggggagtgaatgaagtcaaatcctaaataattgaaatatatttaattaatgtaatcaaaaggcatacagttgaaatatattttgaaatttagtggggtttgtacatagacatttttataaatgtaacaaagcaaacaatttttttttaaaaaaagtagatctgagagcaacagtgttaaaattatgaccatttcaactcataactgggacatatatttgattcctaattctaatcccataaaacctgccagctcttcattaggatcctgatatggcttgctttagaacttacacttggtagatattttaacagaagcacagaaacaacacaaaatatctcactagtccttctgtttttatacaggttgagcatccgtaatccaaaattctgaaatccaaatacccccaaatccagaacactttgagtgctgacataacatcaaggagatgctcgttgaagcatctcagatttcagatttttggattagggttgcttacctgccataatgcaaatactccaaaatctgaaaaaatgggaactccaaaacacctctaatcccaagcattgcgaatatgggacacacagcctgtcgcgtgaccaccccaagggcagtcattaggaaacgcggaggtggggcctggtggggctgagttggggacagagacagtgggaagcaggcctaggcaaggccacacctgggagcagatgagcgcccccagtgactcccgcctcacaccctctgcttgctaacacccagggccaggtctagcaggcccccaagggcaggcagagccgggctcggctcctgcatgagcaaagctgccgccccctgcatggtctgggtggagaacggttctccgggcttggcctggatgccacccttgcccttcgagcgccttgctcctggtcccacctcatatctatcctgcagcctcagaatcttcacagtgcacctgggagccctgagccggcctctttcgtggctgaatagttgatatgagtggttgttctgttgactgtgggtgtttccctgtgtattttattgttggaaaaagggcttctcactaaactgaaaaaatgtagtgggttttcaaattcatctttacaaaaacttgctctgtttctgtgggcgggggggaagggccacatttaaccatctcaactgcacaagccacatcgtttcactttgggtgtgtaacgtttaatagtggcatcgctcaacgttgaaaatatgactggtctctcagcacctgcccagaacacagaaaaatgagtgtctttatttccattatgatctgtgacaaataagtataaattcaaattctctcctggagagttcaggggcctctgagcatacagtcaggtagcacatcccagcttgaaaaccactgagagcaaccgtatttaatttaataaaggagttatgtgtttctgctttagattttagaatttttcctatcaaaaattgtgtctagtccaaagacaggtacttgagtcccaggccttccgccgagcatgtgcctggcacagagtagattctcagcgatacgggatggcggcttctgagcgcgctgcgcgggagagctgcgtcatctgtgacgcgccctggagctagcggtgatcgttgtgaagttctggggtcaggcatttcggaagattaaatctaaaattccattacagatagtggaactgtataaaaacgagaaatctttgtccaagtatgaagtgaagatgcgcatctctcctggtcccgagctcttggttggctcgagctgcgccgagtggcttctgctctgctccttctcggagcggggactgcccacgccggcctccatgctgcttatgtccccacacccttgactgcttccccagcgcggggtccatgtccaggggaagtctaggtccagaggtctaaaaccctgacctaggtagggttttagaatccttttcactctgtttctgaagcttctcatctcatcacactcaccacaggggaaactggccaactgaaaagaggagggaggccttccgtaccgtgaggagatcgtggggagagagaggaagaggcacccatgtggtcccccatgggcaccttgcttcgtggggattggctcccgagggcccggccttgcctgcggtgattcgtcttcgatgcaccctgcggcccgcagcgcttcacgcatgtgtttggggctggagctcgggagaggagggggatcccacctttggcaagttctaaggaatctccattgttttcatcctgggagtgggaggtccgtccctgacacttgagatgaaggaccaagctgacttgtcggggctgagcagaaggtggcacttcgcaacccctgcattgccggtgcctctgctggccttggtggcttagtggccactggacgtgcagcaaacgctgtgctggtaggaggaggtgggaaggacgagaaaaacacatttctcagtctcactaagaaggaagggcatgagtagcagtgacttgaccctccctcctgtgtggcctcacgtagaaaacacatcctcagtctcactaagaaggaagagcatgggtagcagtgacttcaccctccctcctgtgcgacctctcgcggcctcttgcagccaggcagtggaggctggtctgagcttgatattggaagacagtgcgccacatggctggtaatggagtgacttctgaggtcagtcaccgggcagatacgtcaggcccttcccactgggaggacgcccttatggcccaggctgcctggaccaggccctgcagcaggtgtctgtgaacctgcgatattcttggatggtgcagagctgcggacaccgctggtgttcggtacaagcggcatgggtggtgtctattaatggcagtcacaaacgtgactttcctttgagtcttgcagctgctgttagctgggcagcagtgaggaatgtttggagctttccttaaccagcctctgtacttttgctaaaactgccagaactctacacgtgagggcagcaaagctatttcacgtttttctgcgctgtgaatttcagctctgcgtttcctggcgtcctgttgcagaactgagttatgttcatattcttatatctttcctggttttgccttttttatgttgataccctgacagatgtgatgtagtgagattgcagttcattgtctagtctataaattgtgatgtgtgattcacatgctgaggcccacaggaaggggtcttctgctccgtggggagatcccggctatggcaggaattttctcgggagttgtggttacccattccctgtgagctatggaggcaaaatggggtcgtcgagcaggtctagggtcatttgtcgtcaggaagcatgagtgaggctgcccgtcagtcttcttcttgccatcccagcccgggtgctcaggggtcagaggctgcagggctgggtgcggcctctccttgccctcacctccccagctcgtcccctctcgccctcctcaccatgccacacagctggctttggctccagggccgacctctgagaagaagcgcatccctggtcgtctttgctttctcctttcctttgtgtccgccgcttcttagaaccgtcaggtggtggcagctgagagactgtttgaagatgcctcctgccctgacagccgttctaggggttatgaggcaagacaggtccagaaaccagcacgtgctcagggtctgggccccagggttaggctgggagtaggatgaggtggggagtggacagaaaagctcctacaggtgtacgaaataaacactgtgcctcatcgcctaccttagtttaatatcagagcagcacacactgctgatattcagacacctgaagaccagcattggcgctctcagaaatcagcatccaagcagccattgtgagtttagacaaaacttttcaaatctgtcacaacaaatgatcaacttatatgtgtgtgctcagggatttttttttttcacttttttcttcaacgttgacagcagttctttaaaatactgatacattatcatggagtccacagatttctatactgtagttcataatactaaatgttatcatgttcttttctgaaaacatacactcacagatgcacacataatgttgaacttcttagtttaagaaatgcgaggttttacactgccgggccgaggcgttcactcacaccccaaaccccagcaccacacagtacccagcaccacgcagtacccggcaccacgcagtacccagcaccacgcagtacacgctccacacagtacccagcaccacgcagtacacgccccacacagtacccagcaccacacagtaccgagcaccacatggtacacgctccacactgcctggccgaggcgttcactcacaccccaaaccctagcaccacacagtacccagcaccacgcagtacccagcaccacgcagtatccagcaccacgcagtacccagcactgcacagtacccagcaccatgcagtacacgctcctaacaaacccacacctgcacctcctgaatctaaaataaaagttgaaaaaatggaacgtgaggctttagagcaactgccttcagaagccacactgagtctctactgaagggagatggtgcaccctgcctcaggctctgcagcctcactgtggcgaggagaagcctcctggcgcgcccctaattacttgaaaaatgctgttccagttgtgttgtatgaaagtaccagataagtagcactcagtcaaaactgatattaatagtagaaatagtaaccttctgtggtcattcctgttaggtcacgacggggcagtgaatgccgtgtgctggagccaggaccggaggtggctgctctctgcggcccgggacgggaccctgcgaatgtggtcggctcgtggggcagagctcgcactgcttctggtaatggacagtcatctctgccatgggcagtcatttccaaaggagctgagagcttctcaaaagtctcattcttttaccttaacaggagatgaggaaagggacgtaagccaagagtttgctttaatgcaataaaagttactgattaaaagttattgcttcaatgcaataacagttattgattagtttctttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaattagtttcttaaatgtgtgtctacatgtatatgttcacacacatgcaataggcacagacgcatatacatgcatacacatacgcacacttacatacttgccacatattcacatgcatgtaagaggcacacgcatatagatgcatacacatacgcacacttacatacttgccacatattcacacacgtgtagatgcatacacatacgcacacttacatacttgccacatactcagacacacgcagtaggcacacgcatatagatgcatacacatacgcacacttatacttaccacgtattcacacacatgcaataggcacacacgcatatggatgcatacgcatacacacacttacatacttgccacatattcacacacatggagatgcatacacatacgcatgcttacatacttgccacatattcacacgcatatagatgcatacacatatgcacgcttacatacttgccacatattcacacacatgcaataggcacacacacatgtagatgcatacacatacacttacatatttgccacgtattaatacacatgcaataggcacacacgcagatagatgcatacacatgcgcacacttacacacttgccacatgcatgcatacattcatatggttaaatctatccttatgtttgttatggtctgcgaatgccacatgattaatactgaaacatttgaagaattttaaatattgattcagtgtgatttcatagtccagatagcagtaatggccaaggggctattacgtgggggaagtatattttagggagaggagtgacttgttttgatgaacttacgggagatcatttgggagcagaacaggaaaggagagacaggaagatgatagataaccttatgactaggacagggaaagaaaaggcaatggtaggaaactcaccttcaaatcatgaaattatgagcaggcgacttgcaaagaacataacataaaaagcagtccaattttcaaagatgttgggatttattttctttgcgtcttttatagaaaggggattgaatacgagaaagacaagaaaggaagtgtcaattaaagaagacctagggcctctaaaggtgaagcgtttggcagcagcttcaggaaggagtttgctgagagctgtggatgccgtcagcttgctctgtgtcataacgtttggttgtgaggtctaaatttgagagcagacacctcagaactgtattttaaaacattttgaatttcagctttaataaaatctttggtacttagtatgtttactgctaagtttcgattttcttttaaagttgttaaatggctggaattcaaagcattcattacagtaacattttaatcatataatacctttcagaagtagtaggcagaaacaaaaattgtagattgggtctaacaaagtttatgtacacatttagaacaaatagatgttgggttttaagaagaaataattttatgtttagagcaatagtgtttttgttaacatttattatattgacagtaattactgatttgcattacagggcaaagacatgttttctaaacctatacagtctgcacagttctattatatagatgcctttatattgttatcttctggccctgaatttcagctactgaggtatcacattgacacttgcaaagatgagattaagaggtaggcaccccccgccctgtgcattatttttagatcacaggaagctgtttcaataatgtgatgttgaaaggtatttacattttaaaatgttgccccaaatttaataatgacctcatatcaccaaactcttgatgagagggaattatccagatcctactcattttaaaccttcctttgtattactatgcgcggggcctttggcatgacggaatcagagaatttgggggatttgagaatcctcaattatcatctcggctctgcagcatattgaagtgatgttatgtgggacaaatactattgataacataaagttaaattatgaactgtttcaaatatatacatatatatggggaataataaatatcttcttagctacacctagcttggacaagtattaacatttcactatctttgttttccagaatttttaaagaaataaaatattacagagggaattaggaacctatctcccagtcctgtcctcttccctttttcctccttttgagattgatatatttgcttcttggtcatagttttgtatttttgctgtatctctgtgtattcatgtcattttatttttttgagtgtaacatgagcacacctttcttaatcaaagttacgtttctgagatgtgtgccttcagtttgttaattggggcaggtgccctgcgctcggaatgggcactgcatctgcctgcttctctcatggagggacatcgggttgggacctgccaagggttgggcttccatccgatcgcatctgatagatgggcttgcaaggaatccccgatctcaccccgatctcaatgagagcatccccactctcatctatcctgtggcacagcatcccaggagtgacttctggcctgtgctggggcgggttgcatgcagaggaagggctccaggacccagcggccccctcctgcggcccctccctcagccttgtcttcagaggtgcctgggactttcagtcctaaagtttgtttttgagacggagtctcactctgtcgctaggctggagtgcagtgatgagatcttggctcaccgcaacctccgcctcccgagttcatgggattctcctgcatcagcctcccaagtggctgggattacaggcgccccccttcccccacctgccccccaaccacacctggctaatttttgtatttttagtagagacggggttgcactatgttggccaggctggtctcgaactcctgacctcgtgatctgcccgcctcggcctcccaaagtgctgggattacaggcatgagccaccacacctggcctaaagtttatttttacttactgggagggagcttcacaagtcagctcatgtcacagcgttcccatctcggctggcacagccctttgcccctgagagttggtggatcctcttcttgttcctgcctcctctttctgatcttgtgggactttctcttagagatcactttgcaggcacttcagttgggtttcgggaggcagtgaagctgaggcatgtcttcagttatatgtagcgggagatgggcaggattttctaagcatacatggaaataccctatagaaaaaggctggtgcatttgattacaggctgaagaaggaggacggcgtgggggatcttttgtatgtcaaaaatcaccacaaataattagatgttaatagaaaaacaggtttttyttcctaaagaaaaattaagrtagctaattcacttttcccctcagtatcataaaatatgatttttaaagtgatatgaaaactttcttttcatgtttaatgtttttaaagataaggtgtttagttgtagcagaaggaaagcaaaaatattgatcatcttgattttctcttccagatataaacagaagagcaagtccaagctgatttgcaggctctccacgacgggtgcagtagacatgaccagtttatcggcagtcaacracttttattcccgtatcctttctcccggatcctggtagggttttacgccctgagtgttgttcctctggcagaggcatgtgctgagcatctcgtgagtgtcaggcattgtgtggggctccgggaatgcagggacccttctcatggagctcgccatccttgtgttaattgtacgtgtaataattcatctcaacattgagaaagggcctcagaggaagaagaaacctgagtgccgtacagctcatgccatccagcaggtgggtgggctgacctggcccttctgctctggactttgttgactaatgtctactaatttagtcattstatctcatctgcatagctggcaaaaatcatagcggttgctgttcaaaataatatgaaatggaatcccagaactttaatttttgagatttttatggctaacaccattgcttttaattttcaaagttgattttaatttatttaggggaaaagctccagatctttaggaattcattgtataaagttttaatttactcaaagttcaatctacgttgaactctattggagggttttgtagttgaactaaaagtgttaggaggttgcagtatgttttctttagaaacgtggtaatttcatgctagaataggtgttaaaatacctagcagaaataagaaatatgtcattaggattattctagcttaaatgatggtttctggaatacgagagtactagagtcaagagtaatccaacgctaacaccagcattacgggtctcttgactccagtgcacctgggttcccaccacctatacacattactacagcattcagggctgagcattgaggcttggggagtgctggtggtcacacgcgccctaaatgtacacattgctcctcataggtcaagtttatgaagcacgtcacggtcacctgccgacatggcactgtctgggttgtgtctcccatcrtgaagcctgccccaggtgctgtcacccattctgtggatctgtctaatcttagtccagtcctttctgctgagtgcagtatctacatattcaattatttgacatctgatttgggtgtttcatggacatctcaaacaccacgtatctaaagctggaactcacacctcaaaatagctactgtggtggtctcacttttcctaagcagccctcccccacccccgtccacctgctcttgccaacacctggagtcagatggggtggggctggactggactcaggacttttcctgcggcatttcagaaattcttaactagtcatccattcatgagtcttctaatattccaaagtttttattagtaaaagagagggaactgtcccttccccatgggtragagtgttgagaagagctccctaactggattatcrcagacatcgtactcgcagctggccggaacaggaccgtggaagtgtttgacctcaacgccggctgcagtgcagcggtgatagyggaagcccactcacggcctgtccatcaaatctgccaaaataaagtgagtaagtttttggataacatgtatcatctgtaaaactatgtgcttaaagcatttaacagatacaaatgtatgatgccattttataagtgtttgctaccaaattcaatgttaatttttattgatcattaaattattcgaagccttgatgtttgaccctaggagatattttaatatcatgttgaatgttaagttttctacgtttgtgtttgattattttatgggcccatattaagattttactagtaaaacattcttacataaaacttgataaggttgtatatgttaagcaataatggattgcatggtagacacataggttctatgaactggggcagccttgctaaatcagtagcttttttttgaaggtggaggctgttggatacagccagtctgttttgacagagacaaagtttacaaatatccacagcggtaggttaaagggtggcattacaggagaaacatttgatgagttcattgtctgatagctgcacggttcaaaagacacttggtacccaagagggcctctaagtcttgggaacaaaactgtatttcttaggactaaaactgcaattttggttgttgatatgcctggaaaggttttccaagttgaggatttaacttacgatgcatctggcatttatatcatgattcagggtatcattttgccaagtgaagtattgcaatgttggttaaacagactttgttatccacaggttaacacattttgcgtcttcttttttttttttttttttttgagacagagtctctcgctctgtcacccaggcgggagtgcagtggcactatctcggctcactgcaacctctgcttcctgggttcaagcgattctcctgcctcagcctcctgagtagctgggattacaggcatgagccaccacacctggctaatttgttttgtatttttagtagagatggagtttcaccatgttggtcaggctggtctcgaactcctgaccttgtgatcagcctgcctcggcctcccaaagtgcagagattacaggtgtgagccaccgtgcctggcccacattttgagtcttttaaatttctgtttaataggacaggtatggtctgattatctataaagttttttaatcagttcaaatcagaaagagcaaagattctgggctgctaagttaaattacattgaagcagatttgttcctgcatcttttctggataaaggggagatggaggtgtcagggccacaggaagactttaacgggtgcagcatgagagaccccgggattcagaggctccgtgtccaggaagatggtctccctgcatgtcggtctggatggctcttcagagaggcagatccagggacttggcagtgtggggtagtcagagcttcggagtccaggaggacgcctggggagactgcctgcggaagcgaattccacctccgtgccctccctgtgggcagccttggtcggagaagggagggtttaaaggctccgacaggcgtctttatcttgccttccttttaatcttccacccccccaccccaccacccagttcattaataggacatttcaagtttcaataggagaaggcttttctggtttgaataacaccatggaaatatcagcttggggagagttgttggagaaaagattatttttctgcattttttctttttgtttagactcttcctgcgtataaaccagagcaaacatgtttttaaacactgtgcagtgggtgtctcagatgagtgaagggatccctttgaagaatcctgtaacttctttacaaggctatgaaaacggcatacttcacaaacgaagtgtgaattagttgaatcagtgctgtgtgtaatactccatgtttctgtgttttctgggaaagctgtgaaggaaaaagaagtcagtttggtgatttatgatgagactaggcagcactgttggtatttgagagccatgatctgatactactaatttcgcagtaagatcttttaaatgaatttaataattgagttactaacttttaaaatgattgttagcctaatacccaccttattgattgattgattgattgatttgagatggaatcttcctctgtctcccaggttggagtgcagtgccatgatctcggctcactgcaacctccacctcctyggttccaatgactctcctgcctcaggctcccgagtagctgggattacaggcgcgtgccaccacgcctggctaatttttgtatttttagtagagatggagtttcaccatgttggccgggctagtctcgaactcctgaccttgtgatccgcccgcctcggcctcccaaagtgctgggattacaggcgtgagccactgcgcccgaccaacctgtcttattttttaggtgttatgattccttttaaattcaagtgcagcttaatgagatattgatagctaatatttggatgtagaatgttaaagtataaatctgacctactaaatttatttagtgaaacttccacgcaaagacatttgactttaagatacctgagtgcagactagggtttgcaccatctttgtgtctgatcttggtcgtacctggaacctggaatctgttcacttgacatgcgccgatttgaactgtgactcgctgttaccaacagaaagcaaaggattcgattctttgtataagaaagtagatgtaaatctagagaaaaaaatggtttcttaaaaagactcgtcagcatgtagatttcagaggttaaagtttgacaagtagtatttaaaatttgttgatatattattctcaaaatgcaatgtctaaaaatgtatctaaagataaagattgctaacaagaaaagtctctcctgagatgttatgtagttgtctatctggtcagtttttctaaaagtctgtgagtctttagataatacagttaagtgagaattgaccaaatttcttaaacattgtcattcttgagtttaaaaatttcagtcgtgaagataaatgaatcttatacgtgaagtttctttcatgttgtaaattttacttttttttttttttttttttttgagatgaagtttcgctcttgtcgcccaggctggagtgcagttgcgtgatctcggctcactgcaagctccgcctcctgggttcaagcgatactcctgcctcagcctcccgagtagctgggattagagtcgtgggccaccacgcctggctaatttttgtgtttttagtagagaggggatttcaccatgttggccaggctggtctcaaactcctcacctcaggtgatctgcctgtctcggcctcccaaagtgctgggattacaagcatgagccaccgcgcccagccaattttacatttaaaacatattgcttaccatgctttctgacacttgctgctgcttgtctcaaacattgtcaattattagaaaaatatttcttagttcatttaattttgtattggttgtgcatgactcttattaaaggtggtcattgcaaagccaattataatttatttttggtgtttggaaaatggtctgtcagcatttccattataaatccctattttctttctctttttgttcttttctttctggggtttatgacagagccataaaacttggtctagattaaaacttggcctgttagagcttaggctgagattttttttcaatttagttcccaaatttttaaaaattgtttcagatgtttaggttgcaaatgcaaaatataatttcggagtttttaatgctttctaatttataacttaaaaaataacatgcaaggtttaagataatggtaaagataattcttttaactttagctaaccaattttctaatattttcaagagaattattttggaaaatgatatgatgctatttggtgtgattttgtaattttatttcctttcctctctgttcccacttcataatagaagagtttctaaccttttgcatatataaagcttttctctgttaaagggttaaatgtatgtaaatctcttagtgtgtgctaagtccattaagtgaaagctatttttctaatttttaaaatatgaatttgtggaggcagatgggtactgctttagaaaactcttacgttccacatgcaactactctcacacagttcttttgttcctgtgagttttagggataaatgcacaagaatttctccacctgcagcagcagatcagaagctgagttagatatggtttcagtgttcaaagaaatacaaggcagaaggtggtagtcacgggtggaataacattcgcacaaggctgactgttctaagcactataaaatgatgtggaatcgctgccagagagtagggatgggaacagccatcctgtcctgggaggatgagagaaggctgcatctgaactggcattacccattctcacatactgttagataaaacttttggttttacgaggagtttaaaggcacataaaatggagaaatagaaagattgaataaacttgttttacctcctgtgtggtcagcaagtttgcactgaaagccgtgtggtgtcctggtctccctgtgacacgctgtgttcctgctggtagagcgactcatattttaaatcctgcaggcgggctgatgcgcatgaggctccaaatgtggagtctcagtctgttggggctgctttaacaaaatgccctagactgggatatttacaagcaacagaaatgtatttgctcacagttctggaggctggcaagtgtgagatcaaggcactggcagatcagcgtctcatgagggctttctgcttgagtggcggggccttcctgctgtatcctcaagtggtggatggaaatacaaactccttgaaacctccctcataagggcattcagcccattcatgcagactccactctcatgacctaatcacttctcaagggccccacctcttaataccattgcagtgggggtttcaactgatgaattctggggggagagcaacttccagaccatggcgccgagtcacccctaggtgcttgccagagtctgtgtgtggaattttttgagtgtcacagctaggaactaatgttcaccaagtctctggaacgccgtggcctttccctgtgtgttctcacaggctcagcgaggacattcgatggatgaggactcagagtgcagggcctccctcctccctctgcatgggctgtgagctgggagttggactccaggcctgcctagttcctctgcctggatgctgtttttcttccctccttaccatctaaatgtcaggttatctcaactgaacccagtatcttgaccaggtcaaccagctcctgacacttcacatcacaccccatgctgtggctgcacctgcctgagcaatgtggaggctccccgtgcacagcaccaagggaggaggatggagacgctgggcctggctcgcctcgggagcctcaggacagcaggcatggtgaatggcgctccagtacgtagacgatctccacattctgatacgtgtttttcctctcttcctctagtgctgatgtcattttggcttcttttatcttttatttcaataattgaggagacttgagccagatgagctgtgtttacatttagctttattctggcttttaaaatatgttgtgttggaagcatcatcatagattttttagaacacttcaagccgtaaaaaggcattgacttggagaacgaagatataggaagtgaatttgtagcataattaagatttgtttttaaaaagatgtttatattttgttagtttgattgtaatacatttattttcaagacttaaagcatcaaatttcattcttgtcccatttaatttactgtaatgaacattgtttctaaatatatgttagaaatcagcaattagatgatggtggtgaggagttatcgaggaaatcatggaggaggaccctgacaaattacagcggcgctggaggaccagtcctgagttacagccgctgtggcctttcacatcagaactctgctctccttaccaggaaatgagaaatgtgctgtcaggagaagggcagctgctgatctgttacagtgaggactctttagagtccaggttttcagctcctcggagacacaggcactgcccagtggtgctgttggcgtccacagcggggcatcctcatgcccagtccgccgggagacttctgcctttatctgttttacacactggatgaacgcatggcctctcgaagggctggttctgtgtgtctaaaaaccactgctgtgaagggtgaccatttcggcaaggaagtgctctgttgtggaacaatggcctcatctacttactcacggacgtggtgtgagtgtattctgagctgcacggtgcggactcatgtggaaagcggcgtgatgtcatcctcaggatcaccttccaggtcagaggcaggaggtgtattcagtttatgaagtagtctgtggggcctctgaacaaggcggggtcagggaaggtgttccccaggaggtggtcctggggctgagccttgaaggaggaggggacagctgcaccagcaggaggggcctggycctgaccccccaccgcccactgtgtggcccagagaaggcagcaggagcctggcacagcctgctgtgttctgcacctagccccacaggcaatgcaaccccccttggctggtgcctctgcagccaccctgctcactacagcacagcccccctctgtcaccctctgtgggtgtgcaaagcctcaggaaggcgacacccacacccgcataggtgcaggtgtgggaggcctagcgctgccgtcttctgtcccacctatggcctgcagttgctccccagcagctgtccccgcgggcttgtctccgcctatcatcacccactgtggacctgtgccttcagaaccccattcgggttattttaatcttcactgtcaattcttcagaggccccagcagcttttaggataaaagcccgaggctgcatgcagaccctgtaccactttctcgttcttaccctgtcagtgtccttggtgacgcctcagacccagtctcaagcttggcgcccacatgaagcccgggctgctgggctgggccattctctcacaccctggttggcttctgtggtggcctggacagtcacaggagggcatcagggccagctcccatgtgacacacatgctctatctgctgagaagaggcgggctctggcctcagagtcacagcatcatgaacgtggagcacggggcatcctcatcccccccagagccccagacggagtaggggtgccggcgtgagatctgagcaggcaccactggcacctaagctctgaccccacggagcagctaaggctccacactggtttcccgactgcacctgcctgccggtttcctgactgcacccacctgacagtgagcccagtgaacggggctgactctgagacacaggactgaccccgtcgggcctggtccccggcacttcagcccagggctctcagaagatggagctgagcgtccgccagctgcactctgtctgtgctcttgctctgtggcccgggtcacgggcagacccttccgactgtccaggctcagtctccaccaccaccccaggaggcctccctggcctctcagtagttggactcggccccttacttggtcttgtgtctacactgctgttccagggctcatcagtgcagtcggaatgacgtggaattaatcctctctcctgtgagagtctcatcttgaggacagagccatccgttactagcatacagtcggtgctcaaaaattgcttgcttagtccaagcccagtcctggcagttttaaggggcctgtttgagttacaaccrttggatctgccttcctttttcagtatttcagcagrgccatcgtggacccagaagaactccatgacctgctgctggcgcggacactccaggactcagcctttggctttccatagtggtgacataagagaagcagctacgtgtgtgtttattccagatgccaagtgaagcctagaacaggagttgcatcttgcaggtcccctcagtggatgggcyrggccccgagggtgagggctgccacagttgactgcccagccaggctgtgggacggctgctcttgtactctccatgctctgactcaagggaacctgtgttcctggtctcgtgccatctacctggagctgcagtgaacacacatctcgaatttttcatcccatggggttgcatggctgcggctcacgtgtctcatgggccaggcatcagtcacaggccacagcaagggctctagttgacggtcaggtgagctctcttctcagtggttgtcaaactctcatgggaaaattatttaattaaattggttactttatcctttttatttatgaaaattaatgaagttttctttagttattagagaacttgggaggtcacctgactccctggaaacggtcgatggctgttttcgatttaggtcctgcatgtccctggctgggctgagggggatcggggatggcaccagggcacagcccagcctccctccggctccctaagcagttccgagtggacacgagcgtttcattcactaagtcactcgagcttgagagagacgcatgaggggctgcactctggtgagcttcgaatctccttttgcacacctggaaggttctcgtgggtgttctttgtcctcggatccagagtgtatctgatgccacacgccgcacacctgatgccacacacctgacgccacacacctgacaccacacgccacacactgcgcacctgacgccccacatggcacacctgatgcgcacacggaacacctgccacatgccgcacacctgatgccacacgctgcacacctgacgccacacacctgacgccccacacggcacacctgacaccacacacctgaccccacacacggcacacctgatgccacatgctgcacacggcacacctgaccccacacacggcacacctgaccccacacgcggcatgtggtgtctccagggccccatgtccccaatcctgtgtctggtgttcacctcgcctcgtgggtggctgcctgttagctggttttgctgtttgtgtttgtgtctaccttctttttgctcakgctgtgtcactcctaggctcatttactaggacctagagaagtgtgccctcagccagtgtgaggaaaacaggcccaggctggcactgagtagccgttgggaggagttttcaatgtgctaaatcccatgattggggcctcacgtgtgtgtcaaaacaccatgctgtaccccaaaatatgtgcagttcttatgggtcaattaaaaacaaaataaataagtaaatgaccagtttttcttctaaacggttcagaataattcatcccaaatgtgggttgttgatgctcccccaccatggctctcttgggcaccctggctggaccctcactgtctctgcatgtgagtgggtaygcaggctgtgacttctgtgtgaagcctgcgggcccggtgagtggtgccgtcactggctgagggccacagctgagccactggggtaaccgcccaatggttcaccttgtctgctgcctagatagagccagttgatcaagacaggggaattgcaatagagaaagggtaattcacacagagccggctgtatgggagactggagttttattatgactccaatcagtctccccaggaatctgggggtgggagtttttaaggataatttggtgggtgggtggagtcagtgaatcacgagttctgattggtcaggtcagaggtgaaatcatcaggagtcaaagctgtcctcttgtgctgagtgagttcctgggtgggggccgcacgaccagctgaaccagtttattgatcgggtggggtaccagctgatccattcagtgcagggtatgcaaaatatctcaagcactgatcttaggttttacaatagtgatgttatccccaggagcaattttgggtaggggtgggggaggtggtcagaatcttgtagcctccagctacattactcctaaaccataatttctaatctttgagctaatttgtaggtcctacaaaggcagtctggtccccaggcaagaaggggatttgttttgggaaagggttgttaccatctttgtttcaaagctaaactataagttcctccccaagttagtttggcctcagcccaggaatgaaaaggacggcttggaggttagaagcaagatagagctggttaggtcaggtttctttcactgtctcagttgtaattttgcaatggctgtttcaccgggacgcttctcccgtgtcgaaacactgcagtgctctcctgaggagggacacagtaaaaatatcacttctttgaaaagtttcctgtttttatagctctggtaaaaataatgaataatagattttatgttaaacttcgttttcagtcatttcttcatctctttgtggagattgttttattcatattgttttccaagtggttctgtttttttctataaacattcagtgaaatggccatggagagtaaagtgttaacagtctgactttgggctgaactcttaattcaatacctgttcctaatagcagttaaatataccactgctcatttcctcccaccttaaatttggtttgtatgtgcgtgtgtgtgaaccctgaacatctgaggcaggtttcagtgaaactggaaagtttattttgcccaggttggggatgggtgccgtgacacagcctcaggaggtcctgacgacatttgcccgaggtggtcagaacacagtttgatttcacacgttctagggagacatgagacatcagtcaacatacataagatgaacattgcttcggtctggaaaggtgggacaactcgaagcaaaggcaggaagacacaaatcagggaggggaccttcaggtcctgggtacataagggacaaatggttgcattcttttgagtttctgatgagtctttccaaagggggcagtcagatctgcatttatctcagtgagcagaggggtgactttgaatagaatgggaggcaggttggccctaagcagttcctagcttgactttttccctttagcttggtgatttgggggcccagagatttattttcctttcacagtgtgtatatgtgtgcaagtatatgtgcctgtgtgtgaatgcctgagtgtgttcatatgtatatgcgtgaatatgtgtgtatatgcgtgaatacgtgtgtatatgtatgaatgcatgtgtgggtatgtatatgcatgcgtgcatgtgtgtgcgtctgtatatatgtgtgcgtgtgtgtgtgtatgtatatgtgtgaatgtgtatatgcgtgaatgcatgtgtgggtatgtatatgcatgtgtgggtatgtatatgcgtgaatgaatgtgtgggtatgtatatgcatgtgtgggtatgtatatgcgtgaatgcatgtgtgggtatgtatatgcgtgcgtgcatgtgtatgtatatgcatgaatgcgtgtgtgtatgtatatgcgtgcgtgtgtgtgtatgtatatgtgtgaatgcatgtgtgggtatgtatatgtgtgcatgcacatgtgcatatgtatatgtgtgtgtgcatgtgtgcatatgtatatgtgtgaatgcgcgtgtgtgtatgtataggcatgtgtgcatgtgtgtgcatatgtctacatgcatgcatgtgtgcgtatgtctacatgcatgtgtgcrtatgtatatgtgtgaatgcgtgtgtgggtatgtatatgcgtgygtgcatgtgtgtgtgtgtgtgtatgcatgaatgtatgtgtgggtatgtatatgcctgtgtgcatgtgtgtgtatatgcatatgcgagcgtgcatgggtgtatgtatgtatatgtgcatgcatgtgtatgcatatgtatatgtgcttttaattatagtattcattaaagtgcctattaattaattcatttaaaatatctattagctgctgctgtgcacttggcagtgttctgtgaatgaagagttagatgaagtgagggcaaagtccttgtgctcaagaattgtattttcttacataggaacacgtgtattacacaaggtcaggtgctctgtgctgaccaggtaactagagcagcaggttcatgacacagggaagggtgccaggtctatgtctggaggagcagagtgcaggaggagcaggtctatgtctatgtctggaggagcagagtacaggaggtggactgtgtggtgaagccggtggaggggtggacctcgagccccttgttaaatcaaaatatctaagacaggtctcggtcagtttagaaagtttatttcaccaaggttaaggatgcacccatgacatagcatcaggagttcctgacgatggtggtcggggcaccgcttggttttatacattttagggagacatgagatatcaatcaatatgtgtaccatgtactttggttcagtcaggtaaagtgggatttgaggcgagggcttccaggtcatgagtagataagaggcaaaaggttacattcttttgagtccttgatcagctttccactgaatacacaatttagtctagctcagtgaatcatcatttttacataaacaataggggagaggaagcaatgagatacgcatttgtttcagggaagcctcggagggatgtctttgagttctgactgtcctttgtccacaaggaatttccttgtgggcaaattgtgagggaggtctgtagcttcttatctttgtagctatcttacttaggaatagaatgggaggcaggttttgcctgaggcagttcccagcttgactttacccttggcttagtgatttgggggtcccaagattcattttcttgtcacattcctgatggacatctggacaagctggctccctgagacagcatccctgcaggtaaggtgtgtcctaaaggggtgaggactaggctctgattaaggggtctgaggagtcatgctttaaaaaccatcaattctcgtcagatgggttttatttaaccttatgtatcatgacttattttccaacctggctctggcataacattacaagacaaggaagaaaataaaaatatttcactccaaaacatgtgtctttgccatatgtcgaaatggccctgcaaagctgtcctttgtgtgggaaaaccagttcagtcacattagtcatgcatctgtgaagaatctctattaacatggctagatctctttcttccaggccctcccaatcctaaacagattaagagtctagcaccttttaaagatctgaacaggaaacatttgtcacctgttgtctccaagggcagccactaatgaggcttcaaaagaaccttggtctccacagtcttttatcttaaactgaacatttcctttctattgatcccaggtcttcagagaaactcaaccaattgtcaaccagaaaatgtttacttttacctagagcctggaagcccccactttgagttttcctgcctttcccaggtgggaaaccagtgtatttctgaaatgtctttgattgatgtctcatgcgtccctaaaatgtataaaaccaagctgcacctgaccactttgggcacatgttctgaggacctcctgagggctgtgtcacgggccgtggtcactcatatttggcccagaataaatttcttccaatattttacagagttttactctttctgtcgacaagaggcgcataggatatttcattccaagtgctgtggtgaagactgtttttacaagttggccttgtgaagagccattgttgtgtagatgtgcctcgctttgttcctggaatgacatggtgaccgtctaatttcccaattcaaggagagttcctctcttttaaaatcttagctttttgttaagaggtttagtgtctttgctttaggaaactgcttaaaatgtctacatttttcaacagcttgagcaatgactatacagtagcctgaatcctgtcaaatctatgtggtctttcagtagggattgtaatattttgtgaatcattgtggtgtactcttggatgagaggtgttatattaagaaaaatagttctgaggttttttatgggaaaattacgggttttacttcctgaaaataaacatctgaatggtatttgatggaatgaaagggaaagagtgtaaggttacagaggtttacactattttttaatagcttttttaaaaaaacttatcttacatttttgttcagttgcacaatgtacatcaaactaaccatagccatgtgggggctgctactcacaaactgtcatcctacaagtccaaatacaggagaagcagaaattatcattggcccaaatgctgtatttccagtaacatataaaacagggcatttctaatttcttctaagcttagtaaccagctcagccacattagtcatgcatcaataatgtttttttttttttttttttttttgcagtcatccaagtgcaccaccattaacatgatctcttctgagaattactcctatagttatcttaattctgttggacaaatggaattttaaattcattttagtattgtattaacaagagtgccagatgcatcaaaaagtgatggtcatattttcctattttatgtgttatattattaaatggctcatttaaaaaatgaaaatgcatacgtgttttatgatttattgatatccttaaagtcctagcaggtgtagatactttatatatttttaaaacttgataggatactactctttgcctgcctctgaataaaatatgtactattttgtgatataaatacataatactagacagctaattttaattaaaaacaatgtgtaaaagtttaaacagcttttttaatgaaataattttattacatatgattctagatttcaggaatagtcacttatgttattttgctttattagttttagatcttgctgtatttttaaaaaggaaatgaaatgattattgatgcagagaaaaccctacccacatccctcccttttcttcttctctgataaccactgctgaatttggtatgggtctttccctagtacccattcagaagcaatgatacaggagttaagaagaaattacttaggcagataatgaaggtatgggaatcctccctaaggttttccttttaatgaagaacagcccccaaatcattttcttttctaacgaagagcaggctgtaaaatcgagctgcagagttagacaaacaagttggaagcttgtaaacgcgaataccggcagttgtgccaataggaaaggctacctgggaataggcatgttcaaaatggtggctccatcttttcttttctgccagccacgtgtacagtaaggagcaggcaagatggcgctggccaagtagaaagtccatttgcataataagattagggttgggcggctgggcacagtggctcaggcctgtaatcccagcactttgggaggcagaggtgggtggatcacytgaggtcaggagttcaaaaccagactggccaacatggtgaaacccggtctttactaaaaatacaaaaattagccgggtgtggtggcatgaccttgtaatcctaaccacttgggaggctgaggcaggagagtcacttgaaccagggaggagaaggttgcagtgagctgagatcgtgccattgcactccaccctgaacaacaagagtgaaactcggtctcaaaaaaaagattagggtggggcaaccagccttccctgcctaccatgtaaaagtcacacttgattgaaccaatctgtgggctctacatacatcaggcaccgcctcctcaagcttgcctataaaatctggcacagtccaccacatgccggcttttccctttgggacacccctctctcttgaaagagagagagggctgctctcctttctttttattttgcctatgaaatcttcgctcctaaacttgctgctcatttgtgactgtgtctttaatcttggtgctaggcaacgaaccctaggtattgatcccccacaaggatgctgcttcagcaacattgtgcattgttgagcctagcgttagcctcttacacatggtgtcaaaccccytatctccctgttgcttgatttttcatgctgaaattgcactttaccagtttgggcatgcactatttttattatcttccagcactaaatattttctcatgtttattatgatgtttttcaacccaagcttcagatgtatgcttttagatttccacatgagttaatttttggtcatcttttttgttgttggtttctaattttatggcattgtgttcagagcatgcactctccatatatagtattgattttcttggtatctttgagattttttatctattgaaaactggacactatggtttgtttttaatattacataggtgtgtgagaaaaatgtggttttgctgactatttggtacatgtttgcccagatattcattgactcacccttgttaattgtgtttaaattgttcaggtcttcctaatttcttgttgcttgatttttttaattactgagagatgtgttaaaaatctaccattatgattgtaatcttgtcagtttcttcttcttcttcttcttatttttttggagacggagtcttgctctatcgccaggctggagggcagtggcgcagtcttggctcactgcaacctccacctcctgggttcaagcgattctcctgcctcagcctcctgagtagctgggactacaggtgcccgccaccacacccagctaatttttgtatttttagtagagacagggtttcaccatgttggccaggctggtctcgatctcttgacctcgtgatccgcccgccttggcctcccaacacttgggattacaggtgtgagccactgcacccagctagtttcttcttgtaattctattgagttttgctttatgtatttgaagggcatgttattagggatatttaagttcagtcttcttatattttcacgtgcagttatttcttttatcatttttttgaagaaactgtttctaatgaggctttctttaccttatatctgtttttttttctagtgcttatataatcttgcctcctcagagttcgcgtgtgctgtttgcgcctcagctttcagttttgactttttttttttttattaggttttcagaacttttcttaaaatccagcgtaagttccttatagatgctggatattagacctttgttagatgcatagtttgcaaatattttctcccattctgtaggttgtctgtttactctgttgatactttattttgctgtgcagaagctctaaagtttaattagatcccacttgtcaatttttgcttttgttgcaattgcttttggtgtctttgtcatgaaatctttgccagttcttgtgtctaggacggtattgcctaggttatcttccatggtttttatagttttgggttttgcatttaagtctaatccatcttgagttgatttttgtgtatggtgtaaggaaggggtccagtttcaaccttctgcacatttagccagttatcccagcaccatttattgaatagggagccctttccccattgcttgtttttgtcggctttgttgaatatcagtcggtcgtaggtatgtggctttattatcaatactgtgctattttgagctacatgatgagaactcatgaacacaaagaagagaaccacagacactggggtctgcttgagggtggagggtgggaggagggagaggagcagaaaacacagctattggtagcaggctaagtatcggggtgatgacataatctgtacaacaaacccctgtgccacaagtttacttatataacaaacccacacgtgtacccctgaacctaaaacaaaagtgaaataatgacaataatgataataatgaaatccagcctaatattatctctcttttccttgttgagtttagtctgtttgcaattatgattattcatatatttgatatcattttgtgctttctcttccacattttttatttcttcgctttctacttatcctgaattttctttgtttttttatttcttcttcctcaccctctattggattgaacacattttttaaaagtttaccttttctcttgaaaggtttggtcattacatagtatttctgttctgttcagttttttactctttagcctacatatactagcaattgctgtctgtcaggtgttgttagtgccattatcttctctgtctttttgttaaactaagcctacattttcttctttttatgctgagtacctcatgtaacaccagcattcagtagatgatctgtaaatatttgttgaatacctgctcaattattagtgtgaattattattattttaaaacatgtattacagctttgtttcttttcttttctttttcttttcttttttttttttgagatggagtctcactctgttgcccaggctggagtgcagtggtgtgatcttggctcactgcaactttcacctcctgggttgaagcgattctcctgcctcagtctccccagtagctgggattacaggcacacaccaccacacctggctaattttttgtatttttatagagacgggatttcaccatgttggccaggttggtctcacattttcctgacctcaggtgatctgcccgccttggcctcccaaagtgctgggattacaggtgtaagccactgtacctggccttgaattattattagtttgttattattgaacttagtaagcctttattttctgtttgcaaatgaaggatgacttgtaggcacatctatccttcatgaaatttgtcttaatatttttaatattcttgacctagaaggaggatggaaatcattatttatcacaaatgtttaggtgatgttttgtgtcaaatggttctgtagatggagctgagttcagttccacttagtgagaattgcttctgatagcagcacagggaaaggggagcaagtcagagtcagggccgggactcgaggccccgtgggagttcacccacatagtcatcgcaggagcctgctgagtgtcatttaggggttgataattggcagattaataactcaccttaactttaagtgccttgttgaggggcatctttcagatgatttattgaatgtggcttatggtctatactgtaaacatgaattttggtgtattactatcttggtcttttttgaccattttgtacttctgtaactctcagtggcattacacataaagagaacatacatcaatacttctctaggtcaaaatataccctcattaactactttatgtagaagtttttggagtccaattctgaaattgttacaagtaagaaaaaaactttgtgttaatatcttacttgagaatcagctattatgagatatcattagcataacgcttattaactcaacctttgaaagtacatcttgatttcccccttaaaattatagggttcatcatttacaacccaacagcctcaggcttataaccttttcctgaccacggccattggcgatgggatgagactgtgggacctgagaaccctgaggtaaggctgtcctgcgccctgcactgcaggggtggggagctcaagagatataagctcaatctgatctcttttccgaatgtgatgaggttgtggttaatctgtgcacactgactaatctaagactgatttatgcacagaaaagttagctctaactttggaagggtgaagcactaggtactggtctctctgctatatgtggcttaggagagtaaccccaggcccttcctgtgggtcagcgatgttgagggagactttggaatctcctaaaccacagttaccctatggtgtgattactgctctctctcccaagtgtgttcccatctccactgggtgccatccactaggcaccgagcacccccgtaacgcagggccagcggcgcctgactctccttttcctacctcctcaggtcacagttgggagggcatttccttagatatactatcyttaagtaaattacttctcatttcacatcaagtatattttagatgctttgtagactttgaaaatacattttataaaagttagaaagcaccttagttttatcagcaaaatatttacagatcttttaggacaggaattcttgatataacaataattgttgtttactgttgaatgcaataataaaacttacaggcaggtttgtttactattattatttcaaattagtgatgagaatctgtatgagcaatcaygttgcacatgaggatgtcttaaccagtgactgaccatatcacattgctggtggcataagattatgatggagctgaaaaattctttttgtttattatttcctttactactttttatcatgattttagagtgcattccttctacttataaaaaaaattaactataaagcagcctcaggcaggtcctgcaggaagtgtccagaagaagacattgcttttttttttttttttttttttatgttagacagagtctcgctctgtcacccaggctggagtgcagtgttacatgatctcagctcactgcaacctccctgccccaccaccccacccctgagctcaagggattgtcttgcctcagcctcgtgagcagctgggtttacaggcaagtgccaccatgcccacctaattttttgtttgtttgtttgttcgtttgtttgttttgagacggagtctcgctctgtcacccaggctggagtgctggagtgcagtggcgcgatctcagctcactgcaagctccgcctcctggcttcacgccattctcctgcctcagcctctccgagtagctgggattacaggtgcccgccaccacgcccagctaattttttatatttttagtagagatggggtctcaccgtggtctcgatctcctgacctcatgatctgcccgccttggcctcccaaagtgctgggattacaagcatgagccaccgtgcccagcctgtttggtttttttgagatggagtcttgctctgtcaccgaggctggagtgcaatggtgtaatctcagctcactgcaacctctgcctcccaggttcaagccattctcctgcctcagcctcctaagtagctgggactgtaggcatgcgccaccacgcccagctaatttttgtatttttagtagagaacgcattttcaccatgttggctaggttggtctcgaactcctgacctcaagtgatccacccgcctcagcctcccaaattgctgggattacaggtgtgagccactgtacctggccaagacattgttatcagagggagatgacagctccatrcatttcactgcccctgaagaccttccagtgggaccagatgtggaggggaagacagtgatattgatgatcccgactccatgcaggcctaggctaatgtttgtgtttatgccttagtttttaacaaaaatgttttaaaagtaagaaaaagctcaaaatagaaaaaagcatgtagagtaagaatataaagaaataaaatatttttgtacagctgcactatgcatttgtgttttaagctaagtgatattagctttgggaggccgaggtgggcggatcacctgaggtcaggagtttgagaccagcctggccaacatggtgaaaccgcatctctactaaaaatacgataattatccaggtgtggtggtgtgcacctgtaatcccacctacttgggaggatgagtcaggagaatcacttgaactcaggaggcagagtttgcagtgagccaaaatcacaccactgcactccagcctgggtgacagagtgagactctgtctcaaaaaaaaaaaaaaaaaagtaagtaaaaaagttacagtaaactaatattaatttattactgaggaaataaaaatattttaaaataaatttagtgtagcctaagtgtccagtgtttataacacctatagcagttgtggtcatgcccttgaccttcacattcactcacttcttgctcagtgacttactcagagcaactgccagtcctgcaagctccattcatggcaaggaccctatacaggtgcaccctttttaatcttttattttatttaattgtttttatttcaatagtttttggggtacaagtggcttttggttacatgaatgaattgtatagtagtgaagtctaaggttttagtgcacctgccacctgagtctatacattgtacccaatatgtcattttttattcctcacccacctgccacctgcccccttgtgagtctccaaattcaatcataccactctgtatgcctttgtgtactcacagcttagctcccacttacaagtaagaatataaggtattaggtttttcatttctgagttacttcacttaaaataatggcctccagctccacccaagctgctgcaaaagacattcttttgttcttttttatggctgagtagtagtatttcatggtgtctatataccacattttcttttttcactcattagttgatatggtttggctgtgtccccacccaaatctcatcttgacttgtactcccgtaattcccatgtgttgtgggagggacccagtgggagatgattaaataatgggggcattttcccccatactgttcttgtggtagtgaataagtctcatgagatctgatggttttgtcaggggtttctgcttttgtgtcttcctcattttgtctttaccctgctgccaaccatgtaagacggggcttgctcctccttgccttccaccatgattgtgaggctgccccagccttatggaactgtaagtccaattaaaccactttcttctgtaaattgcccagtctcgggtatgtctttatcagcagtgcaaaaacagactaatacagtaaatcggtaccagtagagtggggtgctgctgagaagatatccaaaaatgtggaagcgactttggaactgggtaacaggcagaggttggaacagtttggagggctcagaggataggaaaatgtgggaaagtttgcaagttcttagagacttgttgaatggctttgcccaaaatgctgatagtgatatggggacaataaggttcaggctgaggtggtctcagatggagatgagggacttgttaagaactggagcaaaggtgacttttgttatgttttagcaaagagactgatggcattttgcccctgccctagagatttgtggactttgaacttgagagagatgttttagggtatctggtggaagaaatttctaagcagcaaagtgtttaagaggtaacttgggtgctgtgaaagacattcagttttaaaagggaaacggcataaaagtttgaaaaatttgcagcctgacaatgcaatagaaaagaaaaatcccattttctgaggagaaattcaagctggctgcagaaatttgcatacatactgaggagccaaatgttaatccccaagacaatgggaaaatgtcttcaggacatgtcagaggtcctcatggcagcccctcccatcacagacccagaggtctgggaggaaaaagtggtttcatgggttggcccagggtccctgagctgtgtgcagcctgggacttggtgccctgtgtcccagccgctccagccatggctgaaaggggccaacatagagctcatgccatggcttcagagggtgcaagccccagtccttggcagcttctacatcatgttgrgcctacgggtgcacagaagtcaagcactgaagtttgggatcctctgcctagatttcaggagatgtatggaagcacctggatgcccacgcagatgttttctgtaggggtggggctcccttggagaacctctgctagggcagtgcaaaggggaattgtggggtcagagcctccacacagagtccctaatggggcactgcctagtggagctgtgagaagagggccaccatcctccagaccccagaatgatagatccatctacagcttgcaccatgagcacggaaaagctgcagacactcaacaccaggctgtgaaagcagctgggagggaggttatgctccgcaaagccacagggacagagctgcccacgaccatgggaacccacctcttgcatcagtgtgacctggatgtgagacttgatgtcaaaggagatcattttggagctttaagatttgactgccgcactggatttcatacttgaatggggcctctagcccctttgttttggccagtttctcccatttggaatgactgtatttacccaatgcctgtacccccattgtatctaggaagtaactagcttgcttttgatattacaggctcataggcagaagggacttggcttgtcccagatgagactttggactgtggacttttgggttaatgctgaaatgagttaagactttgaaggactgttgggaaggcatggttggttttgaaatgtgaggacatgagatttggaaggccggggtggaatgatatggtttggctctgtgtccccacccaaatctcatcttgaattgtactcccataattcccatgtgttgtgggagggacctggttggaaataattgaatcatgtgggcagtttcccccatactgttcttgtggtagtgaataagtctcatgagatccgatggttttatcagaggtttcttcctcattctgtctttgcttgttgccattcatgtaagatgggacttgcccctccttgccttccaccatgattgtgaggctttcccaggcatgtgcaactgtaagtttaattaaacctctttcttttgtaaattgcccagtctagggtatgtctttatcagcagcattaaaatggactaatacattggtcgatgggcacttagattggttccatatctttacaattgtgaattgtactgcaataaacatacacacacagtgtcttcgtgatataatgacttattttcctttgggtagataccaagtagtgagattgctggattgtatgccagatctgcttttagtgctgtaagaaatctacttttagttccatggaaaacagtatggagatttcattttccttttataccatatatttactgtgccttttctttgtttaggtatattaataattaccattgtgttacagttgcttagtacagttgcatgctatacatgtttgtagcctaggagcaataggctacaccacacagcttaggtgtgtagtaggctacaccatctaggtatgtgtaagtacactctgtgacattcacacagggacaaaattgcttaacgacatatttcttggaatgtatccccggcattaagtgatgcatgactgtgtagttaactcctggcatcttcttagtactcagcaaacagccaacaacatccattttctagtgattattgcttatttattttttatttgtatatatttaggaggtgcaagtgtaattttgttacatggttagatttgtagtggtgaagtccgggcttttaaggtatccatcactcaaataatgtgcattctgcccattaaataatttttcttcctgcatccccttcccaccctctacccttctgagtctccagtgtctatggtttcatactctatgtccatgtgtacacattatttatctgccacacataggtgggaacatgtggtatttgtcgttctgtttctgagttgtttcacttaagataatgccctctacttccatccatgtgctgcaaaagacatgatttcatttttttcatggctgaataatattatattatatgtgtgtgtgtgtgtgtgtgtgtgtgtgtgtatacacacacaagtatactacattttctttattcagtcgcctgttaatgggcacttagattgattccatgtctttggtattataaacagtgttgcaataaacatatgagtgcatgtgtctttttgaaatcatgacttctttttcttttggtagatacccagcagtggggtttctgaaatgaacggtagttatatttttagttctttgagagatcttcacattgttttgcgtagaggttgtactaatttacattcccatcagcattgtataaactttcccttttccctgcatccttgacagtatctgttactttttgcttttttagtaatagccattctgactggtgtaagatgaaatctcattgtggttttaatttgcatttctctgatgattagtgatgttgagcatttttcatatgcttgctggccatttgtatatcctcttttaaaaggcttttatactgttggtgggaacgtacattagttcaaccattgtggaagacaatgtggcatttcctcaaaggcctagaaccagaaatatcatttgacccagcaatcccattactgggtatatacccaaaggaatataaatcattctattataaagatacatgcatgcatatgttcattgcagcactattcacaatagcaaacacatggaatcaacccagatgcccatcagtgatagactggataaagaaaacgtggtacatatacaccatggaatactaggcaaccataaaaaggaataagatcatgttttttgcagggacatggatggagctggaagccattatcctcagcaaactaacacaggaacataaaaccaaacactgcatgttctcacttataagtgggagctgaacaatgagaacacatggacacaaggaatggaacaacacacactggggcctgtcagcggagtaaggagaggaagaggatcaggataaatacctgatgcttgtgacgcttaatacctaggtgatgggttgatctgtgcagcaaaccaccatagcacatgttacctatgttaacaaacctgcacatcctgcatatgtatcctggaactttaaataaagtaaaaatgtctattcatgtcctttgcccactttttaatggatttatttgtggtattttttgttgagtcgtttgagttccttgtaaattttggatgttagtcccctgtaaaatgcatagtttgcaagttttcccccattctgcaggttttccattcactctgttgattatttcttttgctgtgcagagtatttttgtttaattaagtcatatttgtctatttttatttttgttacctctggttttgagttcttagtcatgaattctttgcctagaccaatgtctggaagtgttttttctagaatttcttctagtatttttatagtttcaggttttacacttaagtctttaatccatcttgagtttatttttgtgtatggggagagataagggtccaatttcattcttttgcctatagctatccaatttttcaagcactatttattacaaagggtgtcctttccccattgttgattttgtcagctttcaaagatcagttgactgtaaatatgtagttttatttctgagttctagattctgttccattggtctatatgtctatttttataccagtaccatgttgttttggttactataaccttgtagtataatttgaagtcagggaaggtgatgcctccagctttgttctttttatttaggattactttggccatttgggctcttttttggttccttatgaagtttagggtgttttttttttttaatgtaaaaaatgacattggtattttgaaaggcattgcattgtacctatggattgctttgggcagtatgttaattttaatgatattaattcttctgatccatgagcataggacgttttcctatttgtttgtattatctgtagtttctttcattgatgttttatagttttccgtattgagaccttttacctccttggttaattatattcctaggtatttcattgtttttatagctattgtaaataggactgatgtctggttctcagctaaatcattattgatgtatagaaatgctactgatttttacacattgattttgtatcctgaaattttactgaatttatttatcaaatctaagagtgtttttgatggagtctttaggtttttctagatgtaagattatattatcagtgagcagggataatttgatgtcctctttaccaatttggatgcttctttaaaaaaaaaaactttttttttttttttttgcctaattgctctggctaggacttctaggactatattgaacagaaatggtggtagtgggcatccttgtcttgttccagttcttagaggaaagactttcaattttcccccattcagtatgaccttggctattggactgttgtatatggcctttattatttttatgtatgttccttcaatgcttagttttcattgaggatttttatgaagagatgctgaattttattaagtgcttttttttgcatttattgagatgatcatatatttttttgtccatgattctgtttatgttatgtatcacatttattgattattgtatgttgaaccatcctggcatccctggtataaaacccacttggtcatggtgtattatcttcttgatgtgctattggattctgtttggtagtattttgttgaaaattgtttttatgttcatcagggatcttggactgcagttttctttctttgttttgtccttgtctggttttggtatcagagtgatactggccacatagaatgaattagggagcattcccttcttcttgacattttggaacagtttcaggattgatagtagttcttctttatatgtttggtggaatttgcctatgaattcttctggtcctgggcttttctttgttgggagactttttttcttgattcagtctttctattcattattgatctgttcaggttttctatttcttcctgcttcaagcttgggaagttgtgtatttccaggaacgtatccatttcctctaggttttctattttgtgagtgtgtagtttttcattatagtctctgatgatattttgcattcctgtggtattggttgtaatgtctgtttttcatttctaattttgtttacttagatttcattttttcttggttagtctacaagtggtttatcaattttgtttatcttctcaaataactgacttttcattttgttgatcttttaaattgttttgttggtctctatttcatttaattctgctctggtcttttaaatttcttttctgttgctaactgtggatttggtttggtcatgcttttcttgttccttgaggtgcaacattaggttgttaatttgatctttctagtttttttggtataggcatttgatggtataaactttcctcttgacactacttttactgtatcatacaggctttactacgttgtgttatcaccttcattcatttcaaaaattttaaaatttctcctgaacccagtccaattacacttctagagcacttattaatgtgccacgtgctgtaagaagaaatttctttatgaactcatttaagcccatttcatgaatggggaaaatgcagcacagaggtgagcaactcaccaaagttgctcatttgatgagaaggggcttagctggggtcagggttgagcctggccctggatcacctgctcttggccactgctctctatggcctcttcactgagctcattagacaagaaacacatgatcgtgagggaaatgttcatggtgtattctggggtagacatagcaggatataaagctgcataatatgcatctctactttgttaaaggaaaacaaagacctttgcatatgcagagaaaatgtgcagtatatgtgccacagtactttctggagttgtcatttaatggaaggattatgagtactttgatgatttttctctttgtgtttctttttttttaatagtaaagaatgtaaaaattwaaaaatcaatgtaaaagaaaaaaggaattaaatttatgacaaatattgtgacaaatgtttatgacatttttataaagatttaatcttttctcagtagtacactacagttcaggttattttctacagcctatattaccatctacagaatttttctagacagaattatcttggccattgcaacagtgcactctagcctgggtgacagagcgagactctgtctcaaaaaaaaaaaaaaaagaattatcttggctaggtgtggtggctcaaacctgtaatcccagcactttgggaggccaaggcaggtggattacctgaggtcaggagttcgagaccagcttggccaacatggtgaaaccacgtctctcctaaaaatacaaaaattagctgggtgtggtggtgaatgcctgtaatcccagctacttgggaggctgaggctggagaattgcttgaacccgggaggcagaggttgcagtgagcctagatcacgccactgcactccagcctgggtgacagacagagtgagactcaatctcaaaaaaagaaaagaaaaaaaaaaaagaattatctttgtagaatttatactacataggacatgattaacaagaaataacaagaatttcttggcatttttttacaataaacaaattttatatggcactttttaaatagttgtgaaacttaaccaccctcgatagaatgttttgcctccaaaaagtctctgaataatttaactaaataatttattattttagaagatttgttaagtttgttttgatatttaaaaaatttccagaatatgtttacatttaatatttatcacatataaaagcttatttactattagttttgtcatctttgggaatttaagattttgaatagtgtttgaattatttttaaatatctctagagagacccattaaccatttaataattctcacatataaaatattctttcattattcttttgttcctttttgtgaagaaaagcaacaagttgttttctttcctctaatttgcattcaaattttaaaatgatttttctcctggtgtttctttcctccctgtaggtgtgagcgccactttgaagggcatccaacccgcggctatccatgtggaatcgctttcagtccttgtggacgattcgcggcttgtggggccgagracagacacgtatgtactgtttgactgtctataaatgtagagagtctagactttggtaatgtgtagactgtttartattgttrcatattaggatagaaacctactttcagcttgactgttggtcaatattttaagactcttacacagtaatagcattttaataatgtgtgaggtatgaaagatgtttttactgaagcatgataaactaatcactcatgaattaattattaatcatttcacagatacttgttgagtgcctactatttgaaagacactgtgctacacgttatattttcttgtttattacaagatgataatattaattagtgaaacaccagatcctgtgtatttaatgtgtttaatggtgtgatcctttcctaagttagatccttaggaaacaatgtgcttatattaatggaactgccccctccacattatgcgcatgcgcctcatggtggatttggggcaggtactaatacacatccacttgtccataatctattttaaaaggcttgtattaatttcctagggatgccacaaactaccacaaacttggaggcttaacccttttcccattcgccccaagaatactcatgggtggccttgcagctgcagcgttcacctcacggtcatgttgcctcagaatatcctgctttgattattattttctcatcgctctagtatcctgactttggaaacaaaaaacatcattctatctgtagcattctgtttttagtagtggtattttcatttacaaaatgtagtaattattgattgctgaaaatgccaaattctagaaaatgttgcatttctagtcatgatgataacatcattcctgaatagttattggctgaagattcatttgatgaatctgatttttctgaaataaatgattctgctgattcagatgattctgatgttctgtttagaaataacttcaagacctggtggtgacagaatctctcagcatttgcttgtctgtaaaggattttatttctccttcacttacgaagcttagtttggctggatatgaaattctgggttgaaaattcttttctttaagaatgttgaatattggcccccactctcttctggcttgtagagtttctcccgagagatcagctgttagtctgatgggcttccctttgtgggtaacccgacctttctctggctgcccttaacattttttccttcatttcaactttggtgaatctgacaataatgtgtcttggagttgctcttctcaaggagtatctttttggcgttctctgtatttcctgaatttgaatgttggcctgccttgctagatgggggaagttctcctggataacatcgggcaaagtattttccaacttggttccattctccctgtcactttcaggtacgccaatcagacgtagaattgttcttttcacatagtcccatatttcttggaggctttgtttgtttctttttattcttttttctctaaacttctcttttcactgcatttcattcatttgatcttccatcactgataccctttcttccagttgatcgaatcagctactgaggcttgtgcattcgtcacgtagttctcgtgccgtggttttcagctccattaggtcctttaaggacttctctgcattggtaattctagttagccattcgtctaattttttttcaaggtttttaacttctttgccatgggttcgaacttcctcctttagctcggagtagtttgatcgtccgaagccttcttctctcaacttgtcaaagtcattctccgtccagctttgttctgttgctggtgaggagctgcattcctttggaggaggagtggtgctctgatttttagagtttccaggttttctgctctgttttttccccatctttgtggttttatctacctttggtctttgatgatggtgatgtatagatggggttttggtgtggatgtcatatctgtttgttagttttccttctaacagtcaggaccctcagctgcaggtctgttggagtttgctggaggtccacaccatgcctattccaaaattgaccacatagttggaagtaaagcactcctcagcaaatgtaaaagagcagaaattataacaaactgtctctcagaccacagtgcgaacaaactggaactcaggattaagaaacgcactcaaaaccgctcaactacatggaaactgaacaacctgctccggaatgactactgggtacataacgaaatgaaggcagaaataaagatgttctttgaaaccaacgagaacaaagacacaacataccagaatctctgggacacattcaaagcagtgtgtagagggaaatttayagcactaaatgcccacaagagaaagcaggaaagatctaaaaattgacaccctaacatcacaattaaaagaactagagaagcaagagcaaacacattcaaaagctagcagagggcaagaaataactaagatcagagcagaactgaaggaaatagagacacaaaaaacccttcaaaaaatcagtgaatccaggagccggttttttgaaaagatcaacaaaattgatagaccgctagcaggactaataaagaagaaaagagagaagaatcaaatagatgcaataaaaaacaataaaggggatatcaccaccaatcccacagaaatacaaactaccatcagagaatactataaacacctctacgcaaataaactagaaaatctagaagaaatggataaattcctcgacacgtacactctcccaagactaaaccaggaagaagttgaatctctgaatagaccaataacaggctctgaaattgaggcaataattaatagcttaccaaccaaaaaaagtccataaataaataaaccataactaatgtgaacaattcagctaaattatagatgttactgaatagctctatgtcaaataccaatctcttctttttgtctagtgcttctcctgtcctgtttaaataatctttgttcacttccaaatcatgatggtattgtcctctgtgctcttttgaaaagctttattgtttttgagaacacatggacacaggaaggggaacatcacacaccagggcctgttgtggtgtggggggaggggggagggatagcattaggagatatacctaatgttaaatgacgagttaatgggtgcagcacaccaacatggcacatgtatacatatgtaacaaacctgcacgttgtgcacatgtaccctaaaacttaaagtataataaaaaaaaagaaataacttcaagaacagtttttatattttattttcacgttgaaaatcattcaaatttgcttcagcctcaaatagcacgtttatgtaaagttaaatgagtgctggcagtaacctgcatttttaaattctaaacaggaaaagggttaaaaaaatagacacttattttctgtcggctctggaggccagaagtctgagatgaaagcatcagcagggctggccccttctgcagggtccaagggaggaacccctcacgcttccctggcctctgtggctgctacagtccctggggttccttggtgtgtggctgcgtcatgctggcctctgcgtccatctccaagtggcctttcctcctctgcacatctctcgtttccccgttctttctcttggggacactagctaggtttgaatgtctcctccagaactcatgttgaaatttacttgccattctagcagtattcagaggtgggaactttaagaggtggattaggccatgagagctggccctcctgcaaggattaatgccattaccatgggagtggggtccttacaaagggtgagtttgtccctctcttgcctctaggccctttcaccttgtgctgtgtgattatgcagaagggaagccttgccagattctggctctttgaccttgggctttccagcctccaggactgtaagaatatacatttccattctttgtatattacgcagtttcaggtattgtgttatagcatcacaaaacagactaagacaacactgataatggatttacagcccaccctaaatccaagctgatctcaatacccttcagttaatttcttctgcagaaaatcctwtttccaaataagatcacattcttcatattcaggttcagcactagctatgatggaatagcgtgaaactractagggtgcctatcagaactactacacaaaccctggtttaactaggttatgagatgcaaaggggcagctcacattctgtaggtactttttctctgaaggagtttgccatttctaaacaaaaaaaaaaagagacctatgtttcaggcaaaggccatacagagggatgcatctgtgtgtgtgtgtgtgtgtgtgtgtgtgtgtgtgtgtgtatgaatggtaagaggtgaagttgtgcataaaaattggcagaacttttttttgatattgcagggatgtagagataaaaacttgaaaactttagggccatggagggtcaagtgccatgcctgacactaccagtattcctgtcaacatattttattcaattctggagctaaggagggcaagaaacaggtaggctcagcagaagacctttagaagcagagtagggtttttaacaatatttcagggctgaggctatgaatattagaggtcagtacctgctagtagggtgggaattcccaatggacaccttagcttacccctggataaaccaggagttgatggaatctcacccaagctgcaatccagccttgagtctgctcaactctgtttatagtaaggaagtcttttcttgcttcatctgcccacctttctggagtacaataatgtaattttgagccttgggagttttttttgtaatatacatagcatttagctttcagtcaaaaattacaagtatgtcaagaggcaaaaaatcaagaaaaaaaaacataatagaaacaatactatgggtgacccaggtattggacttagcagacaaggttttaaaaataaccatgattaatatattcagggaaatagagtacaagtcagagaccacagatataaggatggagaattttactgcattgttggactttcctagaactgaaagatatatcattngaaattaagagtgtagagacagaagtgttgaaagtagcaggatgggaaatgaagctgatatgataatactttagtgtaaagtagactttgggtcttaatgcattactaaaaataatgaacaacatttaatatgacaaagatgccaatttatgtagaaaatgtcataaacctgtatgcacccaataacrtagtttcaaaatatataaatcaaaaatgatataactctaagaagaaaaagaagtatcttcaatcataatggaagactttaacaaacttctcttaatgactagaaatgactagaaaacagattattgatgatcatgacactttttaatgtaaatatgattacacttttctttgtaaatactatgtgtttaaaatattctgcaagctctctatgtagaaccaagatcttatgtgtgtcttaaaaggactttcacaacatgcctccaaattacytatcttctctctctatttttttctatatctcctgatttctgtgtcatacaacttctggatatcacagttttttttaataatacaaaaaaaaataaggatgaaccaaaaaatattctcacagacaacaagagtacaccataaaaatgtgtctgctaaacaggtgaaaactaatgatatatttgcaaattagcttaagaaagttaagaaaacacataaaacatcagaaattgctagacaacaggaatatatgaaatgagaactgatgaaaattaggaaagcattagaaaaaaattcagaaataaagaccaaatacaaaggaatataatagaaagcaaatacagagagcacaatagggaaaaaggatacaaatgagagaagtaaataaagaaaatgataaaagacattcaagatgaaaggtaaatatagaagttcggtaaaagagattcaacctacatgtaaaaggagtccctggacatttttttaaaaagtcaattaaacagaacaaatactatgatagttcaaaaatatattttctaaaattaaaaaaatttagttaaatctagatattgaacgaatacctgggaaaattgactcagactagtttgcacagaaatatagcttaacaaatctatttgactataaacattaacaaaaaaacacctttgtggatccatgtaaaatgttcaaatgcttataagggaaagagtatcagcttggattggatttttgtaaatcatctttttttgttaaaaaaacattgggaagaatgtattttacttactcaaaaagagaatctgagtcaagaattttaatatccagctaaatttttttttgagtataaaaccagacacacagttatgaatatgccagaactgaatggtgttcccttgagttatattgaaaaaaaaaaaaaaagctgtataaaaccaaggtaagattgaagaagtttcagcaaaagcctcaaggtgagcactgaatatgtttaactatgtaagataaaaaatgggaatgaaggtaccagaatactttgtaaatattctatctgttatagtttaatagtacaaaactgggagatgtgagaatataactagaaagtagaatacctctcttgattctccttgtagatgttaattgaataagaagagatcagttgaagctgacaatagaattgtaaactcttaaatgtaattaagagtataaatattaagataattatgattaaaattggatgtagaggaagagagatggaaaaatggttgctagacaacctcactattgggcatagtagggaactaacatgcattgtcttagagaggagtggaccaagagttttgcataaagcttttaataaaagataactgctggaagaagaattctaccatttttaagtgcccaaagaactatctagataggacaaataaaataaaccgtaaactgccatacattaaatagaattaaaaataaaatactatgatgaaactgagatgaaaatgtcagtcatattgatgtctttgtggttgttgtttttgtttatttttgagtcttgctctgttagcccaggctgaagtgcagtggcacgatcatggcttactatgagcttgaacttctggtctcaatccatcctcttgccccagccttccacatagctggaactacaggcacatgccacccagcctggctcattagttttttagagatgaggtttcactatgtggtccaggctgctctcaaacaattggcttcaggcctgcagcctcagcctcccaaagtgctgggattataggcctgagccaccatgcctggctcatatcaatgtttaaggaaaaaaagaaaaaaactttcagattggattttacagatgaggaaaaaaatctgagtccrtgctgaatacaggagatgctttaatccgaagtgatccagaaaggataaagagaagagatgtgaaatgtataccaggcaaatgaaaataaaaataaagcagattatatgattttagtatcrcacaaaacacaattcaaccaaaaaattatgaggcaaagatacttataatgccaaagactaaaattcacaatgaaaatacagtatatgttagtatctaattttgaagaaaataaacaaatttcacaaggtggaaacaataagaaccaaataataagtagccacacattaataatggagactaacgtatctgtctcagtccttggcaggtcaagtgcacagaaattataaggttataggaaacctctatatcataattgataatgcattatcttgtagatattcatagtaatgtttgtctgccagcaaggaaagtgtcttattttcaagtgcacatcaaacatctatgaacaatgaccataaatgaatccagagaaaagctcgatacattaaaataagaacaaaaaatcaacattttctcactataatgcaatcaaagtacaaatttaaaaaccaaaaagtttcttgcttctaaatattaaaattccatctgttaagcaactcttggtttaaaggtgtcaaacaaaataggaaattgtagaatttcttgaaaataatgttgtttctaacatgatatatcagtgtctctggaatacccataaaccagtttttgaagggaaatttatagcaccaaatacctatatcacagacgtttttaaaagggaaaaaataaatgaatatctacctaaaaagccagacagggaacaacaaagtaaatcagaagaaataaatggatagagataaaagcaggtgataagttagaaaacagagaatcagtagaattaataaataaattaaaacactagttgtgttttttgtttgtttgtttgtttgtttgtttttttgagacagagtcttgctctgttgcccaggttggagttcagtgccgcgatctcagctcactgtaacctccgcctcccgggttcaagaggttctcctgcctcagcctcctgagtagctgggattacaggcgcccgccaccacgcccagctatgtttttgtatttttggtagagatggggtttcactatgttggccaggctggtctcaaactcctgacctcaagtgatccacctaccttggcctcccaaagtgcagggattacaggcatgagccaccatacctggccaaaacactagctttttaaaaacacaagcaacaaaataaacttaatagtgcaattttttttataaagagagaaagcttaatctataataagaaatgaggaggaggcagaagcatggagcagaaggattttgaaaatcatgagactgcttctcataatttgtgcaaattaatatgaaagcctctatacaaatggttgagtcacagaaatttagtttatcaaactggcccccaaagtagaaacaaatttaacaggccacktttcgtagaagaaatagagaacgtttcctaagaactccttgtgaaatagtaccaggcccatgtgctttctcaggggattttaccaacctcttaaacatcaaatagtcccaaagatacttaactgttttaaagcatagagaaataaggaagacatcagactgctttttgaagtaaccataactgatagaaaacttgatgaaatttcagaaaggagttatatttcatttatgaatatcaattgaaaagcttaaataggaacatagaattagtgcattaacaataatttatcatgtccaagtggggtttatgcgtagaatgcaagcatgattcactatcaataaatccactaataattccctcataatattaactgatacaaaaagaggactcttataaccatgttcctggatgcttcaataaaattctggattcatttctgctaaaacacccggtaaaagaggaatccatgaatgcctctttcaaatgataaaatgcttatctcagcccaaaagctgacatcttactgagaaaactttagaggcattctgtggttgggaacagagccagaatgttcattaattccatgactattttacagggtattggaggtatttctcttgaaattagacaggacaacttaacagatattaccactgaaaagaacagctaaaattattcataggtgacaagattgcatatctggaaaacccaagataattagtggccaatatgaacaataaaataattaagtgaaagattagtagtagtatttaaactaatatatggaattcaatggtctttatagatataaaaaataacctctgaaaagttatagtggaagaggagaactcattgagaatagcctcaaaaaggataaaccattccggtattaacaagatttctgcaaaacctgcattaagaacatttttttcccccagaagtgtagacctggacaaacgcaaaatcctaacttgttcttggataggaagatttagtttcctaaagaaggcagttctctgtaggtaatgtgtagatttaacactcccccaacaacaacaacaacaaaaggccagtaggtttttctgtagctgtaccgttagactgaaagttacttgggagaataaacaagtaacaatggtccaaatacccccggaaaaaagaacatgatgatgaggagaacttgccctgtcagccgttaacctctgttggaaagcctttcgaattaaaaccatgtgcaactggtgcacgaataccagtatttcttagctcctgccacggaaggtgcttggaagcagtgacattccagccatcacccttagtaccctctttgcaacctctaaatgccgttccccactaatagaagccagaactccctgggtggagagctggttccaggtctgtggcagaagacttactagatgagccagggacatcttgtgccaaagagaaaagaaatcaaagggtaatggagtcatataacaaggccacaggcaacagccaattcccaaggccttaaagctgctgctgccttaggcatgcactactgtctgctggttagaccagcgggcagcaccacacctgtgctgtattctgttggccagcggagggctagctgagcatccaaagagtaatgactgtgattgacttcaacattgtatatctaaaccctcatcatttttgataatgctccccccaaaaagctatagctaaaaacaaaaacataaaatgtcattggtccccatttggaggtaactagggcacctgtcccttactcagaagtgtgtcttataaaggaaaataattaaacatttgtctgcctttcctgttcggactgtattttaagtaaactaaataccctacttggtaagggaaagttatttcttagagaattgcagacaagtagaatggatgaatggcagaattagaaaatcaccctcttcaatctcagatggagtaattgacttaggcaaatgtcatcagtaggtgaaattatcagatgaagatcatggcccaaaggaagcttgaataatagacattttgcttaagaacacatacagatggccaatgggtacaggaaaaaagggctcacytcaccaatcatcagggaaatgcaagtcaaaaccatattgagacaccacctcacacctgttagaatatcagaaagacaggtgatgatgaggatgtggagaaaggggagctcccgcacagtcggtgggaatgcaaaatgaggtagccactgcggaaaatgtgtgttgtttcctcaaagagcaaaaagtagaatccacatgatccagcaatctcactcctgggtatttgtccaaaagaattgaaatccgtatatggaagagatacctgcgcttccatggccattgcagcactcttcacagtatccacagtgtggaagtaccctaaatgtccgtctcaggggaatggataaggaacatggagcgtagacacagaatggcatattatcccaggccttaaaaagttactgctgcctcaggtatttaccactgtccactggttagaccggtgggtggtaccacaccagtgccctgttctgctacgtctttacaagaggaagtgccagagaaaagggtggggtttattactgtgtgtgccatatttattttgccagaccttgatggaggttgacaagagttggagattgtgcgtcagccttgcagcctgatgagatggtgccattcgcctcccatggctggtgtggcgggcggccaggtggccctgcgtgccaccatcaggaattctctaacagagcctctgcctcttgctgtaaggaggcaaggcttctgtcttagtgtgactttgttttaaatcttgcacgttttggtcttctgagaatagtttacttttttataaactaaaaattcagtatctgaagaaatgtgcagaatattcagaaaatatcatttctggaattattttcaaaagcaaaataagtgagcataatatgatagttgattcccctgtggaaaatatcactaccattgtcaagtttcaggagtgcaacactcacttctgtttgtaattctttgtctcctttctgctgtggggttaatttgggtaaagggaaatgaaggtcacgttaggtactctgtgaaaggaaaaatgaaagaaacttcattctcacagacgtggctcaacagagttacaaaatagttgtaatgaatcggtgtagtcctgtttccaaaacacttctcttcttcagtagtacattcagtcccttacaatttttgtaaaaacatttttgagcagtcaagcgttattccagcacccacagatttatgccacatcctcatcttttgcctgaaaaatattgcttccctttttcttgcttcttctctcaggacttgttgatttggttctggcataagatttacccgcataggttttatttccaactctgtttgttttctgagtatgtcttagccacagctcgtttctctgtggtgggtgaagtgcttcatgaatccagtgagtacctctaattaaaatgtttctttcacacrtggattgtggttacattgaatcatttgcagagctgttcattaccatcgctctgtgtcatacaagaggcttattgtccttctgtatttatgacactgtgtaggatcacagcataagaaacctgcctatctactaaaatattgatatttgggcttccaattgctgtgtcacatgtaaagttgtcatgatcagaaaattcatgtaccccaagaatcccctggaccaaaagatgtttcatttaatttcattctcactgaggaaacaaaaggcctttcctggatacgttttacctcacctcctgccactgtattatgtcattcagtgtgtgttttgaggtttcatgcaaatgggagccagctgatctcaggaagcgcttttcaagaggtgagtggccttggaaggctgcctgccctcagcctggcttccttgtctatagaattggggcaataagtgttttcttcatagtgctgttgagagggttacacgagaaaatttatgtaaaattcttatcagtgcctggcaaaaggtcagtgtccagaaagtacttgctgctgttaacctctgtattttatcattggaaataatggatggaaaagagactcagtcattataatttcccttatccatttaatctaaacagcaggcagacaggagttctgaagagtggatcctcagaaaccctttgatattaaatcagtcctgaattaaaaatagcaaaataagcaaagatggttttggaaacacctgtgagattasagggaatttgaggatgccctaaaccatgtgtgaatgggagttgtctttggcagcctagtgaaataaatagcaaaaccttagtcagaaaaatcagtttggaatctcagcactgaggctccgtggctktcctggcaaagtgctctctacctgtcatggtttcctcaataaaaaaatggagatttcaataaaatatggatgcaccttggtccgttattgtaaatggtttatgtaacagttgtgttttgtaaatagtgacacactgtgtaaatgttagggttaccctcacccagtggttcccaaagtggggtgccctggaccagcagcagcagcctgacctgggaacctgttaggagtgcacattcccaggccccacgccaccccttacagcagcaactgcacgggaatacttttcaaataagcatgtgcttgtggcagaagaaaataaaatgtagacatttgatttctccactttccttcaaaattcagctgacccttgaacaacatgggtttgaaatgcacgggtccacttatacatgattttttttcaacaaatatrttaacatttttggagattttcaacaacttgaaaaaactcacagatgaaccacatagcctaaaagtataagaaaattaaaaacatatgtcatgaatgcataaactatatgtagatactagtctgttttatccttgaytatcataaaatatacacacatctttttaaaaagttaaaatttattagaatgtatgcacattctcagtcaagagaaatataaacaaatgcagaaatgctgtatgaaatcatcacttcatamactcaactgtagtccctccagcactcctgtcctcatttcatcacccctgctcttgctgttgtggtgagctcaggagttacaagtatcccttaaaatgctgtgtgatgctcatcgcctctgcatgagctgttcgtctctccagtaaattgtgtgttaccgtaaaaggcggtctcttatagctctcgtgtatttttcattgtgtttaatgcaatactgtaaaccttgaattacaccatggggcccataggaagtgcccctggagatgctgaaccttctcccaagaagcagggaaagccacggctttacagaaaaagctgaattgcttggtatgtaccatagactggcagtcgctgccatttcaggataaatgartccagtgtaagaaatagtgtaaaaaaagaaaaggaaactcatggagacatggctgcagctatgccagcaggcacgaaaaccttgcacgttttgttaaatcctttttaatctcattgcaaatgcagcttttatgtgggtacaggattgttatgagaaaggcatactgtagattctaatatgattcaagaaaaagtgaagtcattatctgacaaagcaaagggaaggtgaaggatggcttgataattttagaagaggtttggcttaaaaagttcaagataacaggagaagcagcttctgctgaccaagaggcagcagctgagttcccagacatcattaaggaaatcattgagggccgggcgcagtggctcacacctgtaatcccagcactttgggaggccaaggcgggcggatcacctgaggtcaagagttcgagaccagcctggctaacatggtgaaaccccgtctctattaaaaatacaaaaactagccgcgtgtggtgctaggcacctgtaatccaaactacttgagagactgaggcaggagaatcgcttgagcccaggaggtggaggttgtagtgagctgagattgcaccactgcactccaagcctgggcgacagagcaagatgctgtctttaaaaaaaaaaaaaaaaaaaaagaaaatccttgaggagaaaggatatcttcctgaacaggtttttagtgcagatgtaagtgcccaattcttagggaaaaacatgccacaaaggacatttattggtaaggaagagaaggaacaccagacttaaggcaggaagggataggtcaactctactggtttgtgcaaatgcagctgagcttgtgatcggggctgtccttatccataaaactgagccttggagggaaaaaaacaccacctgccaatcttttcattgttcaccaagaaagcaggacagtgagaacgttttcctggattggttccattgatactttgtccctgaagtcaggaagcgactgccttttttttttttttttttttttttttttttttttgagacagagtctagctgtgtcgccaggctggagtgcagtagtgcaatctcagcccactgcaaccactgcctcctgggttcaagcaattctcctgcctcagcctcctgagtagctgtgattacaggcacgtgccaccacgcccagctaatttttgaatttttagtagagacggggtttcaccatgttggcaaggatggcctcgatctcatgatccgcccaccttggcctcccaaagtgctgggattacaggcgtgagccaccgtgcccggccatgactgccttttaaagttcttttgatattggacaatgcccctggccacccagaacccaatgagtttaacaccaaaggcgtcaaagtggtcttgcccccaaacatctgtcatccagcctctagatcagagggtccattacacatggaaccctatggaaagggttgtcaatgctatggaagataactttgatagagagaacatcatgaaaatctggaaagattgcaccattgaagaggccattactgttataggaaaagccatgcgggccatcaaccctgaaacaattcccactggagagaactgtccagagttgtgcatgacctcacgggatttatgacagggccaatcaaggaaatcatgaaagagatcgtggatatggcaaaaatggtttcaagctatggatcttggagaaattcaagagctaacagacaccacaccagaggagtgcttcaaaccaatgccagacagtgaggaagaagacatggaagaagcagtgccaggaaacaaattgacattaaacaatctggaagaagggttctgatgactcaatgcttttgaygtctttcacgacacggatccttctatgatataggcactgaaacyaaagcaaatggtaggagaaggattggtaccatatggaaaaatgtttagagaaatgaaaaagcaaaaatgtcaggcagaaaatacgacgtatttctgtaaagttacaccgagtgagcctgcctctgctgcctccccttccacctcctccacctcttctgcctcggccaccgctgagacggcaaaaccaacccctgctactcctcctccccagcccactcaacatgaagtcaatgaggatgaagtcctctatgatgccactcagtgaatagtgaatatattttctcttccttataattttttaaatatcattttcttttctttagcttactgtattgtaagaataaagtattaatacatatagcatatgaaatatatggtaattgattgtttatgttattggtaaggattctggtcaacagtaggttatgagtaaagtttttggagagtcaaaagcttcatgtggatttttgactgcttggagggccagcacctctagccaccatgttgctcaagggtcgactgtatatcagacatttatttgtagactttacttcaaaacctgcttagtcattgacagaatcattgggaaggcctacatctgaaggactcattcttacattaaaatagttcttttaggtgattgttttatttgctgagccgaagctctttagtttgatgcagtcccatttatttacttttgtagcctgagcttttcttctgacgttcaaaatattattgccaaggtcaatattgaggtgcttttccactatgttctcttctaggagttttatgattttaggcctttcatccattttgagttgatttttatgtatggtaaaataaaggtccaatttcattcttttgtgtgcagaaatccagttttcctaacaccatttattaaagagattatcctttcctcattgtgtcctcttgatggccttattgaaaattagttgtccatatacatttagatttatttctgagctctatactctgtctaattggtctgtgtttmtgttttttggcagtaccacattgttttagttattatagctttgtaatataatcttaaatcaagtgtgatgcctccaactttatttttcttaagtgaaaaagcaacctatggactgggaaaaattatttgcaaaccacatacctgataagggtttaatatccaaaatttataaagaactcttgcaactcaatagcagaaaaacaaatgacctgattaaaaaatgagtaaaggacctggatagacatttctccaaagacaatataaaaatggccaaaaagctatacgaaaaggtgctccacatcactaatcataagggaaatgcaaattgaaaccactgagctagcacctcatacctgtaaggatggctrttatcaaaaagacaagagatagcaaatgttgtgagggtgtgaaacaagggaaccctgtgcactgttggtgggaatgtaggttggtgcagccatctggaaaacagtatagagaacagtgaaagtagaactatagtatgacccagcagtccttctggtatatgctcaaaggagaggcaatcaacaccacttaaagtcacctgccctcccatgttcattagcattagtcacaacagccaagctatagaaacaacctaaaagctcatcaatgaacaaattaataaaaaatatgatataggagtgtgtgtgcctatgtctgtacacacatgtacacacaacggtatagcctgccatttgccacagtgtggatggacctggaggacattatgttaagtgaaataaaccagacacaaaaagaaaaagactgcaggatctcacttctgtgtgaaatctgtatcttaacaagagctcaaagacacaagatagatgatggaaggaagtgtggttaacagggtagacataggcggggagggggaggaaatggggagatgtgggtcaaaggataygaaacagcagctgcgaggatggmgaagtccaggtatctaacgtgcaacatgagtgctcaagttagtaaaaccatggtgtattagggattttcctgaactacatagattttagctgttcttgtcacaaatacaagtagcgatgtgagatgatagatatgagagtccacctctccacagtaactagtactattatcttcatatctgtaggyatggatcccataaaatcatattgcaaacttcaaatatacacaatacgcttcattttttaaaaatagtaggtttttgcgggaaaaggaattgtctttgacaccttcctcctgctgcaatgtgacgttgctctttattactagtaggctttcagaaaatatttgttgatacactttgttacttaatgattatctcatctctcaattccatcagaatggtatctgataacagattttgtctccaaaataaactatttgatggcaattctggatatatatccagaattttatgtgtgtgtgtgtgtgtgtgtgtgtgtgtatatatacatatatatatatatatgtatatatacacacacacacacacaattaaagaggaacttatttatcaacagctataaaaaatctatttgaattgctcaaattctaagctgatgagtaggaagcaaagcatagtgtatgtacctatctcctacctcaagtttatgggggaggacaatagagcatcttttttttttttttttttcattcaatttggaacttcaaggtaaggttgaattacagaatctatactccttccttaaaattagtcatcaatcatgagcacatatttaaaactgttcacagggtactatagaggtttttgatagtaaatagaaagtatgacataagttcactaagatgttaaaaatctacaagagagaaggggaaaagatgcctattttataaagttagttccccagcttggatgatgttttgtcaggcatcttggttgttgctgttgtatctgatcaactacactaatctatagatggtccctctgctctgcctagcttacaggtgattcctgactctgagttaacatgrcacacctgctcatcttgtcttgtaggcttacgtgtatgaaatgggctcaagcacgttttmtcacyggctggctgggcacacagacactgtcactggagtggccttcaacccatcagcgccccaggtacwgtcttgctgagtgggtggggcgcctctgctgcatacaagtcttacattatatttttgtatctttatgactttattttggtgaaatcttataatacttaaggttacatgccagtgttcactgagtgcaaggagaacttaggaaatatatttttattggcgagagagagagaaataaacctttattgtggrgaaatgaatctggaaaagtttcttttataatgaaggtgtttgccactcagcagtcwtgcatgtttgattgaatgaaacaggaacgtatgggaagacctgtggacaaatacggttacatgtagacaaatacggttacatggggcactaacatgaacaccagtgccagcaagaaagcaagcagcagagcaagtaagaacgggattttgaaaattcttatggaaaaaagtctgcagcatttccagaaactttcttaattagaagaaaacatgaaartaaccgttgcaaatcaattgtatataaaaatgaatggtcttctattaaaatgtagagggagattttttgcaaaggattaaaaatattaggtattggccaggcgcagtggctcacacctgtaatcccagcactttgggaggccgaggcgggtgaatcacctgaggtcaggagtccaagaccagcctggccaacatggcgaaacgccatctctactaaaaaatamaaaaatgagccgaccatggtggtgggcgcgtataatcccagctacttgggaggctgaggcaggagaatcgcttgaacctgggaggcggcggttgcagtgagtcgagaycatgccactacactccagcctgggcaacaaaatgagactctgtctcaaaaaaaataaaaaataaatatcaggtattagttatctccagtgtttgggaataatttcattttgtctctttaagattgagactttgattcagagaatagcgtcactgtgtgactgtgtgctctggcctagcgcgtgtgaccaggtggaacggcactccacacgtgtcttgtgaccccgctcttctctgctataggacgtatcgccgtggttcagggcatgttgccgtgcctggcacacgcggtactaccgctgtatattgaataatattgaatattgaaaatgagtaagtgcatcttgtgctgtcatggaccagagcttccatcagcatcaccgctgaattccatccttggccctaattcatcttttcagtctgctccacatgggaatttgaatttatgttttccttccctattataaacaatactgcgacgtacgtcctgatgatgcttcactctttccatgatgagactgccatatacactgtaacggacctgcttttcttgataatatttgtgccatcacctattccacatttgtaaaacgtattgttttgagttgttgtaatcttttataatcctttgaatagcatttgggcagtgagatggaggggtggtcagaaagaaagaaaaatgaaaagtgcaaagctagacccagcagggtgggcggcggggagaggtgtagtgatttatggggggagtcagatgttagctgtcctgacacttcagtatttggcatcaaaatgtctttcagcctgactgacagaatgtttttgaatacttgaaacttttcagtgagaaaaaggttgggtaggtctctcttgcccttgagattaatgaataaaagaagcaaatatggcgtaaatatagttatacaaaataaagaggaaaaagcaacaagttgtagttgtcatgaaccttgcttcctgacgaagggccgctaaagaacaggcagygagaaaccagttatrtataygtatacatcacactgattcattaaggataatgatatcatataccgaatwtatatatatatatatatgtatatatatatatataaaattcactaagttccttatttttaaaaatttccttatttttaaaaatttggctggttccttatttttaaaaatttcctttctttactgatattagtccactttcttccacatatatcacctcactaccgttctgtttcccagcattataaatcaaacaactggaagtagtttttattttcatacatagtattaaaataattacttaccatgactacagtaactcttaaaatatgttttctgatcacttaaattttctcaggattggacaatgttggtaattattgaagagacagttaaccacataaaactgcgtaaaattaagatttggaaataaccacaggcaggacaagtttttgttaaaagtaaacatgataaagaagcacgtgggatggtgggacaggacaccgaaaatcttctccttcacaaaggcaatgaaaacagtcacagaaattgtcaaaaccagctttcttagaactctgaaaattaaccagaggcttgcaacaatccaaagagcatgtatgcaagaaaaatggccaagtctcagtaagacagcaacctttgaaggctatcctgcataatttaataagaaaggagagcttcactttaaaatgaatacccttggttagcaaatgaagttcttgtgtgaagcacaggtaaacttggaggtggtgtttatttaatacgtgattccatttagcggtatatgagggtgctgctgttttgaaggaaagatagtacgctcctaagcatggtttattttgtttatgatataaaaacatacacacaaggaaaacatgggaacaagtgtggtcaaatattggaagtctgtgccacaaacaccaacagcatttcccctaatgactggatctggtaatgagagaatgctggagctgtgaaaatcggggagtgaaacggtgagagcatagctcacacttgggggattgctactttctttattgactatgatcaactgttcagaattttacaggacaagtccagacctgatgcaggaaatcccaaaattggggcttagcccagcagggttcttggctttgctcaggaaagaattcaagagtgaggtggcagtgaaagagcaggttttttcgagcaaagtgtgtagcagaacggtagctgcacaggcagagtggccccgaacagcacgcattggttgctggtgagcatagttatacccactcttaattatatgctacataaggggtgggctattcatgagctttctggaaaagggytgggagttccggaaccacataaggtcacttctgggttgtttccatgcatttgtaatctgtcatggtaccagtgggagtgtcttatgcagatgaattataattagtgcataatgagtaatgagggcaaccagagatggcttcagcaccatcttggccccagctggtttgggccagttcctgtgctacatcctgttttgatcagcagggtcatgacccaggctctggaaacaagccttgctgacccctgcctcagaccccctaatttctcatttctgatgggtacttggtagttctttctcactctctataaatttaacttaaaacatatatcttatgataaatacatttttagctccacagtcattactgctactttgaagtgggctgttttgacaaatggcttaaggctctctcttctacctccacattacagcctcatcaaatgatcagacctttcatctatgacttaagcaagtttttcttgataaaatgcaaagctggtcattgcaggatgacaccaggagtaagcgggttttgggaatggccagttcactattgactgttgttaacctggtggagaaatgtcacagaagcatgtctggtgccactgacaccaagcctrcgacggtctttgcaatcaggaggagaaactcatggaaatcggctcagccaggaggcagactctggctgctgccgtgtaccgagggtgctggtgagagaccttacataaggaacctggagtgtgatgacgtctacggcagctcccacacttcttactccttcataacacaggtgtctatcaggctgtagacatcttgatctccctgagtctctcagatacagaatggtcattaatagcattagtcctgtgtattttacaaggttgcttgggaacaaatgatgccgtataaaataataaccaaagctactgttgagcgtcccccaagagcgaggagctgtttgagggtctttcctcgttatcgagttcttgtccgcagctttgtttgcagatgttagtgcagctgtgtctcagatgagtgatccagacagatcaatttatatgcagttcagagtttgcaccagcatccccacggcttccaagcccatgcactttcgcccccctgggagcttctatgtaggaaatctattaagtgctgcacacaattgtaataagataaaataccttgttcctgccattcgtatttaaatatttattttaaagttctttttgaaattggaaaaaaaacccaatctagatagacttgccattcntccaaaacctargcsgtgtttgcaagtgcttccacgctgaaacaactttctggcctctcacattcataagaggactttctggaagataagcccgtgccattgtttttatatcccaaacggcagcccacatggtcgctatggataagaaagtaaactttatgctgacctctcacctaacgcaccgtgtgggcgccgttattccaggaccatgtcacactttcacagttggagagcgccttccagcttgaaatctcagaaggacctgcgtttccccactaagcatgctccagggtcagcactgyggagcgatgacaccaacctcccagtaggaggataaaacacacgttagagaaacgcgtttccagaataggggaatcaatgggtgaagatggttggggagagagagagacggatggaatttttttatgtgaattggctcactcagttgtggaggctgagaagtctcaagatctgctgtctgcaagctggagcccaggaaagctggtggcttgtgccagcctgagtccaaaggcctgagaatggggtaagagttggagggtacaggtctaagtcccagcccaaggggaggagaccagtgtcccagcgcaaaccggcagaaacgcaaatggtttaaaagctgctgcggcgaatgtcttggagggacgcttggacgcttcccgtcgccgctgtaacgaaccactcccatgggccgcggmggaaaaggccggtttcccgactgcagttccgtggtggggaggctgcggggctcacgggctaagctccccacgcagggccggttcttggccttttctggcttccggaggcgccgtcgtcctgcttcggggccgagttcgtctcccgttgctcactccgaccatctccccgcccgtcctccacgtgtggaccctttgtccttatcctgccccctgtggttacacctgggacatccagaaccatctccccrtctccaggcccccgacgcagccatacccgccaagtcccctttccctgtgggcgaatctgtggccgcccgttcgcagatgcccggaccgtggtgtggacatcggggggcgccattcctggctcggcgcggacgccccctcctcggcgcgggcctgcccggaccccgccctcagccaccacctccgcgtcccattcccactttcccaggttgcccctggtgccctcgcagcacccacccggcagaaaatcacctgtggactgagccggcgagttggtgcgtctttccgtgggcgcaggggtctcgtctccccatcaccgctggcgtccctcttgtggcccacgtaactcttttttttttttccttttctttttgagcatatttgagaggatccttcttccttgctaccaattaagccagtttacattcacataaaatacataatcgctgtatgattcacgaatgtatarttacttaackgtgattttcataattctgtctgtgctaattataaacacactcttgaggaaagttaccatctttctttcttcgtttcctctattaagaaagtaccctgtamagtacttggtacattttgaaagatccttgagttccagtcttgaaaaataatttctttccttttccttttccttttttttcttttcttgtctttttttttttgtgagaaagggtctcactcttgcccaggctagagtacagtgatgcaatcacagctcagtgcagcctcgaactcctgggttcaagcaatcctcctgcctcaacctcctaagtagctgatactacaggcatgcaccaccccacctggctcatgttttaatttttatttttaatagagatggggtctcactattttgcccaggctggtctcaaactcctgccctcaagcaatcctcccacctcagcctcccaaagtgctgggactacaggtctatatgccaccatgcctggtctgaaaaataatttattttatggtaatcttcatctttgagttttgttatatgacagaacttcccgaataccagaggctttccctgacactcatggaaggtcatccaattctgtctggcatccccttcatctcggagcatggccgactggtgaagtcccaccagacctgctggctgccatggggcaaggtggaggctggccaccatcccataccccatggtcatgcccaccatgaggcccagcccagcccagcagagtggatagtgagtcccctgagggtgggtggacacagagaaggaatatttccaaacatgaacacactctaccacatttcatgttgtaatgttattgaattttaggagtggtgttcatctggtgctgtctctgtctatagaagtatctaaagcaggcccgttaactccaaaagctttgcagtatgcagtttttccagtcatggttatcagacacgtctctgaaatagcaacgcttcttcaggaacgcatggcagatgggcttagaagccttcattttgcaggaaaacatttatttgattttaagatacacgttatcccttcactaacatttgtgaaattgttgaaccttaaaatattcatccttcctttttaaagtagcatgttctttctctattctgttaaatctctggtgcaccctacacataatgttgtttaaaatcatgcccataaaatgaaacatgtgactcaagcttttgttttaagaaaatctattagatggtgcatcaaaataatgatttgaaattttcattttaggaaaagacccttctaagttccagcccaggcatattaacatgtaaagtgcatgtgttggcctagagagcgggctgcgttattgaggagagtaggatgttagctcacacagggcagcccctcccaccagacaggaaactcaggctgcctgccttcaacagctcaggatcagtgttgggagcgataagaccaacctcccagtaggaggataaaacacatgttacagaaacacgtttgcagagaaacggaatcagtaggtgatggtgggtggatggatggatggatggatggatggatggatggagagagggagggatggatggatggagagagagagagggagggagggatggatggatggagagagagagagggagggagggatggatggatggagagagggagggagggagggatggatggagagagagggaaggagggatggatggatggatagagagggagagagatggatggatggatgggtggatggatggatgaaattttttatgtgaattggctcatgcagttgtggaggccgagaagtcccaagatctgctgtctgcaagctggagccccaggatagctggtggtggtgttcccrcctgagtccaaaggcctgagaatgggggaagaattggggggtactggtttaagtcccagcccaagggcaggagaacactagtgtcccagctcaaagaggcagatagacaaataccagggtgaagtcccctcctctgcctttctgtcctgttcaggcaggattcgatggattgcatgatgcccacccatgctccctgcttcctccctttcatctcatgcctttgagtgacttccctgatctgaatacgtgcctgcagagataagctattggccttctagctctcctttcctggatgtgtggctggcctggcccctccacagtggcttctgtggtgtngggactgagggtgagagcactgggctgtgagaaagggttggggacagggcgccggcccccaccacacactcactgagtcctggaagctggcaccctctncatgacttcaggctcatgaacgcacttcgtgaaagatctggcactgcaggatgagcttcccacctctcgctgggaccgaggctggcacattctgggaaccctgctttcgagtgtgtcacctggggcggatgtggcactcaccgatcttgtttcagggaactcacatcacttttgaaaagcgggagacagattccatgacttgtttttgttttgttttgttttaatacattttaattgtgagaacgattatcccctttccaaaactaaagttttgagcctctcagagtaaatttctagatacgcttaaaaaaaagtaatgtttttcatcactgttactgctcagttgtcaaaataagacttgtgagtctttgggaagaagaggattatacttgtacttacaaaattattctaacaatgcctgtggctaagaggaccctcaaaatgagtaaggaactgtaacagctcacaagggaccacaggctctgcagagtggcttcggaatccaagactstgaagcacacctgggtgtcctgccaggaactgcagctgcgcgccacatgcgccctgtcagatgtgacttagggatgcgttgtcagcttcagtttgttggacatctgaggacagtggtatatttgccataagatatcagtgtagctgtttaactgcttaggatgggaacacaaattcaagaagctccatagttaaattatcctggctgagatggtagccaagcaagacttatttccagcaaaaaactagcaaggcagaagtatctcaaaccacagatgcaaaagacgaaagaaagctgtgatgtaactgatgggtccctgagtgtgaaagtgtgggctgcagagggagcctactgttcacacagggagttcaggaagaacaggaagcgtgcaggttaagtatggagaaagctgcttcacacgcggatacacagagatataatttattggaatggatarcagagtcacaaatatcacattaccttatattatcaaattgattttatattactatcgcaatcatcaattttctattgtcagttgtaaaatagttacagtcatccctcggtctacatgggggattggttccaggtcccccgtgtactcccaaatcctcacacactcaagtcctacagaacccacatagtctgccctccatttgcctgggtttcacatactggggggctgtatttttgatccgagtttggttgaaaaataatccatctataagtggacttgcacagttcaaacccttgttcaggggtcaactgtaatgaaataaaagaggattaatgtaagatgatataaaaacttttcatattgtattgggtagttgggctttattttcaattttgcatttctcagttgtgcaggatttatcataagacttgctttggtccttccagctatactgagttacatctaaaccatgtcagtactgttaccctagaacacaatgtagaaacttggggggttctcggagagtttcagtgaaagacaagacacagacgaaggcggaggtctgcgtgcagagcccaggtgcaccccgggwggctcgggctgcaacacaacctcctgggaagggaagaaagcaggagtgcggagggaaggtctgcagggtggcgtgggggacggctctgttttgggggctggtatgcggcgcattgacacatgcaggaaaggcagaaacagacatttgcaaactgatttatctataagtagttatatcatgtagagtggacattgacatggttttcaatattttggtactataagtagtgttttgatgtatgtctttgggcatacaatgttttttgtatctgggtttattttctcaagatagattactttctcaacaagtagtattactgagaaaaataaacttttaaagggttctgctatagacaaatgcttctcaaagtgtttcctcttgtttgcttcctcaccagctttggttgttcacacttgcattacgtttgttaattatcaagaaacagtaactcccgattttaatttacygctctttgaatactaatgagattgcacattgtcccacaggctactaggtattggaattcttctaattttttttttttttttttttttgagatggagtcttgctctgtcgcccacgctggagtgcagtggcacgatctcggttcactgcaacctccgccttccaggttcaagcaattcttctgcctcagcctcccgagtagctgggattacaggtacccaccaccacacccagctaatttttgtatttttagtagagatggggtttcaccatgttggccaggatgggatggtctcgatctcttgatctcgtgatctgcccacctcggcctcccaaaatgctgggattaccggtgtgagccaccacgcccggcccagaattcttttaatttttaaattgcatgtttatatccttcatctctttatacttcagactcaatgttttacctaatgattgctgtagcttttaatttaaaactaaaattttcatctttgtatttacagtatatgtttcctctagatttggtttggctttttgtgttttgttttctttttccagtttgatttattctgattaccttaggcctagaaaatttttcctccagagatctgtgtctctgctgaaattacagaacttttaacatattataataatttttaattcctgactgacagtgccaatatctgggttatttctgaatatagttctgttaattgctctgtcgagagacagttgatctccctccaaacctcccctgctctttggtgtgtgttgtagttttttgtttgtttgttttagacagggtcttgctctgtcacccaggctggartccagtggtgtgatcacggctgactacagcctcaaaccccctggctccagtgatgctcccacytcagcttcctgagttgctcggactggcagtctcaagccaccacccccgactaattatttatttatttattgtttgtattaagatggagtctcaccagtttgcctaggctggccttgaactcctgggctcaagygatcctcctgcctcggcttcccaaagtgctgggattgcaggtgcgagctgccgcacgtggcccaatgcagtttttgagtggttgctgggtgttgaatgtggaacgtaaatgtttatgccaggatagcatggctcttttcctgctaattgctggtttsagtccgaaaagttgggaattcagctgcatgtcgttcactttattaagactttgatgagagtggggttatcagaagtaatctgtgtgagtcattgtacaaatagaaatgcaaagacagcattgttaacttctgggaaactttaaatctccagtattcttcattgagtcatctttttatttattttttttttaatttttttctgactaaggtatgtgggtgtgaaatttaaatctgttttatttaggctgtattactttgagagttgtggtttagctttgccagggaaaaatgacataagcatatacctggaggaaaggttacattccttggtttttacatgggataaaaacctgtgatatttgtgatcactgtatccgctaatttataaattcaggagcaagattgcactatttctttctaagaactcataattgaaacagtctgctctgtggtgatgcttgtatacagagaataccgggcagggagtgggcctggccgagagggcaaggctgaggtgcagctcctgctgtcccctccttcctggccgccacgggagactcctggcctgcgtcctgtcttatgaggagagatttcctaaatagagcttttttctttttttttgaaacggaatttcgctcttgtcgcccaggctggagtgcaatggcacaatcgcagctcactgtgacctccgcctcccaggtttaagcaattctcctgccgcagcctcccgagtagttgggattacaggtgcccgccaccacgcctggctaatttttgtatttttagtagagacgaggtttcactatgttggccaggatagtctccaactcctgacctcaggtgatccgcccgcctaggcctcccaaagtgttgggattacaggcgtgagccactgcacctggccagttgagctttttaaagataacagaaaggactgctgagaatgagtaaacctatgtccgtaaagagaattgcatgatttactgcaagtattcctgggagtgaagcatcacgtacacactgctggtctcgtgtcctcctgaagatagcccctcacacttcacagtggttggagaaggttctttttctctcctgtcttccctctgggtcccacctggtctagcattttcatctgtgttgaaatttgtttttcatttctgttttagtccttgtgtttgtccttgttgaaagttaagttgtcagctaccgaggtctttctcgttgactaaaccaccccccaaccccatgctccatgaagagcacctgtggtttccttgtggccatgagtgttgtggtgggaccagcatcaagcgcaagagatctgccgagtccacgtggatacactatgaccccgcagaccatgaaggtagatgaggaggtaatggcattccgtggtgcccyatgtgatggcatcagggttcttcctagcagcytggaagacactcctgccctcaagagggctaagtccagtaaaacccaaccaacaggagacagttgggcaggaagactcattctgagtgtagatggctctgggttttgtgagagggtgaaatctttggtcgttaaacaattctagctgccctagaatggtaaccccaagtcacttcagactggaaaagattttagtggctagaattaaatgtagagatggcaaaatacaccaaagccacagcattaatagacttgcatgaatttaggaataacctggaataattaatatttaaggcatttgcaatgctttaaggatgttgatattttaaaagatctgattctaatttgacatctgtattgaccttggacttgtgacttcttagttgagaaaaaaaggaaaatattactaagtttatgagtatttaaatttttaagagaacttaaaattcaccatatttatgtttgctttgttagatttttaataattgattaagaactcaggaccatcttacattttatttttgtcatttaagtattcaagaaaatcttatatagtacatttaaaatgaagcttaacaattttaaaatactttaacaaagttgtaactttaactcattgcctgagggatttaatctgttcattgtgagttaactgaacatgaatcaaaggctactttgcatgtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatcacagtcccacggttgtgtgttggctgtttgcttgccactccaacctctgtgcattcctgctgtctttgtggaattgtttgctgcgttctctgttgatggaagaggggcttcaaagcttttgggtgggcggcgtctcttcctcttgggagcgagcagggacagcaaaccaggggcatgcggcttccttctaaaaccatatggcaccacagccctacgattgatactgagacacggtaccacatcccacagagaagttgcacaggggtgaggggcatgaaatgaaagaacaacccatttcctctcagttctgttttcttctaagatttgaaatctttaaataaaacagctaagcatactggaaaacagtggagcctctatcaggtgttgcatggccccttaatccatgagactgtgaggtcatcaatccatccgtttccatctgtccttcaagaatatgtaggattggaaagttgggtcttccctgtttgtcaaccaattagcttaattttattttctttgaaaagagaaagtgagcattttagggtttatgttctcttcttcagcattttgagaatttgttttcaactgggtcttctacatcatccactttatttcccacagctgcaggtccctactgagcttagtgacttgaagtagtgagtgcagtgacttgaagagtgagcttgtgtccttactccctgggcatggctgtctcatttcagctgtgcctttcctgttggctcctacagattcttgcttatttttcatggaagacatgtactagatgtggagcaagtatgttataagaaatgttttttttccttcagaagtggttttcagtgtttttttactttgaaaccctttgtccaaatggaaccttgcacaatcatgggggctttctggctgggtggtggcagagcctgggactcaccttctgcctctttctccttcagtctgtggttcctgagtgtggttcctgtgattgctgtcagactcaggcttccacggacctgtttgagaaccactggtctccccaagccctgctgagggagacgctcttcctggtggagctgatgctccctctcctttacagtgcggtttcggcagctcccttgggtctctgtttactcatcctggaacacagatgctgcttttctgcgctgtgttctcagcactggagctggcggcccttcctcccagctttacgtctgcagagtggctggggtacaagggccagcctctctaggaacacagtggaccgccgctctcactcctcttctgtgggattccgactttattctcagagttgcagcttccaagttggtgtggaaagagaggtgcaggtcctgggagcatcctaaaaagcaggactcgcagccctgggttttgcctcttctaagacaggaatccgctgtggggctgaaggggttggagagagcttccaaaatttcttcccggcagtacagttttattgtttcagagcgtggcacaggtgtgggccacactgtgtttctcagcacgccgccttcagtcttgcttgtggttattggaagcacctcctaggctcttgcactagagcgtctgcgcctggtgctgtgtgtgaagttctcatcttttgctgttggggagygtcagggagccccccaggagttcctgccctggcttcatttagccaggaagtctctataagaagccaagctacttagarcttgaggacatcttactgggaatttcacactggccagaaagtgatactcctaaactagtcagttccacaacaggcacatgcactgttctgccacgcagaccgtctgtgagggtgcccttctctgtaactgcgccarcctggactcctcacacctgcagggaagggccccgttcaaatggtgtttatcacggacaaagccaaagtgtgcgtgactgacctacatgatgccagatgtgtggcatcccgggtcctccccagcagcaccgatcaccccaggtgtcrctgtcacagcccaaagtgcctgactcatttccaaaggtcccccagacagccccacctggctcgggctgccgcctatcagactctggggcacgcagacatcgttgttggcctgcttggtgcctgaggctcycaggcattgcccagcacttgaggtgtctctatgtgggatgcctcccctctgccctggcctattatgcatttttaataaatggagccaagtagagtaaatattaattttgtttttayagttgagttcccagtttcagtgtccacacttgttatccactgtctcaaatgcacatctgtgcatgttcttagtcaagcacagactatggctgattttgttaccaaattcagtcctgatactgtccgaatcccccacactggaatctgattatcctttttagaaagcgtttctacaggatgtatgcgtggcagcctcgcaacacccagggtgagagtgagtgctccagtagtctctaacgttgcctcaactccaacaggccccgaaattcaggttccttggctatttgttttaaacaatacaaaaatactcagtacatgcccatcttaataaatgacagaacagtgagaaccaattaatggtcatcrtcaaaatatttatgtcatttctcatcacgtgacatagtttgagttgtcrttttgtttctcatcccgtgacgtggtttgagagtctgttcgaggcccccgggacagtggccackctcagggtctgtggcaggtgctggagggccagcccctctgtggggtgggggctccctgccaggagcaagggctgtcagaccaccttgccctcaccactgcccaggtgagcagggctgctgtctagccacaagctttcttccctgctgtcactctcagaattgacttgaggaattttagaaatcagaatcagagctttgtctagtggtgctattgtttacrctacaaaatgttttatttcttacataattgatctggtttcttctaacgagtaacaatacattacaaaatgttttatttcttacataattgatctggttycttctaacgagtaacaatacattacaaaatgttttatttcttacataattgatctggtttcttctaatgaataacaacagacaaaactgagctattgaagacacattgatcataaaagtcaaagctgagctcataattatcagttaattaaaaaatggggctataggtgcagtggctcacgcctgtaatcccaacactttgggaagctgaggcaggaggatcgtttgagcccaggagagcagtctgggcaacatcgtgagacctgatttctacaaaaatgaaaaatcagctgcgtgtrgtggctcatgcctgtagtcccagctacgcgggagcctgggaggtcgakgctgcaagtgagccaggattggaccactgcactccagcctgggcaacagagcgagaccctatccctaaaaacagaataattttaaaaatgttacttggtttacaaaacttgttctttaacattgactctttaggaacagattaagtaaaggaaatgaagtggcttgtgtgcatgctcgaacccttccagcatctgtgtgattatgaacacacattgtgaacgggacactcagtttctccactgcgtaagacaagcggggaaatacagatttccaatacctggtgggggtgtttttaggggatgagacttcagggtccctttgaaatattaaatggatcccagatgcggggcagtgttccgccttatctgaaatacagtctggatttccttagatgtttctaatttagaatattatgtagaactgcatattaaaatttagtcttctggtgagtgactaaagtttaatcttggtataaaattttgccccccaaaaattaggctttgcatttggaaactggccttcagtctcggcagaagcacacacaacaacgttagcagtttgttcactgggaagggagtaytaggtatctcttgattcgcagtttctancccgtgctggtcagaacacatctcccgccgtgtaagcaaggtggcgggactgcactcccaggccgggaggcttctgaggcttggctrgactgggctcagctcggcgaggcttcaggctggtggaagggagtgctcgctgacagcgtacctggtgggggtctccccggctcycgtgtgctggtccctggcatggtcacttaactcccgacccgttctgcacctgtggttgcgtgtggggtccacatgggtgttggcatgaggacgcgggcgttcattacttcactcactcactcacgcgtttggttacctgaggcacatcaagggctagctgacggaatgggggcagggccagaaaactgggctgggagatgggagccatggagcgttccagtgctagaagagaagtcagggccactcccagggcagatgggtgagcctgagagtctctcgtgggagccagtgtgagcaccgggctctgtccaggtgctgagtggtagagctgcctccagctggcgctgtcctccagggagcctcacaccttactcgcagcccagcacactctccccagatgtggagggtggtcagccacggagaggtcaggaggtggtgagggagggacacggatccaggaaccacaaagcagtgcaggctctcacagcctcgtgttgcctgccgctgccctgtgccaccgtgatggtgaataccacgtgccaacttgactggattgaaggacgcaaagtattgtcctggctgtgtccatgagggtgttgccagaggagattaccattggagtccgtgagctgggaaaggcaggcccaccctcaatgtggatggccaccatctaatcagctgccggcttggctaggataaaagcaggcagaggaacgtggaaggactagacttgctgagtctcctggcctccatctttctcccatgctggatgcttcctgccctcgaacatcagactccaggttcttcagcttttggactcttggaccttggacttacactagtggtttgccaggggctcttgggccttcggccacagactgaaggctacattgttngcttccctacttttgaggttttgggacttggtctggcttccttgctcctcagcttgtagacagagcattgtgggacttcgcctggtgatggtgtgagtgaattctcctaataaactcccctccatatactcatcatctatcctatgagtcctgtccctttagggatccctgactgatacagccactgtcttgtgaaggctggatcatgtcacggatgtgatgtttttagcgcctctgagctgctngagaatttcagactcttccttttaaacctccacccacccgtgtcccccttcaggtgtgggctcagaaatcacaaaattaaggcagactctgaatttggaaagtaaactttcttatcctcatgggttagatttttaaattgtaaaataagaaagaaaatctgttttgattaaacttrtatcttaatgatgttgaagcagaagagacggctgtggctgcatccctgtggccagggccttcctcttgtctctcgtgagcacagttccacgcagcctccttcacagacatcccctctgcyctcgaatacagcttttcttttaaggtacacttgaattttaaactgaaaataacctttggtttgttagagactcacggatgttagttcaggcacatgtttggagttgaagmcaagttgggtctgactggtgtgagctgaacacttcagtgttcagggtccggcttggtagagaccctgttggggttgtgggctcccgtcaggactcacgcgtggttcagctgctacttttttggctttgttttgtctttttcaccgactccatttcttctgtccccgaccctggctgcagcggagttgcagggaagaggtggaggaggctgggttcaactgcggctggcagagcagactcggaggccacagtgcagggaggcgtccagggtggactgagcaggaaacctttctccatgtgcgggtttctctggggtccgctgtcagctttattgtctcctcactcgatgctgcctctgactttatcatacttttcctcatcttaaactgtgatctctgattattttccaaaagccccagcgtgtctcctttagacctatttgctccgggcattcccccggcagcgctgctgtgctcacagtccggactctgagccaggccaggcatttccttcccgggctgtggcctcctcycctcctgacttgtcacctgcaactcccagagcctgagcaggagccgtggagccctcctgcaagytcatcctctatctcatcggcctcctcacccctcgctgttccttatttcacttctgcagattgtacagattttttcttttttaaccagtttctatgtctcaaatgtccctgagcctaaccttccgtccagctcccactggtctcactgtgatgcccatgtgccctccccatgtcccctccaatctcccctatcctgtgcccggggcactcacgcagcctggcacagagtggagaggctkgagcttgtcatcctgcagagttggagtcacctctgtgcctcccttkggccccccttctgttctcagaagcccctgacacagctgtaggtgctctacactcccccatatgctgccttaggggatcccccaaattgtgaaaatgtttatgtactcatttagttcaaaatacttttgaaattctcttttgatttttgtcattgattcatgggttatctaaaattagtgtgctgttttgttttcaaatgtttgaggtctttcttcaactcttattgatttccaatttaataccacatggatagaggaaatactttgcatggcttgaatggattgcttttgctttgtgttctgtgtacacctggaaagaatgtagactctgctgttggcggcgcagtacccgagaaacgtgtcgtgttggttaggcgtgttcctcaagtcttccgcgtccttatgtggtatgtgtttgtcctttccaggattgacagcggcactgaaatctctgactatacctctaggttttctcttttccttgtaattctatcagttttttgttttgtttatttcaaagctactttattaggtttgggttattatgtcctcttaatgagtagacaccttcattgtgatgacatggtggtctttattcctgggaatattttttgctttgaaatatactttgtccgatattaatatagccactctagctttcttttgttagtgttaggatggtatatcttttaaaattatttgtttaaacctatttgggtctctttgtttgaagtgcatttcttataggctgtatttaattgcatcttgatcttttatgcaatttgactatttctgccttttaatgtgtgggtttagaccattcatatttaatgtgattattaatgtgattatgtttcaaactctgtcttgcttattcattttctatttgctccttctgatctttgtttttttatttttgtgctttcttttggccccattagatattttttgtatttccatttatcatctttttttttggcttcttaggtgtaactctttgtttagttaatttgaggtttstttaatttaaagtataaatctttagctgtggyattctattgttaagtgatatgaaaccacttcatctcacaatagcaaacttccatttctcctctccaggctgggtgctattattgtcatgcattttacttttacaatgttatgatctaaatgtttgttttctgccccccaaattcatatgttgaaagcctctctcttaagatgatggtgttcagaggtgggaccatcaggaggtgatgaggtcatgagggaagagcctcctgacaggaattaatgcccccataaaagaggcttgagggcactttgttggcgctttctaccatgtgaggggcagtgagaaggcactgtctatgaggaggaggcccctcaccaggcactgccagcaccttcatcctggacctccagcctccaggacggtgagagataactgtctgttgtttacaaaccacccagtttatggcatttttgtgacagcagcctgaatggactaagaccacatttgttctaaattccacactagatcattatcaattttgtttaaacagttacctcttaaaaatatttaaataataagaacaaaaattctatatatttgtctatgtagtacctcagcaaaccttttgaactttgattttcttatctctaaaattaggtgttggattatacgatctttctgtcccttaagtaggtctcgcctccacagagtggattgatatggtgtgacactctgtgaggggcgtgtgygtatctgcatggggtagtataaaatgtgtagtttacatttttacaatagtttatgttttataaatatgtaatatataaaaacattaataataaagcaatctgataatgattgtatgtactggatatgtagctgaggatgatggggtaaagtgaccaaagttagtgtcccatcaacaagagggccagcatcaagcccatcttcaaattcagagccacaaggccctggcccttggacctggctgtgcccgacaccttggtgccttcccgtcaggcttgggcagcctccctgcacactggccttgcctggctctcacttggagtttcttgtctgggccatgtgcacacaccttacttcttatttgtagccaaagacaaaatggtttgaggttgtattggtccattttatgctgctgataaagacatacctgagactggggagaaaagtaggtttaatttgacttgcggttccatatggctggggaggcctcccagacatggcggagggtaaaaggcactttttacatggtggcagggaagagagaatgagagagaagcaaaagcagaaatccctgctaaaaccatcagatctcgtgagacttagtcactatcacgagaacagcacgggaaagacaggctcccgtgattcagttaccttcccctgggtccctcccacaacttgtgggaattctgggagatacrattcaagtggagatttgggtggggacacagccaaaccatatcagaggtcaatttaaacatttacttgcactgattaggtgcttactgtgtcacagtcaccatccttaagtgctttatgtaatcatcacagccttaacaagcngatacctcattaccttcctatcgcaggtaaggaaactgaggcataaagaagttaaaatgcctgaacaaaagcacacagtgggtaagtggacacgcaaggcttcgcacctcattgatctgacttcagattccatcttcttggcatggtgcccacctacgcaccacagagctgtataagggcagaagagaggagtgtgttctgctgccaccagcaagcactgggaakcatcttgaagaaaagcggggtgagctgtacggagcctttcggggcagattcaagagcagaaagccgtgtctttcttactatggacactcgggaactggagaaaggtttccttctcaaatttattgactagaactcagttccaaatcaacatttcaaaaaagtttcttatttctgtgagaggcaayatatattatatttctactaatgtggcattaatgcttgtttttttcttttttagtccctgagtggtttcaaatgtgtgttttcatgtacaatttatagttctgaagagtgtgtcatttccagatatttcctgactgtctcatcaatgcccacatcattaaagttaatttcatgcctaaggaatctacactaccttccatttggaaaatgttctgcagattctagcaaagtcaacagccaaaccgtgaatgtaaaggctgccgtacagactgcagaagtaggcagcttgccatcgccacgctacctactttacattcaagtgatttatataagagccaaaaaaatgtgctccacatagtattgatctttcactgccatgcagggatgagctgtccagatgataaattaagacaatgagaacataagggattggcttcaagatttgtggttgccgacggaatttcttcagcagaaagagaaggaaactgaactacggaactggtaggatattattatttttactgtaaacgatccaagcctgtcaggcctgtaacttccaagtgcaatgtattatgatctacagtgtaaaacaaaagattctgaatttgagtcagtaatagctggtttattccaggattcaaatgtaagtaacttactctyaccaacagtagtcaaaatgagaagcctgctatgctgtggatttatggctcatggactctggatgagttctgcatttatcttcgtggagtgacgaataattgaattggaaaatcatggcatccagaatggaactgcataaaaatctgctggagtgtttccgaaaaaatgaagacctctgggcccttatcccagactttctatttcagtggtccatggaagagcctgcaagcttggcttttccatctcaggacttagctgcagggtctcagggcacactgcagagactcgtcatcctgttgcctggaggtgtgcactggctatttgcagatgagccgccatcccgatgactgcccaatcctcggctgcctgtgctccgggtctccattcatttgaccagcaagacccacatccagcagcaaggactccaccgggatgggagcctggtgcttattctcgaactcagcaatccagcagtgcacctggstctgtttccagcctggccaatgatattctaagcatgaattattacatattactaattattaaaaattaaatgtaatatcttgagcatgccctgttcaattgatgcttcctgaggccagaatatcaactgatctgttagaatagcaatcagaagaggctaaattcaaatatgatcaaaatcagtaattaacatactctgacacaagatcacttcagtgaggagtttttatgtgcagaagccatcgctgcttgtgggaaatagaaatgtcaaagggagtattggacttagaccaatttctgatgaaatgcagggcacacctttttgtttgaacccagaaatttgtggatagtgttgggaaatatagtgacctgatttatgctctcatagttcttagccatcatagaaacactataaagttaagagggctttatagacacttaggctgctataaaaaattatcccatttttatattcaagtcaatatgttttttcaagtctaaaacagtgtacagtatagaaaagggcaatgaagayagtctcttattttagtgataatcttctgtcctgataacttattaagtggaggggaatgcaagtttttaaaaaatactttgatytttttatttttattgaaaaaaatgttagagacagcatctccctcttgcccaagctcaactcttgggctcctgcaatcttcccaccccagcctcctgagtgtctgggaccacaggtgtgggccaccatgcccagcttatactttgatgtttttaatcaaaataaaagaattttggaagaagaattgaaaaggaaagattgaagataaagaaataaaagtattggcagttcatctgcagaggcactgaataagcacatgttctaaatcatgtagggtgagggctcctttctttgtctggggttacaatgaacaaatgaacagccagaggccccagtcccgcatcacaggtgcacctgcaccgcaccccccacctcagggtcttccccacgtccccagtcagtcctcatttccactctccaaggtggaaactgctcttgtgtccatcacagactggctttgtctgttccgggttgtcacatgaatgccatttggcaagttttcttctctgcttggcctctgtgtaatgattttgaaaatcctccacaatgttgcacgcattctggttccttcctttatatcaccgaggcattttcccctgtgtgggagaaacacagtttacccagccctcagttggggatcttttgatgtttccagtttttggtgattacaaataatgctgccataaaaattcttgtacagctgtttgtgtgaacacatgttctcgtttctcttgcgagagacacgagtgcagttgctgagggcgatgtgtgcttaaccgcaacgtaactgcctctcagttttgcatggggttgtacatcttgacactccccagcaaggtatgagagtctcagtgccatcatctcagttacatgtggtttctttagtctttttaattttagccttgaggtggttgcggagtngtattttcattgtggttttaatttgcatttcttttgtaatgaatgatgttgagcactttaccatatacttatatgcccatttttaattgggttcttttctaaattattgaattatagaacttttcttttttaatgtattctcagctctagacaggtattgcagtatttnccctaatctntgggttgcttattggtgtcatcatggcatccwttaatgaacagaaattttacatttttatgaaatctagtttttaattaaaattagatttgcttaatgctttctgtggcctaagaaacctttgctaacccagagactgagaagatattcttctgtgtttccttctaggatgtttgtggttttttattccatttggatctataacccgttgctacatgacagtattagcaaaactgctgtggcttgaaaccacaccctctttatctcacagctcctgtgggtcacgagtcagggttcgggggagctgggtcctctgcccagggtctcacaaggctgagaccaagctgttggcagggccttggttaccttctgaggcttccctggggacagatctgcttgcaagctcaccaaggacttggcagattttaattccttgtgactgcaggactgagggcttcagttccttgctggctacagggtggaagccatcatcagctccctgaggcccccaaggctcctacctcacaggtaggagcccagcacaaccacatgcctcctcacagccagcaagcgagagagactccagcaggatgcaactgtgtgcacaggcatgccttggttcatcacacatgctgtgttatatgccacaggcgcctcccatgctcacagacaggggtcacatgagggcatgggtccctcctctacctccatcacaaactgattttgggtggggagaaaggtaaggtaaagagtcatttttccctatatgagtatcggtttgctccagcaacacgtgttaaaaacaatttccttttcccgctaaatttcactggtgttcttggtggaacttcattatctctgcaagttaaatctcttgcttaataatcttattgtaatttcagaagatatttcaagtgaatttggtttattcttccagtggtatggttgttattagttatatagttgcctagtgaagaaaattattgtctctcctaatgtttggtaatcttacgggctccattacaaaagtgaaggctcactaatattattctggaaaattactcacttaagattggttaattatattgtaattgacctcatgtgtcatatggcmatagttttggtgtgttaatttacaatttttatttttcccctaagaatttttgtgagaaatataaatgatgattgttttttcatcctcttcactgcctgtaggattgagtcctaacaaggctgagctcgtgctgccaagtctacctttccgcctggtctcccttccatccttctctggtgcactggtccccagagccctctcctcctctggggatgagctcagcctggagcagtctgctcttctttgcttggaatgtgtttttcccacttgctcttttcagactcctccttagcccttcgtcctccttcaaatgttgtcctctctgagacatcccctgaaatgaagttaacgtcagaccttggtgtctccatcgcaggctttagatgctgatgtgaagaggacccgggcatcacattgtaaaccgtcaacttatatatcctgtgtgccactggaattttagttattcaagggaagaatagtttttcatttttattcttgttagtcagcctaatcatcagtatagatcagatgctcagtgaatgctggtgaaataaatcaatccatgttcttatgttataactagttatttctaacaactttacttatgttaatattgcytagaaagtacagtatttttcatccaagagtatttatgtcatcgtggaggcaaaaatatacatctaccacacagaattctagaaaacaaaatgtatgtagtcaatttacttttaaaacatttaaaatgataaatcaccagaagccaagcgagttttatgcataaaagtaggctgtaatgtaacctaggaggttactaatgcactcgtggggaaagtacagcgaatccccttttacggttgcacatggtggtggttgaccagcacagagggtggtggtgcagtcattgcttgagctgaaacgcagaagaaccgggtggcacagaagccacacgggaacagtgtttgctttgcagctccgaaagtttgggatctggaatgcagaaatgcttatatttttaaggatgcaccctacttcaatattttgatttggttatacttcaggctattttaatatctaaaattgtatttcgccagcaatgatttatataaagagtactggagttgacaagcagggccatgaatcgtagcacatctgtgatttgcttgcaaagcaccgacaggggcagctttgctcgtattttcttggtcagaggacttgcctctgctgatgggtcccgtcttcctgcattcaccatcaacctttcccttagagcgtggtaggcacttgtgcccgactgcagccccrtcccacccagccgctgagtccttccagcccctgaggctgaagggagcatgggctgggcatgaactgggcatgaactagaacccgggcatgaccacacgcttctagcctcagctctgccctttgctgttgggtttcttgagttgccttattccwcttggttattacttcgtttcctcaggtaatcaggactttgtcagcttgtctgtccatgcgaaattgtagcagaactagaacaatagcacactaaaaaaagtgacttaaaagattacaaagaataatttcattttaaagatcaaaaatctgccatttagagaatttaggaattgtaagatgtcatagacctaatttgtggcaaactttagagtaaaatcaggtcttctgctctcagccagcattctttctctcactccattctgcctcttcagaacatctggagggttccagggctttggaacacaatatattatgaacatgtgaacggtaacgtccccatttgtggaagtattttcagtttgttctgggagaagagaaccttaagtatctccttaagcatgttatgctcttctagcaggtcgtaatgttcacataaaaataycaatttagccttcaaagcaggccttaaaagaaggtgttatcattcccttatatagaaaggagcctgagatttaaagcgcttgaggttgacccctggccactaagttactaaatgacagagaaggttctgaagcagaaatcctgcatccaagaccagaaatcctcctactatagaacagctgatctgtgtgttttggcctttccattttatgacacttttgtggcactccatttctaatttatattctaagatgtgtcataaagattcaatgaaaatttggcagagaatattttatattgctcttcttttctaaagataaaaatggtaccatgtcttcctcctgacctgtgtactaaaccggaaagaatggcttgcggatgggcagggagacgttgctgggccrggctgggagtgagaggtcggcggctccctagagcaggggccacatcgggacagccaggactctggtgctgcctgaaaacrttccctgagcacccgcagtccctgtggatgctgctgtcccacagtgctctggtctctctgatggcgtycccgcccaggccctccccacctccctgcatacacacacacacacacacacacacacacacacacacacacacacaggccctccaggccctccccacctccctgcatacacacacacacacacacacacacacacacacacacacacacacacacacacacacacacacaccgggcaggccctccccaaacagcacacagagcrcgtgcgagccgcgcttagctgccttttaaaatgacatctgctgctgcggaactctcaagttcatgcaatgaggacgtcatgaaggatgattattttagcctcaactgagagagagtcttttaaaacagttaaaaatcctcagttacagacaacatgcatgaaaatacaattcatttttacatatatggtaatacaaaattccactaacaatgtttaaacattagatattagaagatagtgagggataattacatcacartaaattaggttccagggaggcagttgatcratttagagcaagcactttcttcagtggaacctggcatgaatcttgcctttacctctttctggctatatgaccttgaacaagtgatttcacctcttttattgctagtttcatcagtgaaatattattaaattaattcaagaaagtttatgagggagctactgcagggtgtacggctgttaaatatatatcatttgtccaacacagctgtattccatgccctctgcgttcagctgttgctctgggagtgagggctgcagcgggaacaggctgaaagtcctcgtggagctggcgtttcagcgtgtttgtgtttgtgcagtgggggagacgaacaataataacatgagtggtcatctacgtgcttattaaaaggccacgggttctatggctaaacggaaggaagtggggggcagcttgtgcaggtggggacagcgactctgcatgtgtggtcggggtgggctgcatgactgccgggtggtgggacgatgagaacacaggcccgagcaggatggagcctggatgcttgggtcagcaggacggacactggagcagcaagtgagagggagacctcctgagtgactgggggcagtggggcccagacccctgttgcctttctttgtatgcggcttctctgcgtgggacggaacccacgggagggtattgagtagatcactgagaaaaatctgacttctaagacaggggtttgcagatgaccctgtttttgtaaataaagttttatcagtacgcaggcattcatgtaagtgtcgactgtgactgcgttcagaatagcagcagcggagttgcgtggttatgacgcaagcgacctggccttcaaagccagaatcgtctttactctctggctgctaataagacacgttttttcttttcttttctttttttttttttttttttgagatggagtctcgctcttattgcccaggctggagtgcaatggcgcaatctcagctcactccaacctccacctcctgggttcaagtgattctcctgcctcagcctcctgagtagctgggattacaggcacccaccaccatgcccagctaatttttttgtatttttagtagagacagggtttcaccatgttggccaggctggtctcgaactcctgacctcaggtaatccatccaccttggcctcctaaagtactggatcctcctcttgttttaacagagtcactcaggttgttatgttgagaaaaaactagaggaagaggttggacacaggagaccaactaggaggtgcctggagtaaatcaggagagatagtggtaagttctgtgaaaaacgtaacccagataagggggcccagtgagggtgagcgtggggtctctctgtgtctaaattacttagcgaagtgattggagccttatgagtcccagttcattagctgtaggggtggtagaaatcagtttgtttactgtagtagtttcatccaactgaagtatgatttgtatttataaagtggggactcattcacctttccaaaatagcatgaatggacatgccagctcaaacgcctttggaattttatagtatttttcctcatttatttttccttagaagagtttatgttctttatttattttaatctatgcccacataaaaataactcaaaatgtccaggtgcggtggctgacacctgtaaaccctccactttgagaggccgaggtaggcagattgcttcagtccaggagttcaagaccagcttgggcaacatagtgagaccccgtctctacaaaacatacaaaagttaaccaggcgtggtggcgcatgcctgtggtctcagctacttgggatgctgaggtgggaggattgcttgagcccaggaggtcaaggctgcagtgagctgtgattgagtcactgcactccagcctgggcaacagagaaagaccctgtctcaaaaataaaataaggccaggtgtggtggctcacacctgtaatcccagcactttgggaggctgaggcgagtggatcacttgaggttagcagttcaagaccagcctggaaatcatggtgaaaccccatctctactaaaaatacaaaaactagcctgagtatggtggcacatgcctgtagtcctagctactcaggtggctgaggcaggagaattgcttgaacccaggaggtggaggttgcaatgagccgagattgtgccactgcactccagcctgggtgacagagtgataccctatctcaaaataaataaataaataaataatataaaatacaataacaataaaaataactcagaatgacacacaagcattaactggatctgtgggcccagtagcctagactaccatttcatgtactcagtggacagcagttcctggcctcattaaccttcttgttgatgctagatgtgttattttagaaacatacaaagtaactgaacactcttataacgatatgtgcagcttttctgaaagtttacttaaacaaattctttttaaagagcagttttaggttcacagcaaaattgtgaggaaagtatggagatttcccttgtgcctcctggccccctgtccctatcttccaccagagtggtacgtttgttactgttaccattgttgatgaacctacattgacacatcatcatcaccaaagtccacagtttatcagcattcactcttggtggtgtgccttctatgggttctgacaggcctataatggcatcatccaccatgacagcatcatagtgtatgttctctacatactgtagttccactgccttaagaatctgcctattcatccctctctccttcctaactcctgtcaaccactggtttctttactgtctccatagtgttgccttttccaggagatcatagagttggaatcacacagcatgcagcctattcagattggcatctttctctgcatagcatgtgtttaagcttcctctgtgtcttttcatggcttgcttgctcacttcttttaagtgctggatcacactctgtcatctggatgcaccacagttttatttatcagttcacctactgaagcacgtctttgtagctttcatattttgcaattatgaataaagctgctgtaaacatccatgtgcaatttttgtgtgatgaacaattttcagcttattttggtaaataccaaggagtacagtttctgaatcatatggtaagtgtatgtttagttctgtgggaaactgccaaattgtcttccaaaaaggctgcaccattttgcactcccaccagcaatgaatgggagttcctgttgctccacatcctcaccagcatttggtgttttccatgttctggactttagccattctcataggtgtgcaaataatctcattgttgtttaaatgtgcattttcctgatgatgtgatgtggagtatttttatatgcttatttgccatcggtatgtccctctttggtgaggcatctgttgacatctttggcccaattttttatcgggttattttcttttgtatatattagatagcagttctttatcggatttgtcttttgcgtttattttctcccggtttgtggcttatcttctcattcacttgacattatccatttcagagaagtttttaattccagtgaagtcctgattttcagttattctttcatagatcatgctttttttgttgtatctaaaaattcattgccatacccaaggtcatctaggttttcttctatgttatcttctaggaattatatagctttgcattttgcagttaggtttgtgatcagttatgagttaacttttgtgtgaagggtgtaaggtctatgtccagattcatttgtttttttgcatgtgaatgtccagttgttctatagcaccatttgttaaagactattttcttcattgtattgtctttgctcctctgtcaaagatctgttggctgtatttatgtgggtctatttctgggctctctattctgttccattgttctgtttgtctcttctttttccaacacagcactgtcttgattactatagattcatagtaagtcttgaagtagggaactgttaccccttcaactttgttcttctctttcaatactgagttggctcttctcagtatatgaaatatgaaatatttctatgtatatatgaaaggtcttttgcttttcatacatacagtgtgatgtttcaatacatgtatacactttataatgatcaaatcagggtaattcacatatcagtcacttcaaacctttattatttcttggtgttggtaaaattcagaatcctctcttctagctgtttaaaaaatacaataaattattgtttattatagtttttttgcctttctatgtaaatttcagaatcattttgttgatatacacaaaataattagctgcacttttgattggggttgcactgaatgtgtagatcgaattgggaagaaccgacacctggacagtattgtcttcctatccatggacatggaatagctctccatttatttagttcttctttgatatccttcattagagttttgtcattttcctcatatagaccttgtacttattttgatagatttatacctgtttcatttttgggttgctaatgtaaatgatattgtgtttttaatttcaaattccacttgttcattgttggtatataggaaagtgattaacttttatgtattaaccttgaaagtgattaacttttgtatattgaccttgaattctgcaatcctgctaaaatcactgtttgttccagaaggttttttttttttggtaaattctttcaaatgttctatgtagacaatcatgtcatctacaaagtcagttttgtttcttctttaccaatctgtataccttttatttccttttcttgtcttattgcattagctaggaattccagtataatgttgaaaagcagcagtgaaaggggatatccttgctttgttcctgatcttagtgggaaagctttaaatttctcaccattaagtgtgatgttagatgtaggtttttggtagatattctttatgaagttgaagaagttctctgttcttagtttactgagaatttttattatgaatgggtgtggtattttgtcaaatgattttcagtatctattgatattttttagcctattgatgggatagattacattaattgatttttaaatgttgaatcagccttgcatacctgggataaatcccacctggtcaaggtgtataatttctttcgtacattgttggattcaacttattaatattttattgaggatttttgcatctgtctacatgagaaatattagtctctagttgtcttttttttgttgttttttactgtccttggtttttttgttagagtaatgctggcctcatagaatgagtttggaagcattctttctgtttctatcctttaaaggagattatagagaattggattcatttcttatttaaatatctggtataattcaccagtgaacccatctgggcctagtgatttctggtttgagaagttattaattattgattcaattttggatatagtcttatttagattgtttcttcttgtgtgagttttggcatattgtgtctttcaaagaattggtccattttgtttaggttatcatatttatgggcataaagttgtttatagaattctttttttatcttttttatattataagatctgtacttgtggtgtcccctctttcatttctcatattagtaatttgtgtcctgtccctttttttcttggctatctccccactttcacttgtgagaacatagtcaagagctcgattgtaagtaaaaactgtctctaacaaactaaggaggccctgtgagatctcgccagtagtttgagttttacgtaagccagcgcccctagtacagttattgttgattagaaacatggccagacagctggagattttacatagaaagttctttcataaaattattctcattttgtggtagctccttgaccattgcatccatgctaagctttgcttgagctgtggaacccttccatgatgggtttgagggtctggggatagaagggatttgtgccctatttctcatctggaaactggagaagagacggcctcaggtgtgctcagtggcacgaagagggtggcttcagtggtttagaatctgcggccaggcaagtctgaggagactgtggatacacatctgccctatcctcagtgtccccacggctctccctgagctcctgagggcccaggaagactcaaaagggaagcagaagggagtgcacgtggaggctgacagtgtaccagcttcctgtgggagctggagcccaggtccctgcagcccagcagagtggctgtcacagagctgccgtgaacgctgctgtacacaggttttgtgtgaaaagaagttgtctttcctc

SEQ ID NO: 10666 - DNA, 38664 bp, Homo sapiens
aaagaagactcacccctaagtgtttcaagaaagcagttttgaaagaaaacatgactgatttcatcatttgcccaacagtctaaaaaatagtaattacgaggctcatcctaacactttttaaaaaactggaaacaaagccatgctatttaatagcttttaagatatgtagaaatattcttttaaaaagtatgcctatatttgccacgttgtaaggcacataagaatatgaaaataggattttagacatattctataaactcttctcactgttagcacttaataaaatgctaaatgtcagcaaaacagaatagcaataacctgcccatggtgatatctaaaaattaatgagatgcctgagagaaaatgcaacaaagtactgttgattcttaacgtattttttttaatatagatgttggttttccccctgggagattaaaaatgttacttaatgatcttagaataaaaaaaaaaattactctccttgaataatgtctccctattatgtactaatataatttttaaaataaatattaaatatttgtaaacctgtacaaatgtgatgtttttggcttgcactgtgcctttttagagagtagaaccagtatttgctccaagtatgcaaatatcacaggcaaaaaaaaaaaaatccttcctcttttttcttttctagcttcagaatgccttagttcgctaattttctgtcacgagctttaagaaggtaggtactatagaatcaacttctgtctccagggcttctgcggcacagctcttgttactccatattacattcctgccaagcacagaaatagagtaatttactctttctcagctttgacaggtgccactctgcagagagggagtgagaaagtagcagacaaaaccacaaacttcaggatattaaatagagtgtgcatctctttcctggacgtgccaatttgcttgggaatcttgccgaatgaataaatgggtaaaaagaaaagattatgtctttgatttcattactcaggaatgttctaatatatttttaaatggtggaattagtcataggtttaatatttaggcattcagatctggtttttttttttcactttcattctaatgaatatatcttagccttgataaaacacagagaatgagagataaacagtaaacatattaaaaacaagcatacttctccacagtccagaaaaaataaagcttgaaaattttgtgatcaaaattcaagtcaagatctatggcattatgtatacataacattatatattagataaattatatattatataatgaagaccaaaaagtgcataactgctgcaaatgattaacctgtgttttgttttttgttttttcaaataagttatctttgtgactacaatttgataggagctcaacaaatgttaggtaaataaagttttaaatattacatacattttattgtccacctactatgtgctaagcacacagaacatgtgcattacttctaatgctcacaatccttaaaagtattttatttccattatagagatgagaattgtacatcagtccaaaagtattaattaaattcataaaagatcttatttagagacatttaagaataggtattgttctaatataacagtactatttataaataaaatttcataaattgaagcaattttaccaaagtgaaaattgtcagatattatgttattctaagcaagtatgctggtttcagtaatccttgatataaacttccattccaaaggctgggttatttgacaagtttctgcactggattaaattctttggcaattctttcctgattcctttcattggctactctgcagatgtctcagtgacccacagctcagtgttttgctctctgctcaatccacactccatccttcgaatactggctttcaaacttttgagcatgccacacaattaggtatatattttataatgtaacacacaatacactgaataaaatagaaacaaaaatgtcatgaagcaatacttatcctacaatatgggataaatctgatattttttactctgtgcttgtttttttaaatgctggttgttactcattacattgatttcctgactcattaatggggcacaactcacaatatgacagcactgttctgggtgatctccagtgccatagctttaaatatgatctgactcttacatgtatatcccagccgtatcttctcctctaactccagactactatattctacttgacatctccatgtggatgtttttctaaacctgctccccttcccttcgtgttctacttcctggtaaaatggcaacaccaattacccagatgcttaggccaaaaactcaaaagtcccactcaacttctttttttctctctctcataccctgccatctctacctttgaagtatatgctaaatccaactcctcagcacctctaccactaccaccttaatctaagtcatcgccagtgcttacaaggactactgcaaaagcctattaactattttcctccactttccataaaacagtccattctccaacaacagggtgatccttaaaaacataaatcagatgtctcgtgctcaaaaccatccaatggctcttcagcacactcaaaataaaatccaaatttcctattatggcctataggcctactgtgaccctagctatccctttctgacctcatctcttatccttcttcactcccttccagccatagctgtccttgctgtttttggaaggtgccacttgagaatatttgtacttgctattgctttgcctagaatgcttttctccaagagattcacagggcttgctccctcatttcattgatttttctgcataaatattaactcagaacagcctctcctgactgcctgaattgaaaaagcacaccctagcctcttacctagcttccctttttcttcatagctcttatcacctaacactataacatctccagtgcttaatgaactgaaactttagttcaaggaatgaatgtacatatatgaatgtcagaaatcactgtctgagagtattattaataactttagtcttggtacaatgtgtatctcattcttcatgacaccattctttcttttccaaattaataactctattttaaggaccaactaagtataaattaaaatgaagaaataagatcacctttgtgaggtgaatcgggaaaagtataaatggaatctaaccaaactcataaataaagcaagcacagaagtttttatgtatacttatatccagggcaaaggaactaagaatcttaactagattccatacatgtgcctagcaagaatatttataaaacaagaattataaagtaatagattagagccgagactgttgagccagaccacctgggtgcaaatatactggttctgattcttagtagctataaaaaacttttctgcatatctgtttcctcacttatataataaaatggagacaataataactgtacctaccatgtagtgtgccatacagaaaaaagcttgtcacatattaagtccttaaataaatactagctactattatttctttataatttataaccaaattccttatcaactggcactattaaaatatgcaaaccttgatgggcaaaacccaaattatggtttatattttcaagcttctttccatgaaaggtaaaggatttatattgattgaaaagtttttcccaaccaaatactgaaaaaaaacatatttgttactgaggctgaaagccagggaatcatgaaatggtaaaatataaacgtgaaacccttaatccatgtgcatatcaacctattgtacaaaataagaagttcaacacagtttataagtatgaaaaatcacaaacacttacttttcttaaagattaaaatttaaacctgcctaaattctctcctacatcatatgttcaacattttgaattttataacttatcttgtgttttatgcttttcataaaacaacagtatttggctgaaaattgtaccctattttattacaataatatagatttaaccaaaacaaaacaaaacaaaaaaacatgcccctcaacagatagatagcagccaattaccttaaatatttagggtcaaaaacgataagaaaaacactgagattttttcaagctcattaaatacgtaatatgggatgcagttaagtcctagagaacaaaagccagtgattaaaattagctgttttcttatctggtaaagaagtaggaaaagtttttaagtgaaaagcttacagtaaccttagccacaaacgaagtgtgtaatctctctggagaatcagggaatcatctgttgccatggagtcataatgccttcagctaaacccgacctcataattaacagtgatcgacagcgcaaatggctaacatgttaccaagtatgaaataaaattactgaattttcacagcaaacaatacctgtgcttgttttaatctaaatggtttcaatatctgcattccaagtatttattctttgttagaaaagctaattggatactcagtatttatttttatttaaaaatcacagatgatgaaacaaaagctacaagtaaaacaagtttaaaaaaacaaaaacaggccgggcgcggtggctcacgcctgtaatcccacccctttgggaagccgaggcgggcggatcatttgaggtcaggagtttgagaccagcctggccaacatggtgaaacccctcctcgactgaaaaaaaaaaaaaaaaaaaaggagccgagtgtgattgtgggcgcctgtaatcccaactactcgggaggctgaggcaggagaattgcttgagcccgggaggcggatgttgccattgcaatccatccccaggcgacagagcaggactccagctcaaaaaaaaaaaaaaaaaaaaaaaattgatgggcccactactacagaagctcaagtttgagctgtgtttaaattaaagcaaaaacacgtagaagtgcaaagtatataaaataaaaagaaatgatgattctcaaatctcattgaccttttcagtcttatttttgaagtgagacctcacaaaacgatactttcaggtgtaatacaaacacaatttttagtaatgagtgtgcttaaagcaatcctctcagtggtgtatgctccccatcaggcagttaaaaaaaaagaaaaaaaaacccgcatagcttaatgtttattaaatatgacagcgaatcacttagttgtgttataacagtttattatcatggatttaaatgactatgtttacatgtttaaaattatcacatcactagttcttgctagcttttgcattttctcctgtaaacattgtttttacagataagcttaggtaaaatagaaatacaccaccttctttatcaataatgtagcacacaatatattactaaagctggcattttcttgatattcaagaatttatgacaaggaatgggatcctggcattaagaataaaggggaaaaaaacaagtcatctcatcccaaaaccaggtagaaagttgggatgggaagtacgtgtattagcaaacgtttttgaaaccaaagcaactttcatgcaaattaaactttctatagaagttaaaaacccaagagatactgctgtgatgacaaaacataagcaaatggccccaaatgaagcaagtcctttggagtaaatgttaagtagtattcacatagaactgctttctgcaatcaggaagggctggaatggaaaactcaatgccaaagagagaagagaagttagtgtgacccaagaggtcttgaagtaacacttaacagcaaatatcaaaccaccccaaccaacgcctccaactggaagctgccccatttctccatcagcagaggaagacatgagggactggctagggggaaactgggaaacgcgtactaccgagaagcccagagccctcaacccgcaccttcagcaggagtggccaaaaaggagtttgaggcggccccagggcgggagaaaaatcaggacgatgataccacgcccttgtccttcccacccttcccccgcatcctcagccctgcagacccccgaagaaaagaccagttcttagggggtcgcggaggctgagaagccggcggcccgagcgccctctttacctggtcgcagaggcgcggccaggcagggagggtgcgtgagcgtgtcggcgacctgggccgcctgcgccttcccgcccagtccgagctggaattccaaggctgcctctgggagctgctgcccgcagaccactcgcctccacagacgccaggagaaaaacgacagccaccttatgtggaaaatactcgcgccggccgtcattcataatccggcggaccggaaaaagggaagtaacgtcacttcctactgtcgcactgccaaacgtttcccccgcccctactgtgggaacctttgttttcctgctttcggagccggccagtgcgggaaccgtttccgaagggaccaccgggaacagacggatcggcagggcggggcggaacggtgagttatgctgagcgactctgctcctggcctcctggaggctcgagacccccgcgccaggagcgaggtgggagagtagctacgtggggtattagtttcctcgctcctcaaggggaatcataatttacgggcggttgcgtgccctagactgactgctctcccctttcagtgaggactgtgcttcctccgagggagttgcgggccgggacatgcggaccgagcatatttctaggtctagggacaagggacttggaatcctgcctcggactttgtcggagggttttagtgacttctctacgtagctccctcattgtctctcatcttttggctcccctgtcaaggaccatcccccattctaggacttcgatgtgtgatgctttgatcaaaggattgacattccttttctaagtgtttgctgtcagctttcagccacttgattggtttggaatcggagccttttctcctgcgattccaggtgtccctaaggtatcagtgttatccagaaccaagaactcagtggaggaatgaaaaaggcagcatctttaaaataatgtttattggaaggggttgcaagagcttgcgaagtcatgaagaacaaagttttttagagccattatgaaatggcaacgataatactgcactctatgtgaacagtttctgtttccttcatctggggcacgtgcatatgatcaactttggacttcttttgagattgccaggtagggtgaaaaatggatctaggagaaagcacatacttatatttatatatgaatgcccaatttagactggagagatcacagaagccttataaggtgacatttacgcaaaaaacctagttcgttcattcgataaatatttttgagcccttattaagtttcaagcactagggaaataacagtgaacaaaacaagttcctgctgtcatcaagtttacagaccagtgggattaatgaattaagcaagacaggcgaaagattgtgagaattttacagataggaacattgtactacaagtccccagtcgtgaaagaggtgattgctttgcttttgcttttttgatgtttggagttttttttgtgggggcaggggtgagttacttttgtgatttttgctgaagggaccttggaaatggctacaattgtgtagaaggagagataagaccactatactttgatcacttaattccagtaattctatagccattattttgttgtactttgcaaagtggcaaagagataggcaaaaagataaatatagactctgcccttaaagtactcagagttttgtaggggacataacacttgtgccaaaaaaaaaaaaaaatgcttcaagggagaaagttgcaataccatgaaaaagcactatgagatatccttgaatggagagactattaatagggtttggaatggagaggggcacagcagctgtcagtcaaatcttcatgagaagtatttgaatagggtcttgataggatgtagatatataaaaataggtaaagagcttcctggacaaaaaaaataagagtggcagggtcagctagctataaggcagatctggggatgatgaatgataatttttgtgccagttactgaatcttcttaaatgctaggccaagaaatttggtctttatttcgaaggtggtagaaagccctaacttctcagcaagaatttttttttttattttaatgaaaaagaagaaaactgggtttcaggaaaattcatatggcaacaatgttgaagtcaaggaaaataacgaggttattgccatagttcaagtaagctaataaaacctgaatttcagtagtagcagtggaagtgaaaagtaggacaagtgtgaaaaatattgccgtcagaatccacaggaattctgattatttgaatataaggagtagggaaagactcagtgaaggaaagactttggtctcaaacctgactaaaagaaagttgtgtcatttattgaaagtaagagcaggacaaggaacttttcgggaagataatcagaatctcaattttagttgtaactgaatttgagatgccattaaggaatcacatagacacatacactaagcatttggaaacatgggattcaaatttaagagatttggctcgcacttgtaatcccagcactttgggaagccacaacaggaggattgtttgagaccagataagagcaacatagcaagaccctggctctacttaaaaaacaacaaaattacctgggcatggttacggtggtgcatgcctgtagtcctagctgcttgggaggctgaggcaggaggatcacttgagcccaggagttcgaggctgcagtgagccatgatctcagtgcactccaacctgggtgacagagcaagaccatgtctcaaaaaaaaaaaaaaaaaaaaagagattgaagttggggtaaaacatattaaatcatctacccagagatgatagttgaaaacctgatgtgtataagattaccaagaagaaactgctagcagaactaagaagatagccaaggacaaatacttggacaataccaaaagcaacaaagaagataagccaaagaaagagtagtcagagatagaagaggaaaaacagaaaagttgagtataacagaactcaagggaagagaaagttttatgaaattggaagtagataacaagtatttacttggccaacatttacagttatttgctgttttccaggaactctgccagacaggggttacaacagtaggcaagaccaatccactgcctgccttcatggaacttacattctaatgagaaagaaagattatttacataattaacagtgtgattaatattacaaataagtacagaatgtttttgggctatgtaacagtgaaacttctagttttgttgagggaatgtgcaggaaaaactgaaacttgagaggtgacttaagatggaggtgggggtggcacactttctactgaagtgctaaggtaagaaagagtatattggaggacttgaaataagtcagatagctataacagagagagtgagaatggcctaagatactaggtaacatttaatgagtgtcaactatgtgtcaggtactgttgtaactgctttatatgtattattaatcatgtagagcaatggtccacaacctttttggcaccagggaccagtttcattgaagacatggtttcaggatgattcaagtgcattacatttattgtgcactttatttctcttattactacatggtaatatataataaaataattggacaactcaccataatgtagaatcagtgggaaccttgagcttgctttcctgcagctagacggtttcatctggggatgatggggtatactgtgacagatcatcaggcattagattctcatgaggagcacacaacgtagatcacacacatgcacagttcacataggattcgcattcctatgagaatctaattccaccagtgatgtgacaggaggcagagctcaggtagtaatgcaagtgatgggagtggctgtaaatacaaatgaagcttccctcgcttgcctactgctcacctcctgctgcatggcctgaaggttagggacccctgatgtagagaattggagaccttgttaagaatcttattcttgaacctttggattgtgagaagtgataaaaggattttaagcaagtgagtgatatgaaaaggtttaaagggatgacaagagtgattgtgggagactgattaagcttttgcagtgggccagataatagatgatgctaggttggtctagggtggtagtagtaaggattgaaaagggtggatagatttgaggtatgtttaagaggtttggttattgaattgggggtgggaattaaggaagtgggaagagttaaagctgcttctgggttactggcttgggcaatagggtaaatatcatttgaaaaagggattactagaggaagaactggttaggagaaaagggaatagtgtatgagtggctctgttggagacacgttgcataggaggcaccaatgatatatccatgtcaagctggcagttggatcttgggagagacacatggactgcagagatgtattagtaatcactggcaaaagactatatagatcaaattgtctagggcaataattcccaaactttagagtagatagaattgcctggaaggcttaacacagatttctagaccctactcccagagttttttcttcagtaggcctaggaatggagaccaagagtttgtatttctaagttctgacgtgatacctatgctgctgactcagagaacacatttttggaagaagatgtagaacaagtcaagaagagacccagaacctagcactgaggaactcatttttaattggataggaggaacctacaaagatgactgacaaagaagtaggagggacaatcgtatgtattaggtttacctgactgaggcggcgaatgactcatgagagcattttcatggaatagtgggacaaaggctgaattgcaagaattgctgtgtaaatagaaggaatgaagaaaaagagtacaaaagcatatgatttctgagaacgttttgctataaaagagaaaagatagaagatgtttgaatatatttaatgtcaatgaaaagatgccagtagaaaggctgaaaaaaaaaaaaagaagatatgggaaataatccataggccaaggttcaagaggggacaagaagagataggatccagatccaggtgacactacatagagagctaccttctccttttttatcagatgggaaagaggaaaggatgagtgcaggtaagtttgtagatgtgctggaaggaagtcgacttaattcctctctgacagcctctctttgtgaagtaggtgaggccatctactgaaacacagaagcaattttaaaagaaaatggaggaagtataactgatctttgcagaaagtggggaagtgagttgaccagagaaggatgagagaattgccaagttgtactgaacgccaagctgagaatggtgattctgaagatagaatgtatgtatattcctcccagttgcacttagagtttgggtgcaggcagagagagaatggctagcagggtggatgtctataaagtagggaaactacagggctttcgggtgcctagagtactgaaagaggtattgaaagggtggaccacagaatgtgagctggataggaagtaaacggcatactgcaataaatcaaggataataagagatacagaaaaaagatcattgttcagtaatggcgatttttgtgctatatgcatttgacacagctaattcccagcatcacctaagaattcactcctatcaatactactactaccacttccctaggtcagcgaaagctttaaagtggtaaatattaattttctcacattctcctttttgaaagcaacatctactttttaaatgaaacctacatttaatatattaaatatctttcatatatacatttttctttcatacacacacacaggactttgttttctagaactctaatccatagtaagaatgatatggctcttttgcagtctgttttggccatgggtttaggaatgaatatacaggaaaggaattgtatagaagtaacatgatttggtgtaactccaggaaaatatttttgtatgtgtagatcaacacagttacaccaagttgctgacctctttatgactgctgtagaaagtaaacttctttcactatatggatatttgccggtaaggaaggaaaagtaacagagattagagaaggcaacagaaaagggggagtaaaggtaagatagaaaactaaaatataaaatataaaccacataaccataagtgttttattttaggttcaactactgttttctgtttggtgaggaaacaaaagtcagggcaagagggtgccaataaggagaaagcagaagggacaagaaattggaggcttctgtaacaaagaacaagtagaatgggaatagagaaatgaataaatacagaagaaagattgacttggcactttgaagaggtccctggattaaggcagtggaagagatagagtaatggaagattgtagtcagaaaggagaattgattgtaataaaagaggacaatagttgtggcaagtttcagatttcactggctgaagataaagctccttgaggttaaagatcaattatataacacactattatcactctgtatatgaatagatttttaaaaaataaatagaaatagaaataaattggctgggcgcggtggctcacgcctgtaatcccagcactttgggaggccgaggcgggtggatcacaaggtcaggagatcgagaccatcctggctaacatgatgaaaccccgtctgtactaaaaaatacaaaaaattagccgggtgtggtggcgggcgcctgtagtcccagctactcgggaggctgaggcaggagaatggcatgaacccgtgaggcggagcttgccatgagccgagatcatgccactgcactccagcctgggcgacagagcgagactctgtctcaaaaaaaaaaaaaaaaaaaaaaagaaatagaaataaattaaaaagttaatatttttttctctgtattccaccatggggaccactgggtcaaagggccatgttagtaatttaggggaggggtacaaagcctgttaagttttataatggcaagattgcataaaaagaactgactccaaggttccaactggaatgttggtgttgatgacttccgcagtcttgtaatctaggtgctgactcttgtcacctaatctgtaatgtaaacctcttacctgtgattgtagaaatacatagcaataaatacttggctttcatttttcagcatagaaatttcaagaaatggtttttctaatatattacaagggttcttttaggtgtcaaccctttggtcagcacccaataaaataaattgttttataacaatctggataagtaaactgctatttcctttacctatatgaaataaaatcagtagaaagattagtaaactgtcacaggagtggaatttaaagaaaaaaaagagattaggctgttacccttgtatatgctgggggaatggcaggtttacccttttaatcttggaaattttattaaggagctattttttcctcagaacgtacatggtgaccagccccatgagtaaattttaaaataatttttctgtacctatcattatgtagaggtgatgtatataataatataattttaagaagtgacagaggctgcttttcaattttgttaaattcttagaaatacaacagtttgagataaggttactttttcattatagtactggcctttggattcctttccatgggtgattcagatgatattttagtacagtacagaattcgacagtaattttgtagttatcaggtagataactaataccttcctgggaacttaaaaaaaaaaaaaaaaaagcctagggatgtgtatgtgtgtttcttgtcagatgtggagaaggatgaggagtgaagctggaggggaggggacaacaaaatccattttcagatgtgctttcatatgctaggattcaacctacagcaagttttaatggtgttataaacccctgaaaatgggagataactgtggaattgctgacagttccctaactatagcartgcaagtgtgctgcattaatacaatattaacctcaaggatagaagatttcaagccatagtatattgatcaaaggattgaacacaaagaatacatttttattttgataatttcttgcctggagaggtctttgaaaaagtgacaaccagaagcagaaccacatgatagcattggtattaactaaaaacaaaactttttagtattgtggaatttcataagcctttgatgtatatctttatccatcttggctattttttaagctctttaggacacaaagcatcataggctctgtgtgtgtgtgtgtgtgtgtgtgtgtgtgtgtgtgtgttttaagtagatatgatattatccctcagagaccttacttttaaaaataggttaatgcatgagataccacaatctaaatgtgatcaaataaggttatcattaatatgttttctgagacatttagggttggggcagagaactgaagaggtgagtttagaaaaaaaaaaaaaaagagttgaggtaaaagtggcagcagtgaccatgatagctaatcacttaatataccttttcaccattgccctcttacgatagcccttacacacacaaacacctgcacactaagtcttcccttgtgttatggaaataaggtttgagagaagaaattttgatacagagtaaacttgacgtaaacccatcaagttctatgtactgaaactgcgaagtgtatcttttaaaacacagttaggaaggagttctgtggcagggagaggcctacctggatttaaaacgttaccatcgatatggatacacagaaaactgatactgctagttgtttcagggggaaggaactagataatgcctgtcaggaataagaaggaaatttacttttatttgtaataactttttggtgattttaaattttatatcatgtgtacagtattatctattacaaattaaaaaacagaaaagtaaaactttaacatagataattgtgcattgtcttctagattactttctctttttttccttcaggcgtttgcaatggctgctactgtgaacttggaacttgatcccatttttttgaaagcactaggtttcttgcattcaaagagtaaagattctgctgaaaagctaaaagcactgcttgatgaatctttggctcggggcattgattccagttaccgtccatctcaaaaggtacttgaatgaataaaaagcttggagagagttttgtaaggcctgtagtactacattgataacatatagaccatctcaaaacaatctctgccgaaataatctttccttgtagcatgaagaaattatattctttattttcttttttcccttcaagttttcagagaactgttacaccacatagaaaaatcagctgggggtgcaggatattctgttctactactttatgtgtatatgaattcacttgtttacgacttactttaatttccgattctttgtgatcagaattttttttaagctgctgaatgtaaccacaacttacttctaattattgcctaatattttaaggattaaaaaaaatcaagtaaaaggacagatctttcaacaaaataaattgaatatgggtaggataatttaagagaaaaggaggtatggatgaactctgagaactgtgtagctcctgtcttgataataacaaagcagccaatggcagctttatgtgaaaagaatatatgttttgataccaaacacacctgttttaaatcccacttaaatcttataattgtgtgatgataatagacaacgtatcttgatgtcccaggcacttttctgagtagtttatgtgaataattaattttaattatgataatgatcctttaagatagataactgttttcttcattttacataaggaaactgaggtacatagaaacttcatttcacttagtctgtttattggtaaaatggggataataagaactactttgcagagttgtaaaaattgaaggagatccagtaaatgagttacctagtgtagtacctgcctggtacataataggctgtcactgaatgacaactcttattatattccctaatacctactaagacattctatcaaatccttctaagctctgaccctcaaactccaaatcactcaggtctgtggacttagatcccaaactgagaaggagaaaatagaacatgactagctcaagtctaaccagaatctgaagctcaagagaggatctagtcccaggctcagagcccaagtaaacactggcattttgtccccagccttctttcaatactaggtctagtactccgaagcctttttattgtattttgaatagcagaaccattgtgacttcatttcttctatccattctcattgcagtaggttcagtgagttcagatcgaccaaatcaatatggctctacaaaacatactaccaaattcattccactgtgggtgttggtattgtccagatagggaaacctattattactaaagaaaaaaaattgttttaatggggttctaaaatggaagtttatctcttaaagaacatgaaaaatttgttgtgattaaaaagcacgctgcccttaggtttctagctagagttcatttctcttgatcagttttcagaaactactttgttataggtttttaaagcccaggtccatttaattttagccttcagctgaatattttcatcactagatttgtgtaagaagagtgatttatgccagtgtttctcaaactttagcatggataagaatcacctggaggtaatgcttactaacattaccaggtctccaagtgtattctaacatgaatattggttgatattcatttacattaatgaggaaggcaaatgtgaaataatggagttaaaacttaactcatccgtcaacaactagaacaacttttttgctgaattaggtaatagtttaatactgcatgactttgtcttcaattttttagttacacacaatacacgtttttgtttttctgttgttttttgttgagacagggtctcactgtgttacccaggctggagtgcagtggcacaatcttggctcactgcgctctctccctcccaggttcaagcaatcctcccacttcagcctcttgagtagctaagactacaggtgcatgccaccatgcttggctaatttttttatattttgtggagacagcattttgccatgttgcccaggttggtctcaaactcctggactcaagtgatctgcccaccttggcttcccaaagtgctgggattacaggcatgtgtcaccacacctgcccaccacacatttttaagtttaatctgcattattaacattttcttcaacactttactaagtctacaccagtgatcaacagactttataaagagccaaatagtaagaattctagattttgtgtgccagatggtctccattgcaactatttaattctgccatggtaatgtgaacgcagccatacattataaaatgaatgggtgtggctgtgttctaatataactgtttataaaaaactatttataggcctcagtttgctaacccgttgtctaaacaatcagcataataatatatcaagccctgccaccactagatctgaggacccattcctccttcctttttcttctcttcccccctcasaggtaaccactattctgaaattgttgtgtattattcccatttatacttttgtacttttacatattatcacagtaaaatagactgcactcagctgccttagttttgtttagaatgatgggaaagtgccctccttttgggggagggggaattccaagagctgccaaagtttatgcatactattaatgacaacaaataacaagttatctatatcagcaaagctataatacatgaataaggaattgaatttaaacagaatgaaaagacaagccacagactgagagaaaatatttgcaaatcatatatctgataaaggccttgtgcccaaaatctatgaagaactcttttaacttagtaataaaacaaacagattcatttcttttaaatgggcaaaatattttatcaaatagtttaccaaagaagatatatgtatgccatatgaacacttgaaaagctgctcaacatcattagttactggggaaatttaaattaaatctaaatgagatatcactacatacctattagaacatctacaatttaaaaagagtagccatacaaagcattggtgaggatgggaaggaactggaactctctcatatatgcttggtggaaatataaaatggtactgccacagtttggcagtttctcaagtaattaagcatatattaatacttaccatataacccactcctattttttctagagaaataaaaacatagatatatatataaatacttgtacatgaatattcataacagctttatttgtaatagtcccaaactgcagacaacccaaatatccatcaataggtaaattgataaataaattgtagtctattcattcaatggaatattattcagcaataaaaaggaattaactattgatacactaaacaacatggatgaatctcaaaataaatatgctgagtagaagaagccagaccaaaaaagaatatgattccatttatataaatttctaggaaatgcaaactaatgtattgttacagaaaacagataagtgatgatgatgatgggagacatatttttctatatgcctgatgatgggagacatatttttcttgcttgatgatgggagacatatttttctatagggtgtatacctgtaagagagtaattacaaagggccacaaggaaatttggagagatgatggatatgttcattatgttgattgtagtgatggtgtcacagacgtatacatatgtcaaaacttatcaaatgttacactttaagtaggtgtagtttgggccaggtgtggtggtacacgtctttaatcccagcactttgggaggccgaggtgggcggatcatttgaggccggagtttgagaccagtgtggccaacatggtgaaacgccatctgtactgaaactacaaaaatcagccgggtgtggtggtgcacctgtagtcccagatacacgggaggctgaggcaggagaatcacttgaacccaggaggcagaggttgcagtgagccaagactgtgccacagcactccactccagcctgggcaacagagtgagactctgtcccaaaaaataaaaataaaaaaggtacagtttgtatatcaattatttctcaataaagctatttaactatttaagaaaggaatattacattggttataatgaaatgtcttaatttttaactgaaaattgtttatattaatgatctttttttatgatgatcagtctaaatatttaattactggtaccttttttcatcttttaggatgtggagccacccaaaatttcaagcacaaaaaacatttccattaagcaagagcccaaaatatcatccagtcttccttctggtaataataatggcaaggtcctcacaactgaaaaggtaaagaaggaagctgaaaagagacctgctgataaagtaagattttattttaatcttgttaaaagaaagtaaattagttgttccataagcagaaagaaacartgttttatgcctatttcttttatataataatgggtataggtatataataatcaacactcagtgaatatatattgatagctatagattttgacttttcaaaaaatgagtaaaatttacarattttaaagttaagtggttaaaagttattgtcaataaatatttgagtcctagggagtatagtaactttgagtgtaaactttaatctatgcctcagagatcctagatggaacagttgttaagaagaaaagatagatacactttgggaggccgaggcaggtagactgcttgagctcaggagttcaagatcagcctgggcaacatgatgaaaccccatctctacaaaaaatacaaaaatcatctgggtgtggtggcatgcacctgtagtcccagctgtttgtgggcgggtggggggtgggaggattgcttgagcccaggaggcagagattgcagtgagcggtgatcgtgccactgcactccagcctgggtgacagagtgaggcgctgtctcaaaaaaaaaggaaagcaagaaagaaaagatgggaaagagtatagatgtaaatgactaaacataaactttatagagtggtatgcacctgaacagtgccaaagatgattcttggattgtctatttttagatgatttctacatatagtaattaagattttagtagttagaaaaaaatacatttgaaagatatcttcagtaacccttgccctcaagatggagtatattatcccgtatgttttcatacttttgctaaatagtggctattcataaactacattagattatttctctgtttttagatctacataagtgaagctgggtgtggtggctcatgcctgtaatcccagcactttgggaggtcaaggcaggaggatcacttgaggtcagcaggtcgggagttggccaccctggccaacatggcaaaaccccctctctactaaaaatacaaaaattagccaggtgtggtggcgcacacctgtagttccagcacctcaggaggctgagacgtgagaatcactctaacccagcaggcggaggttacagtgagcagagattgtgccactgcactccagcctgggcaacactgcaagactctgtcttaaaaaaaaaattatgtaaatgttatcatactgtgtgtgtgtatatcctttggtaactttttctccactcaactatgtgcttttgaaatgtatctttgttaatgcatgtagatctagatttcttttagctactacataataccagtttatcattcccctactgatttatcataggggaatgattaaccagtttatcattcccctactgatgcacaattagatatttctcctttgtttctattacaatggagtttgagtgagctactttatacatatgtcatgttaatagtttctataggatgtatacctataagtgaatataataggatatgacatcttcaacattactaggcattgccaaatttctatcaaaagtagatgtactaaatttacactgtcatcaacaaagtataagaattccaaattccatgtcttatcagactttttgatttttgccaaatctaatgggtatattgataatatttatatcttaaagaagggaatccgaatttgctttgaagcaaatatgtgttaagtctgtatggtagatactagtctaagtaaatccatcgatcttccataattctttagtagatagaagagtacaaagagaaatacaaatatttgttaaactgttctgatttatttatttctatcttgctggtttcatttaatatactaataaattcattgcaattcttctacagatctttaatgtgcacatctgtccctaactatgtgaatatatctgtaaaatggacttgttcattgccaattgtccttctcactcgtctttcagtgacttaaagtttattctaccacattactttatcattttctgatgcctgctttttatagatgaaatcagacatcactgaaggagttgatattccaaagaaacctagattggagaaaccagaaacacagtcatctcccattactgtccaaagtagcaaggatttacctatggctgacctttccagttttgaggagaccagtgctgatgattttgccatggagatgggattggcytgcgttgtttgtaggtaagttgtaccttgccacagattcttttgttactttataaagaacacatgaccctttccactcctcaacccccaaaatcagaaaaattgttgtgcattttctattttgtttttactatttggaactggggtggagataagtaggtaactgcccatataacaatttagcatattgaaaattgtcaactattttgtctttcccaactatggcttttaaatctgttatgttgtaacattttctgcatttttgggttccagagggaaagtgattattatattatgatatatatgcctttgataatctaaggctatggtgattgctttttgtgctgttgaaatttatacttttttatacacacatggcttcattctattaatctgatcagacatttattgagcaccctatgtgtgcacagtaatgtgctaaggactgtggataattaggtccagtactcacctttaggtgactcatattaatgaagaacaacaacaacatacagctaactaatataagggaatttaatggagatacaaaatgttatgaggctgttggaagactaatcagagtctactaccttctgagagaaaggcaaaaattatgacgagaaatgacgagaaaatagccaaatttaattaaggcattctatatatttattaatggttgaccataagctttaaaagcttatgcttttgtgcatgccaagtgttggggtttgttatttgctctttgggtttctgggattttttttctttttaatataccaaactttaccagaacaacctggaaataactttttttttttttttttttttttgagacagagtcttactctgtcaccaaggctggagtgcagtggcatgatcttggctcactgcagcgtccatctcctgggttcaagcgattctcctgcctcagcctcctgagtagtggggattataggtgtgtaccaccatgcccagctgatttttgtatttttagtagagacagggtttcaccgtgtcagccaggctggtcttgaactcctgacttcaaatgatccgcctgccttggcctcccaaagtgctgggattacaggcatgagccagcacacctggcccctgaaataactttaaattatggcatttaaaaaagtagtgtaatgtttaatggtatgttttcttaggcaaatgatggtggcatctggcaatcaattagtagaatgtcaggagtgccataatctctaccaccgagattgtcataaaccscaggtgacagacaaggaagcgaatgaccctcgcctggtgtggtattgtgcccgatgtaccagacaaatgaaaagaatggtaggaatcatatttttctttattttaaacagtctgtcaatgtttttgttggtatgtgctttcaaaacaaagatttgaatatttaagatattgaaaaaataaataatataagctgattatttatttatatgtatagyatgtacatgtgattaatatttctattgctaaagaccagaccatgttatgtgcatttttctctttttagttttatctaattctaatatagataaaacaagattggtgacacacaaattatgaatattccttactagtctgtcaatgtattgacaaacattttaaaataccatgcagcactgagaagtggtgagatacaaagccccactctttgttgagatctggtaaggaaatatagaaaatttctgagtgagcttaaaccaccgcatggataagatgtgtacagaggcgatatttatatgtgcatatctgtctttccagctgcatttctctgttgcttagtctttccttctcattgtcctcaagtgaccattacctcattcttcctatgtactttctctttttactgttgactaacatacctgcctttaatatcatagtgaaatatcttttcatttgttatattggatagttttctaacttttattcacttataaaatagataaatgataaatgaatttcataatttttcttttaaagaaaacaagaaattgccataatgtcttattctccacctctccctcccacttccatctctcttcccctgccttaaattagtgattctcaattgcagagttctcatgtctgttaatcaaatgaatttctatataaatttgtctaaccaatatatcttttaaaggtcagaagtacttagttaaaagtaaaaactcgggatacccattttactttttaatcagttaaatcagaaataggaagtgtttttatttattcctatgaaataaaaagtagtaaatgaaaagtgtgtatatcaatagtgtgtatatttcttacttgtaacaggaaatttctatgacaagttacaatctgttctgctcagtttggtttttatttaatttattatttaaactagccctccaggatctcaagtgaaattattacagatgagcaatgcattccagagcattgataagaaaccactaagaattggaaattgtcaaaagaaacaaattgtgacaataatctatctttctttagtatgtactcaactgtttcattattattatcactttagctcctttaatatctaaagtaagcactgttcttcccccaagttttttctcctccattttttctgatttatgtcaaatctatgtttatggttctaaccctcttcctgggtgagcttctatagctaactagatagtctatagatactttaaggtcaatatatttaaaagtgaaagttgttctattatccagttttttttttctgcaattgcctgaattagaaaacatctttgatgcctcttttaattccatatcccattgtttaccagatttgctaattctacctcttatatgtctctgaaatctattcatttctcttttattaccctgttccacaaatccattacttgtctattgcaatagccacttaataaatctccttgcctcctatcaatccactttgcttactatcattagaattcttctaaaatatttacctacttatatatgcccagtggctctcaattacttatataatgagattatactcattaggatgcatatatggaccttctctttttgacccgactctaccttacagccctctctctcactgcttcagcatacacattcatacactctggccactctgacacagactaagtgtgtcattccctgaatatgtggagaactttcatgttcccatatkttctgcttctcagcttcttctcttcatctgggatactgtttattcttttatctgctttgcaaataatatctaatttatcagtaagagcatgtattcattggcatagcacttaagcagagctcaagactggacacattctacattctgttgttcttaagttaaataaaatgaagcaaatgtaatttttttctttttctgagacagggtctcactctgttttctaggctggagtgcagtagcatgaccatggctcactgcagccttgacctcccaggctcaagcaatcctcccacctcagcctcccaagtagctgggactacaggcatgtgccaccaggcctagctaattttttttttattttttgtagagatggagtcttgctacattgccagggctggtctcgaactcctgacctcaagtgatcctcctgcctcggcctcccaaagtgctgggattataggcatgagccaccatgccaggctaaatgcagattagtaccagaaatcaacagtgaatctggtctgtgtgtccagaagtcaaagtactaaatggggagtcatggctaatattataacatgactagaatacaccaagagcaaatgtggggaaataccaaaagacatgatctgaagtgagcctaaagatcagaatccaggaaatgtaaggtttaatgagataattttggaacagtggggattctaaatacagtcattctaactataattgctttgagtgagattctcatatgtgcattggttattgttccaaggtatctcaaagatattataaataggacctgatatcccctttctcctcaaacagattcctcaaactggggcaagttctgcggtacacatcattgtaggaagacctagttaagaatgttgtgatcgtgtatggcagggtccaaggttattcttcagttctatagttttctctctacgcagtagtggagtttttccccagcttcaggtgagagactcatatcacttattgcagtggttctcaatctaaggtagtaacacactcctattttgcagcatttagaaataggtggggtttttagtactgccattctggcagttagtgccttagtggagaattttatacattttgcaatgtttgaagcagtcatccaatgaaaattttagtacctttgttgaacaaaactgaatcagtaattatatcctagttccctaaactagtattaccagtaaaggacaaagggttgtgggtatttcttactcagtttctaagatggctggataaaacagggaaggcagaagattgaaacatgatctcacaggcagaagtacttcctggggcttcatcataattagtctttatctgttaaaacatacaagttaggtgggtcctcagagtctaacctcaggagtgctagatgtgggtggaaggcagtgttaagattgaaagccatggttttggagccatatgtttctgttttactgtgagggatgcattctcgtaacatggttttgcaatgaaggataagatggctctgctttcctgctagtaccagtaatcaagtaatcaacagtgaattacttcgaacattcttaatattcttgatctaattgttgctttataagtgatgttgaaggtaggtgtactttgatgtggaaggtatgtagtataaaaagtgatacgaattgagatttaaggacccaaactatatagtatggcaaacagtagcccaagattacacaagaaggcccaaacaagagcaaaataggccaaattctggcttccagaaatggtgacaaattgttaataaattccctggtatagtactgtatgggcttatgaagattatcaaagactatggaatggctggcgggaagcatctttccccgttcagtatgcatggatttttctggattcagtttgattatcctttgtaaataataatgatgaataaacagtaactttttgttagcactcaacattttccagacactatgctaaactcttacataatcataattcatcctcataacccacctttgaaacaaatgctattaccattttacagatgaagagaatgaggcttttagagattcacatattttgcctgaggtaatgtatctagaaaaatagttgctgtttttttttctgttgttgtttttttgagatggagttttgctcttgttgcccaggctggagggcagtggtgcgatctcggctcactgcaacctccacctaatgggttcaagcaattctcctgcctcaacctcctgagtagctggaattacaggcacccgccaccatgcccagctaatttctgtatttttagtagagacggggtttcaccatgtgggccaggctgttctggctgttcgcaaactcctgacctcaagtgaaccacccgcctcagcctcccaaagtgctgggattacaggcgtgagccactgcacccagccagttgctgggttttaatcctaactgtgtttgactctgaaaattactcttaaacatggcacataaccatttataaacagttataattatctacctagaaaacactaaaaaataaactcaaaaatgattagagtttataggaaaatttagtcaagtacctagttataaaataaaggaaaaaatcagttattggtcaaaataaaactgaagatgcttataaaataatagtgggtgaaaattctttcataacatagaaatttgtatttattaactttctctaaagatttagtgtgcctagttttgcaatgtggaaaaacctcaaaaagtttaatcatttatcaatagtttttttctccctgttctatatttaaaaccatataaatgatctgagctgtgttttaatttgccctcagcaactgaggagtcgacttatgcctagaccccaagaagaaaactcttgtgtatttgacaaaccccaatgagaaataaatgtacttcatcatgagtaaagctaacggttacatatagtttgtgattttgctctttaaaaaacaattttatcttgttaaaatggtatttaactaaccctcttctgtattatttctaaagcttaatattatctttactgtttagaaactaatacaatctgtaagaccattaatatgataataatttgtcaaagagcatatatattcattatcatcacactattttttaaaatgttcaactgtatttcatttcagtgatgagtcctgtgagggaytattatctttctgtatattcagttaagattttgtatctgatttaatccactgatttttgcaggctcaaaaaactcagaaaccaccgcagaaaccagcccctgcagttgtttctgtaactccagctgtcaaagatccattggttaagaaaccagaaactaaactgaaacaagagacaacttttctagcgtttaagagaacagaagtcaaggtatagtagattctatttttatctaagattatatcttaaagtttagttgactaaaaaatagttgcttgatwaaaaatttaatgagaaactttatatactaaatggctatattttagaaattaagactttactactattatattaggtagaaagggaacatttatatcattaattaatctctaactctgttgtttttctttttatcacaaatacgaacagtctatgatcattccaaaatgacattctttaccattctcatctggttagatatttgtcttcaatcagaaatctggtttaaattcaggcgaggtgccatgactcacacctatagtcccagcactttgggaggccaaggcgggtggattacctgaggtcaggagtttgagaccagcctggccaacatgatgaaaccccatctctactaaaaatacaaaaattagccaggggtggtgatgggcacctgtaattcccaggcatagtggcggtgcctgtgatcagctacttgggaggctgaggcaggagaatcgcttgaaccccagaggcgaagtttgcagtgagctgagatagcaccattgcactccagcctgggtgacaagagcgaaactgcaactcaaaaaaagaaaaagaaatctggtttaaattcaaaatacctctgccctcagtagcaacaattttgctccccacactacttgagcagattggccttgtaatttttttttctcccttcttattggctgttgaaggagttttcttgctttgtcttgttttgtttctttataataaactttcaatgttatctacctcttataccaagggaccacattgtctagtgagggtatcacctttctcattcctaagtttgcatccttgaaatcatactacattatttcttaatatcttggcctttttatatcatggaaaaaaataattttctaatctaatttcataacaaaaagaatacttttactgaggtacacattccaatattaagcatagcactaaatatggaagaaaaaatattaaaaaaaaaatagcctcaaattctcaaagattgacctgagaaaactctaaagttattgccttatctaagtgactgtaagtagtaagcttcatacccttgatgtgatgaaaaagaatatgaatacgaaatacttttaaaaacttattgataattatatttggagattatttttcattttaatttgccagggaagatttgctatccaaggcatatccattattgatttgtcatataggaacttggtgaattggaatagaagtaagaataaccagtttattgaaagtaattagagttgctatattctgcatataatcactttttagtagatttttagattaatctgttactactaaagtttatttttagaaaattcaacatgaaatcattttatggcaaacaaattaaagactgctgtcatatttgttttgattaagaggttttgtgtttctttaataaaaaattcactttttataaaagtgaataaatttatactataaaaaaattgttcccattcacatataaaaagcaaatgtcttttctaacttgcccatctagcaaataggcaagaaaatatttatagttaaaaacttgagaaatttgttttctacactgaaatagtaagaaatcacttggtctccattgtttgtgttatattacttctatgtgtcctgatagtattataaaccatctgtcatcctgttgaaaagcaatactaagcaacagcaagccattaaaatgaaatgccagacacatagaacatgctttcttgcttgtacttcctaagtgttggtcttttaattactaaaggtgggttttcttttgtgaagttttttgaaagatcatttaaccatatggcagacagttttatgtttaatagcaagaaaaggaaaaaaaawtaggtctttcataactgaaaattaaaggtttacttcttgactaactttttctctcattgctggtatatattcctctaggaataaatggtttatgtagtttttcttctctggataacttcataagatagttaatatgttactgtaagaaaacttcctatcaattttcagagtatgtggacaaatatctggattccttctcttataaatcgaatatctcagaactctatttttgttacttttcacattgattaaaaatgtatgcatgcagacaatattgaaggctaccttgatttcaagagctaaaaatgttttatcaactatttcagagtaaagttctaaattataactggatatattttaggtataataactaccattttttaagtaggatgttattttgtaaaattttatcttttacctatatgtgaatgtaatgcttttgtgaatcttcttaagagtataaaggtagaaaaggtgtcaataagaagttcaattcaaaattaatttgaatacgtacatttgtgcctaatatgaaagtgaaaaaatatattcttgtgtgaacaagagcaatatgtatttatatagtggcattggtaccattgtgagcttctgattagccaggaaagttaatcagagaagttgaagtgttatacccttatgaaatatatcagagaatgagatcagtcctacccaaaatgtcactgtgcagcctaatgaggcaattgataaaatccttattaaaggagcaggagactcttacatgatagtttaaccggaatcatgggcaaattgtgaaactaaaatcatgagaactttttaacacatcataaaaattgtacacttccaagtaattaactttgcatatattttgtactcctgtaactgttgctcaaaatttaggaggacatttttttttaatgggtttagaatctatacagctgtcttctttctctcacacagtcactcagtaaataaatattgactgaatctcttcatcttggatatgttctcctgaatattctgggtatgggcatttttgctattaagagtgaattaaatttttgaaatgatccctagttatttggagaaaagtctaaaagaattagatgtttaactaaggtcgataatactttgttgggtaaaaastatgttaaagcactaaatctggttttcagatatagcttagaattgaatctaaaagcaattcccaaaaaggaatttcatatattttcttttggaatcattagaacaagaatatggtatcaaaaattttctgctttgcaaatgataatacccactagatacagataagttttgttctgtgtggtttttcagatcagcttcataagaacctaatttggtggtgtgatttaaatttcccaattcataacttgggatgtttatacaggtactgattaaacttggctctaatgtaattatttactttatttttttagacatccacagttatttcaggaaattcttctagtgccagcgtttcctcgtcagtaactagtggcttaactggatgggcagcttttgcagccaaaacttcctctgctggtccytcaacagcaaaattgagttcaacaacacaaaacaatactgggaaacctgctrcttcgtcagctaaccagaaacctgtgggtttgactggtctggcaacatcatccaaaggtggaataggttccaaaataggttccaataacagcactacgcccactgtacctttaaaaccaccyccacctctaaccttgggtaaaactggccttagtcgctcagttagttgtgacaatgtcagcaaagtaggtcttcctagtccaagtagtttagttccaggaagcagcagccaactaagtgggaatggaaatagtggaacatcaggacctagtggaagtactaccagcaaaactacttcagaatccagcagctctccctcagcatcccttaaaggcccaacttcacaagaatcacagctcaatgctatgaagcgattrcagatggtcaagaagaaagctgcccaaaagaaactcaagaagtaatgtggccaagtaggtttttgtatcatattagcctaaagatgaaaggcttattattatgatataatctgtaatacactgtaatttaataaaagtcttcataatcaaatttctattgtttcttaccttaaaatgctaartattatataacaaaacttggaaactttcattttaaatcaatcttcaacatttttattctaatgatttccatagtgtgtgaaaacaatgattagaatgactggttctcaatgagatcttcagaagattgaaagcatctgtgaatttaaggaaaaagaaatagttcatcttctagcaaagccccaagagttgatcctgatgaatgaggtgccttatgtggcggcagggacgacccaacatagttttctattttcctccccgtattctgggtgttcattttctgtgctagccccatttcaactgactctccctctccctcccaattatttcatctttttcaaaattattttttcattattgatttctcatatcaatggattttcctaattgatttatcatacttcatattatatctttaccttttttatcacctcatttcaattatttaagggtatatctttttccaataaattgtgaactctcctggtgcttaatacaatattttttctcacattgctcacttttcctacattgccaatgtaatacatgcacatagtacgtaataaatgttgaattttgattcatcttggttatgcacattcctgataagttttgaagaaaaataccatttcacaaaggtctttgcagatggaaatatatgacttgttcacacactgatggcttcttcctataccatgaaagaaaaggctatcttacttagtgctcaaaatgttatagcactttacctaattttagctaactttgtatacaataagctcctatataatgattaattcttgagattgttttgtacattgttaacccatttatgccagaggttgcaaatttttttggtgaaaaatcagacctgatgatgaccttgaacagtaggatataaataactctataagccgagcattgcaataatggaacactaggcataagtgggttaagtcagaaaatgtggaaggtctgcgttgttgtcttacttgcaagctaacaaattaaccagcaattgttgtacatgtatattctgagagaagataggaagccctctgcatcagagaaacagtttattattcacagcaaaaaaactggatatccaacaaattcacacattcacaagactatgaacagcctgttccatcaaacttgatttgtgctactaaatcttcactctacaaatctctaatctcaaactgtcttccttaatccctaggtttttctaacatcattattctaaagtatattgataggtgatctctgtaaacacaaagcttttaaaattaagcttggtctttttttttttaaggaaagattattattttaaactgctctgttaaataatggtgctaaattatttgtagtaaattagaatccaggattgagataatccattatctcaattatgatctcaataggcagtaaatgtctgtttaccctatatgtaaataatgaattatctcaatcctacagagacttttgctttgagaaacagatttattttgataaaacatcaatttgacataaaccccaatttccctttggggtcaaagaaaccaaaaaatacatatccataattgtttatagttcaaaaccagtttggactaaacaaaattacctgacataaaaactcagctccgcaactataacagttaatgtaacctccatacctacaaaaaatgaaagcagtaatgtttattacagttcacacattggcacttgaaatgaaaacatttatcccatcatggaaaatacgtgctacatagagttgagaagagaagcaattattttaatttctgttgtacctcagaggggactttagtttaggaggtaatttatctttcactgagtatggctctttgtatagataatgtgtgcacacgtatatttaggttatgtacatatgtataagtacacatataccgtatttagctcagtttggtattttatagaggtatatttggtattagagtttaaattgtctcaaggagcttttagaccttgatttttttcatgtcataaaatgagctacaagaccctttaactgagcagtaatgaaagtagccagttttatataaatagcatttattattttatgatcattttatttagtttgttatgtgcagatgttttccccactagaatttaagtggtatgaatggagggatcttgtttgtcttgcacagcattgtattcccactaactctcaataaatacttactggttcaatgaatgaatggacagataagcaagtgtgctaacaagtaagcttttaggattgtacattttaatcccattagtagatatgtggtgactatcatttttctattttgcatatgctttatgtaagattatataactacagattttagtgacttaaggaaaagaaaagggaaaacactaaaagaaaggccttaaagtcagaagacctggttttaaattccagtccctccatgtgaggtcctcaatttcctcctttataaaacacagatgaaaatgagatgtccttcaagtctacagtggatctgaagggagggctattattttctgtgagacgaagaagaatgtaactgacatggccatgaatccgcacaaaacagaatgcactgtgtttacatggggacattgcacagtcacaaagagaaattacactaaaaggcttcagagaggtaattataaagttttggtggcaaccaatgtggctcctcgtggtttggacattcctgtagttgacctggtgattcaaagttctcctcctcaggatattgagtcctatatccatctctctggatgcgtgggtaaagctggacagacaggggtttgtatatgtttttatcaaccaagagaaaggtcaactaagacatgtggaacaaaaaacacaaattacttttaaatgtgtaggtgttccttctacaatggatttagttaaatttaaaagcatggatgccataaggtctctggcttccatttcttatgctgctgttgatttttttccaaccatcagctcagatactgatagaagagaaaggggcgatagatgcattggctgcagctttagcccacatttctggtgtatcaagctttgaaccatgatctttaatcaactctgataaggggtttgtgaccatgactctggaaagcctagaggaaatacaggatgtcagctgtgcttggaaagaacttagaaagctgaatagtaatgcagtgtctcagattaccagagtgtgcctcctgaaaggaaatatgggtgtttgctttgatattcctccaattgagtcaaaggttacaggcaaagtggcatgattccggctggatactctcagtgccagctaaattacctgaaattaaagaatattatgatggaaacatcttttaattccagacagaggagtggctggtcaggccagtcaggttgtcgatctggcaattggtcaggtagagagagtcgacaaagcagttgctcaggaaagtcggcaagatggtagaagacgaagtggaacagaaatagatcaagaagtgggggccacaaatggagttttgactgagtatttgatagttaatttagcagtgtgagcttgcctatttctacctaatcttacattatggatcaaaaattaggtcatcattgttgaggtatgtgtctactatttgcaaagaagttgatcgtatttttttaaaaaagtatttcacaagaatgattgtaaacaaatctacttatccagttatacctttgaataaaaaaacctccttttattgtctctttaaaaaaaaaaaaaaacaacaagaaaagaaagaaaaaagccctggctgaaggggaagtctatttagatggttggaagccttagaattttatttttggtttacactacctaggtttaagtccaggcccaccacttaatagcaatgtgatttggattaaattacttcacctttttgggccatggtttcttcataatgttttgaatattaaacaagttactacatataaagcacttagaacaatgtctggcatatagtgtgcattcagtaatgttacatgttaatatcaagttattcagttttagttcaaaacatataaacgaaacattaacaaaatatattatcaaagacttctagttggtggtatattcttcttatgtatatttggtgtatactctgatttatacatataggtgtataattcatattatccacatacgtgtataaagctacataatatatatggtttatatgtatgtatataaacatgtatgcatttgcaagagagcaatatgaaaaacaaaaacatttaaggcaaaatacatcatacagtaaaaaaaaaagtaaattgaaaaacctttggatccaacctttcttgatgataaaagaatataattactccttcaaaagatcttcacttttaaatagttgatagttgaagcttgggtcatttgctttgctatttctgttggcttagtatttctttcaacatgtatcctttataatacattcatgcaataatcctgttaggaagtacagtattcctgaaaacccagtacagtatcagtttctgtagttcagaggtttcttgctttctggtccaaagttttgtaatgtcagttttatgaggtagtcaatcaacaacttgctggaaaataaaagttgaaggcttattttcttaagcataagtcatctttccaaggtagttagctggcacgtatcctttctgcccttgagcttcagctaaccaccactctttattgccacttaggtcacaaaacctgagtatatgaactctctggtattcctgaaggctgagttcatggtcactccgtgcttgaaaagcatgaactgcatagaaaatctagacaaagaaacaaaagacattattggaattggaacctgaatattaagagaaacatcataaaagtttccaagcttttagaagcaatgctaaagtttttttgttttgccaaagtcacattgtccaactccttctattggatgtattttgctaaaatataacccaggtgagaatggagtgaaataggtattcctattattctgttaggaggaatataaattgtccatgcttgaaggcaacttggcagtttctattaaaagatttttaataatgttaaaatgttaattccttgtgaatcaaaatagcttgaagaatctcttctacagaaacatcggcagaaatttttgcataacaatgttactggattacccataagaatggcgaaaagtgggagagtagtaggaataacactataagtttagcaagagaaaaatagttaaattccagaccctcatactaaggagatttgtagtcattaaaaacggtgcaggccgggcgcggtggctcacgcctgtaatcccagcactttgggaggccgaggtgggtggatcacgaggtcagtagtacaagaccagcatgaccaacgtggtgaaaccccgtctctactaaaaaatacaaaaattagctgggcgtggtggcgtgtgcctgtaatcccagctactcaggaggctgaggcaggagaatagcttgaacccgggaggcggtggttgcagtgagccgagatcgcgccactgcactccagcctgggcgacggagtgagactctgtctccaaaaaaaaaaagaaaaaacacaaaacaacaacaaaaacgatgctttctgagactaataacatgggaaacacttatgataaaatagtaaaccttaaaaagaacataaaattagatgtacgatataagtctaatattattgtttctttgaatggtacaattatagctgattttcatttttacttccttgttcccttctttatttcccaaacctttataatgacaatgtattaaatttataatttaaaaattattttatggcctagaataatacaatatttcagtcaaaagaatttttctctgacctcaaaagaacaatttataattattaagtgcgtaagaagccccaaaataagtctttattcttccaacaaaatcataagattgataataaaaatgtttagttatggcataaaattaagcaactggcttagtttattcccattcatttatttaagcaatatttattcccattcatttatttaatgaaaatttttcaagtacctactaagtgctggttattattttattggacaa

SEQ ID NO: 10667 - DNA, 24260 bp, Homo sapiens
ccgatatgtgtcacatcactgcctcccctgtgctgacgacaggtcaaaaggctctcatttcaaggaggttaaaggcccccattcctagaccggggctgcagctctccactctcttcttggtggggactggtgagtgagagtctctctcccttcctttttccagccccacgcccctgacacacctctgtgatatccacctccagaccctgggaaatgtagggtgaggtgggggatagagctttgggagctgctcctgctggtcatgccagcagctcttctgaaccctgcttcccgctgctgtctggaactgtgatccaggtggctgatagttgctctgggcctcaccttcttggcagccctgggtttcagtaactgggagatgggctgggtgagctgcagccttcaactaacttcccactttccttttaaggtggcaggtggggagaggaggaagcgggcacatctctctccaacgaccccatctcttctgcaatacatgtaggttctgaagtgggaatgcgcgggttcaaatctccattccactattttcattagtgtattctttgacaagattctctttccaagtctcactttctccatttgcaaaatgaacatagtaagaatatcttccttatgatgttggtatttagatttcacgagaccttccatgttatagacagcacagtgcatggtccatggaaatcacctggtgaagttcactattatgataatgattgttactcctatctgtgtccttagactgaatggaatctaaagaggctgtttcatttgtcctgtttcctccaggtcagtggtctccaaacttgctgcacattaaaaccaccttttaaaaattctaaagtccagaccatagccccagaccaattaaactctactccttaggtgtgggcccaggcaccagcgattttgaagctttctaggtgattccagtgtgagccagtttagaaaccgctgctctctgcagtctaaccagctgaggagtttcttttaggggtagtgattcgtcctaggaacattatttacccactaatattgatctgagttgaaacacttcctttgagacaagcaaaatctctcgtgcttcactttaagtcatttttttttcttctgaggaagtagagcatagctatcaccctccaccaaaagctcagttagtgggtgtgtccctcctcccctcccaagcccttcaagggatgacaacagcccagcaggggccatcagctgacgggaggtagatgacaatgttggcattgaatgctgaaagctgatcatagacagagatcaaagaagcttcctaaactctgctgtccgggacttccttttttatgttatcacaatggaatattttcacattcagcatgacagtatatagaaacctgggcgagtgctgaacaaattccactcaaagacattgctggagccctctgtgaccgaagccaaactcaggcctcagggtttcccagttgctccctcgaggcaagggggcctcttcatggctcccccatcccaccccctcacatgcccgttccttcctctaggccttggcacgagcagtttctctggtccttcccagtcccagtccctacaacagagcaccctctcactggcctacagtacatccttcgaggttagcttgagcttgcctttgcttctgtgaagccttttccagctgcctgtctttctaaaaactctcatcgcattcataggtctcaatgctgtagccacagccacacaataacacctctcgtaagagcaagccttttaaaatatttgttgtcttcaagtgctctatttaagggtcagatgaatagcgttcagggaactcagtgattagttcaatcataaaactggtacatggggggagctgggctttaactccaggggcacttaattgtggggcccaagctcttggttctctaagctgtccacgtctctttactttagctcagtcatgaaggcctttgttattggcccactctgcccagcagttgcaggaagaaaggggctcctggtccatgaagtcttgtcccaacagcaaggagcttcctgtttgtttaggtggcagtagagacagatgcgaaggggttaattatgtgtattcttcatgaggaggaggtggggttgaaagtgagtggtgcagccggagagagaggtgggttcacagggaggggttggggaacagaacctcacttgtgtgactccttggggcttgcaaagtgctcttccatatttgttcatagccattcattactatcactctacaaagctgttattttatatatatatatattttgagacagagtctccctctgttgcccaggctggagcacagtggcgccatctcggctcactgcaacccctacctcccaggttcaagcgattctcctgcctcagcctccgaagtagctgggattatatatttttgtgtttttagtagagacgaggtttcactatgttggccaggctggtctcaaaactcctgacctcaggtgagccacccacctctgcctccaaaagtgctgggattacaggtgtgagccactgtgcccgcctggttactattttctttattttagaggtcaggaaactgaggttcaaggagtcaagtgtcccagccatggggctaggagggggcggagccaggagtcagagctgggtttcaagatgcccaactcaaggatctgttcgccacaccactgctgtttcctgtctggtacttactgtcccttctcctatcagcccccattttctcagccagacccctacttcttccccctgctctgttctttctgcctctcctctgatatctgactcagaatcctggtcttcaggcagctttctcacatgaacccacccctttccctagcttcacctctctttccttcctctgcttctactggttctctccttgtcactctgtgctggaggctaggccctggcttccctctcttaccttagggttaggagtatggctgtgtggaccataggtgcctaggactagggtgaccaactgttctgatttgcccaggtatatcttggtttaagtactgaaaatcctaggcaaagcaggacagctgtcatcccaccaggatctgtgagcagctatttctgcttgtttagtgattccagtgctctgcttttttctccccacatgacttatatatagctttgaatccttgagaaatagacactttggttccttaagtgtctgagaggctctaggttccttaagtgtctgaggctctagacacaaccagcaagcagcagagcttctgcctataaatttcaggctcattgtctcctctatcacacagtgtctcctggatgacccactgaacagataccatgtacggaatgcagaggttcatgagaagagggtgtggaagcttggaattgcccttggagcatttccctgtaccaggatgacttttcactgcggcgcccccacagtgctcttgtttctaccacctgttcttccccacctctattgggatttctgccacaactttctttttttttttgaggtggagtttcactcttgttgcccaggctagagtgcaatggtgcaatctcggctcaccacaacctctgcctcttgggttcaagtgattctactgcctcagcctcccaagtggctgggattacagatgtgccaccatgcccggctaattttttgtatttttagtagagatggcattctccatgttggtcaggctggtctcgaactcctaacctcaggtgatccgcctgccttggcttccaaaagtgctgggattaaaggcgtgagccaaaaatatttattgcaatgaacataaagaaaaaggacatttaaaacaccaggaaaattcagccgggcacagtagctcacgcctgtaatcccagcactttgggaggctgaggcaggtggatcacctgaggtcaggagttctagaccaggctggccaatatggtgaaaccctgtctttattaaaaatacaaaaaattagccaggcgtggtggtaggcacctgcaatcccagttactcaggaggctgagacaggagaatcgcttgaacccaggaggcagaggttgcagcgagccaagattgtgccactgcactccagccagggcaacagtgcaagactctgtctcaaaaaaataagcaaacaaacaaaagaacctaggaaaactcctcccacagtctctaaataaatcaactcactttctagttactcacaaagtctgtcttatctgcattttttttttttttttgagagagggtctcattctcttgcccaggctggagtgcagtggcacgataagggctcactgcagccttgacctcccaggctcaagtgatcctcctacctcagcccccctgacccgtgggagctgggactacaggagtgtgctaccacacctggttaattttttgtattttcagtagagatggggtttcgccatattggccaggctggttttgaactcctgggctcaagtgatctgcttgccttggcctcccacagtgctgggattacaggagtgagctattgcacccggccttctgcattcttaattcttatgagttcacagcgcagactccatcatgtagtctgccctttccctttaatatggtacatagtatcacaagtggttgccggttctgctgcagagtctccaacaagatgatttaaaataattgtatccaattgggcaagccatcgcttagccatttttctaaggctggagagtttttccccaagttaaaaaaattattattacattttggatgaaagccacagctatttgagtccagagggaaaacgcacatttttttgttggcggacactgatgctcactgaatgagcttttccccaggatgctgtctgggacgtgcttctcagagggtgagcacagattagtgctggtctaccgtgctttgctattgccttgtggtaagcacagaatttgagagtaaccatttagaaaattattattattgttgctatttttagcagttaaacaatgttttgtttgctgaatctaaaaataaaaaaaatttgggcttgcattttgtatatcttttttaaaaaattatctttaggaggtaattcctttaattctattttacaaaagtattgtctataaagaaccggaaatgataaaacagaaagagagatagttagggatggtttgtcttctggtctagaagacaatattaggtactggtagatgctcaacaaatctataaccacagacttttggtgctgaagtaccttgtgtggttttgtgtttgagaagtctgaggcttatcaagcagcacacaatgtgaatgaccttgggcagaatctgtgggcctccacttgtactcagtgaccacaatattgcacttccatgtgataaaattttgggtgctcatggtgatgataactgcagggagcagaagcagtgtgtggggagattggaacaaaacttttgccccaccaggacgatgctgtgacagaaagtgtttccacctctgtcccagctatggtcctgaggtctctaaacaccatctaactttgccccagatctcccaggcacatcccagaaacaaacaactcgatggtggagtttcttaggaagagatgaactgatgatttggggagaatctgtatagaagtttccagcaatgagatcctgagagattcttgcattctgatctctaaatggcaagagatgaatgataaatgatcgagttggggaagtttgtctgcaatctgatttctgcaactcacaggtgtgaggttttaaacagatgttgctggcaggcaaactaaacattaatactcccctttcaggattgtaaaggtgcccagcccagtaatgtgtgtgtgtgtgtatatatatagagccggagccagatcttttcaaaggagtcagagctcctttcctctctggtctctgcctccttcctgccaggctctttctcttgcctgcttctctggatgctccagcaaacatgagccaccaatttagttctcagtccgcgtttagttcaatgagcaggcgggtttatagtaccagctcttctgcaggctctggtggtgggagtccggcagtgggttctgtgtgttatgctcgagggaggtgtggtggtggtggatatgggatccatggaagggggtttggctctaggagcctctacaatctgggtggcagtagaagcatctccattaatctaatggggaggagcaccagtggtttctgccagggtgggggagtagggggatttggagggggcagaggctttggggttggcagcactggggctggtggctttggaggaggtggttttgggggtgctggatttgggactagcaattttgggcttgggggctttggtccttattgtcctcctgggggcatccaagaggtgaccattaaccagagcctcctagagccacttcacctggaggtggaccctgaaattcagaggatcaagacccaggagcgggagcagattatggttctcaacaacaagtttgcctccttcattgacaaggtgagcacctcaggggcagggagggtcattggtcactgaccaaatgactgagagagattacaccttaccacctctcaccacatcgtgctgtttcagcttgacctgggaccttagaaaatcatttacccatttgggcttcaatttgtcttcttgcagggatttaattctatcttttccttttggcaggaaaggagataagcagtgttaaaatactcaacagatacatggtgtagtaccctcattctcattcataattattcactttccatccacccatccacccatgcacccatccatccatccccatccacacaatccatttatacacacacacacacacacacacacacacacacacmtccatccattcacttattcatcaatccacccaactatccacccttccgtccatccatccatccacccacccatccacacaatccatttatacacacacacacacacatgcacacacacacacgtgttcatctgttcattcactcatccatcaatccattcaactatccactcatgcatccatccacccatctagcccacaaatattttctaagaatctatgataggccagacatcgtgccaggtgctacaggtgactaggacacaggtcctgccatcaaggagcccacgtctaaaggggagagaattactacagtgtatgtgaagtgtgtcaataggggtagtactctctgggccatggtagctcaaaggagggtgtcatgagctctgcttgctgagtctggaaggcggatgaaaagttaaatgggttctaattttagtatatgtgctgccgaagtgagcacgagttaaatgggttctcagggcagaggggattttcaggcagaaggaccaggaggcatgaaagcgtgacgcgtttagggaatttcaaacagttacaattcctggagaaaatgggataccaaggggtggaggagagaagtggagatgaagccacagagccagggcaggagaagcaggcagggcatggtgaatgccctggtggtgggtatctcttggggctaaagtcaatagcgtgcaatgtagggttctgtctgagtttccccttttggctcatcaagggccaaggatgggccagatggagacacagaagcccctgtccctagttccctgttgaaacttcagattaggtccaaagcagcagcagaggctggagaactcgccatggtgaagacctccctccagcatctccttttgtctggaggtcgaggcacagcggccactagcacctccccaggaggaactttgccttcagggatgcagtgggaagccccacagagcaccaaggccgcttgcacactcagtgactttccctcagtccccacaggagttcagtgctgaggccagagcttgacctgtggcctgactgcagggtagctgtggctagaggccatgctgggtggcagggcaggcctctgatatctgagcagatgctggggatgggacagtgtgtgagcgggcggaggagggtgagagtgctgaggcccagaggctgccgaagaggagcgcaacacagcagcgtgctcccgtggcttccgatcatgctgcgtgggaaatttggctgagtatcaccacgcttcaggcaaaggcaggggttagagggtttcactggagcaaggagtcactactcggaggtcacggctgggccaagagaggagcagggaggagaaagggctgggaaatgaccacaggccrctggcaactgacctcctgaggctcatctgattatggcccctgccatgaacagggtctgtccagttgcatggcatagggcagtgggcagaggctagggtgcaagagacctgggcctcctgtccttcgaagggcatggcctatgatgactatgaggagaggcttctcagccaggtgggctgtggcctggctggaaggaagaaggcttctatgacaggtgacttctgactctgctttccaaactggtcttcctgctttcacccttgaccctgtatagcctatwcttgacaccacagcagagccatcctttaaaagcatgtcacgacactcctccatttgaatcctccagtggcttcttgtctcgactgaaagaaaagcccaagtcctacaaggccctatattacttgcccttcaacccgcagctgctgctaagcccacacttgcatttgtggaatcaggccacgttgccctcactgggtggaacagctttcgggatacaatggctagtaagcagagtgaggcctggaaaacagcccccaggcttccaactcattgttgtctgcagcctcctgtgcccctctgcctcctctcctgctctcttcttgctcaccagcatccaaggctcagttctgtctcaaggtctttgcacctaccattccctctgcatggaactcttcccccgagagagaggcccaccttcctccctcaccttctgtgggtctttgctcagatgccacagtttcagtggggccttccctgaccaccacttcagtgttcctatgccccggccctgtgtgactccatagtccctgcagccatctgaggcactgtattttttacatgattatttctttatagtaatctctctaaatagaatgcaaactcctggaaagcagggattttgcctgttttttttattaccaaatccctagcacccagaatagtgcctgacatatgagaattgctcaataaatagaaaccggatgacaaattgggtcagcccctcaggggtcagtgctggacgctcagagagtggaaatggagccaaaggctttctagaaccaatgacaaggggacagggcctcagaaaggaaaggagggtttcagctcttacccctgggacactggcctggccttgatcagctgacccttggacctctatgctaagagtggtgagtggcctggatagcccacaccagcaggcagttctaaaaccttttgcacttcatgagtgcatgacactttttgtcttctccgtgttgggcattgtgtgtccatgggtccactgtgtcccctggagaacaaagtagacataggcctgccctcatggggtccagtgcagcccgggagagagatgctcacacactgtcacatgactgcaagtctcaacagatctagaaaggcaaggaacaaggggctgcaaaggggacacactggtgggatgccacctcagctgaggtctaaaggatgagcaggagtttgctgggcaaagagttgaggagacctggggtgctgagggcactgggaggtccctgtgcaggggaggagcactgaagcagagggtgggcgagaaggttgctcagcagcatgcctcattccatcggtgctagctgagctgcccttgagttttgctggtgggacacagaccaggagtgttttggggaacctggggaaaaacacagtggcttttactgattgttctagtggttaaggcactccctgcatccagactctgcctttgcagtttgggtggcctgatgagaaccacagtgtcttctatgagctcctggatattgcggatgggtacctgggctaaagccagagcacccagagttgtgtcactgctccctcattgttttatgtggagactctccatgggaccacaggattctttcttttggtccccacaatgccactgccactgagtgcagtgaatgagtcctgaattgatttcttcactccctgggagtgccaccacagagtaaaaatagagagtggcaggaatttctcacggtgttgtgagctgtgctgacaagcctgggagagctgcttgcctaatctcttgctttgataaggtgagcaaaaatgagccatgggaggttgtgttgtctgcaaacattttccagcctagagtcagaatccaaagggagctaaccagggttggcccctcagaggggcggagtctcaagggccgggggatttggaggaccctcactagtgtcacgtggtaggggagtgtcttcagggttccgttctgaccacacaaagcagtgggtttgcccctttacatggtgcccagaggaggaagcaggattctggagggtgtgtgtttttgggcgtgtgcgcctgcatgcggccgagcaaagtctggaggcagcatcactgctgctatcagggcactggagcagaggctccacagtgtctacctggctgaggaaaggtggaggctggtcattaccatgccaaggacaagccgcacactttgcacagccagccgcctccctgggccccgcatcttacctccatatccacagttttgggagaagaggtggtgaaaatattgggtgatgtccactctccatttcccgggaaatagcaagtgggtagttctcaaacacctgacaacccaaagtcctcactttggggcacttgaatgcattagacttttaaaaaatgaggacatttgccttaaaaattctgtctgcattataaaagcatttaaatgagttactttcctgacaaacatcccggcagacagcagaggtggtggtggctgcagggcaggggcacccaagcaagtgtgctcaggaattagtttaatgttctaagccaaattgatccttctctctttttctttcttcctctcctctatcacataatgcattttgaccacaaagagaaaggaaccttggggtcatcagtgtctcagatgctccgaaacaccatttccttacgttggcatggataaattgagtgtggagggtgagtgctctatgatgtaaatgaaggaggtgatttaccttcaaaaccagagtgagcttagtgtcaattttaggcaagttgaccttacagccattggcagtcagaaaccacattgccctctgtgtgtctcaatcccgagaaaaggaagctctctgacccttggaggagccatcctgattctctgaggtctggatgtgttgagggggtatggatgctcctrcttatggggragctgctctgatccatggcctggggtggactggggtctcttgctcttaggtgcrattcctggagcagcagaaccaggtgctacaaacaaaatgggagttgctgcagcaggtgaacacctcaactggaaccaacaacctggagcccctcttggagaactacatckgtgacctgcggaggcaggtggatttgctcagtgcggagcagatgcgccagaacgcggaggtcaggagcatgcaggatgtcgtggaggactacaagagcaagtgagactccaggcagggcaaaacaggggagaagcatggccggaaactggtcacaggggcaagacattcggcttcagtgtttgtgtgtaagggtggggggcggggcatgcaggctctgcactgcacaactgcaggaggcrctgttttgtatgtggcaacccgggtagaatgatattggcagccagctgtcaattgcattgggtggggaggggcaggatagcttcatggatgttgaaaccaagtaagcctgatttccagtgtggcctctgccacttactagctgcttacaaattcatctttttaagtttctagtgttcacattagtaatgtgggaatagcaagaaccttccttgttggattgttgtgggtagatctgtggttctcagacttgagcatgcatctgtttgctggaatcagattgctgggctctgccccctgagtttttgattcagcagatatgggatgcagcaagagtgtttgtacttctaacatgtttccaagtgatgctgatgcttgtggattggggaccacactttgagaactgctggtttgaatgaaatgatgcttaataagttcttagtattgtggctgtacacccctagcagtcaataaacccttgttattatgactataaacagtaggggtgacgggagttgtcgaattccagatcagctgctcctgagccgtgcaggcagcagagcctctccctccctcttcttccccatgtggggtgcagggtgcttctctcccatcaccttggcatgcttactgtgtcgtgccagtagagatccaagtgtgtgtgaatcaacgagggaaaagtgaaatccacactggaggtgctggtggggggtggggtacagaaatgtagattaaattttttctcttcaaaaatatttagtaaaagtggttgttatttcatgttctcagttttaaggaatgaatgagtttgacacatttacaaaggtaaaacatcaaaataaaaatagacattccagggaccttctctgtggctctgggttttccatgttggcccggggtcccctctgttggcccacagacctaggagttggctctgccctcatccatgagagtgccagcctctgggaatggacagccagcaccttgagcagggttctctgaacccaggacagcaaatgtttggggaattccaagctttctgctgtaaggagggacctcagggagccaaggtcagcctgcagcctttctgtgcycctttgcctcgcctgacaggtatgaggatgaaatcaacaagagractggcagcgagaatgactttgtcgtcctgaagaaggtgagggaaaggggagtcctgagggtggctgtggacccaggaggctgaggggagtgaggaatccctatgggatgctctgtgacaayggcagggtggcctctacggccggcttgctgtgtatgatgcctgaatgcggggcccttacattggaactgacactgataatgactcttcaggaagccttgagttcgtatctctctggggtcctgaaagtgaaatgaagtgaaatgacagcttttgagtgtcagttacctgtagccttgggacctaaggaaggacctggggtgttggttgtgactgactgggatgtggaggttggtgtcacatctccttctggctaggaaagccaggacttgtgggtcccttattcgagtgcggtgatgaattttttaagtaaggaaataaacctasagtggctctgccactcgcctgagccagccagtgagctggtggcaggcaatgcctgggcaataaagtcaaactgtttctgcctgctattcaggatgtggatgctgcttatgtgagcaaagtggacctggagtccagggtggacactctgactggggaggtcaatttcttgaaatatttrtttttgacggtgagttaagcctttataagaacctcctttcttttctcacatctcacaaggagtatgggctgtaagaggggaggcctgaaacccaacactacccactagggactcatctccccaggtaccccaactctgtgggcctggagtcagccrtcctctccaccccaatcctcagaatccccaggtyggggtaatgaagatggaaggctgggagaatcctgagttaggtggaggcgaatgtgtcyctggttcatggcttccaatctgtctgggaaatcacccagacatataaggggcaaaaccaaccagaaatcttcattaattctggggagttgatggagctgttaggaaactctgtgggaggtgacagtgtgagtctcaaagggagtggaacctgaccttagtgatgggggatcaaacactccaccacccggccctcttttgcctgtgtctaacttgggggtacgtgctctgggccagatgctgtgttagaagtttatgttatgggtatctccattctacagatgggaaaactgaggcactgaggggttaaattacttgcttcattacctagctagtcaatggtacagccaagactcaaaagtgagtccaagtgactccttaactagagtccattctactgcctcggagtactcatgtggtttcaaggaagaggcatgcctgccaaggagcccagctcactatggtggccaagtcagagcaaggcagagtggcagctgcaggagaagtgtgatggggagatggtatctgaacgctccaggtttaggctccttccttctccctggaggcagttaagactctccctattatctctcattgcacacaacaattccaagagcttttcccaagactacctggcccaggcttctggcttcccccgagagccttgagggagcagcagaggaaaactgaggcccccagaggagaatggaaggagtcagcctgtgcgccatgcctcgcaggagctgtctcaggtgcagactcacatcagcgacaccaacgtcatcctgtycatggacaataaccgttccctggacctggacagcatcatcratgcagtgcggacccrgtatgaactgattgcacagaggagcaaggacgaggccgaagccctgtaccagaccaaggtgggcgtggcccccagatctggtgcccagaaaaacagattcttcccagaattgtctttctcttattgcattgtctttctcttatttctgaagtaaaatgtgtttgttatacaaattctagaaattacatgtaaagattacccatctctcactaccgctattaatatgttaatatctcttctaccagttctttgtcgctattaggctagtggaaaagtgattgcggttctcgccattaaaagtaatgacgagaactgcaattacttttgcaaaaacccaataatgtttattgagaactcatatgtgttaggcactgcacaaagtgctttacttatttattattatttcattcagtccttacaacaaccaatgaggtaagaatttcgttatcaccattttataatagatagtagtgtgtgagattacttaatttccctaatgccttgtagctagtaaatggcagagccagagcttaattaaaattgggtttgtgtctacaaacccattcccctcaccactagaatgatttttattcttttttcataatggtatctattaaaatatattttttttacttttttttttttttgagatggaaactcactctatctcccaggctggagtgcagtggcctgatatcagttcactacaaactccgcctcctgggtccaagtgattctcctgcctcagcctcctgagtagctgggattacaggcacgcgccactacaccaagctaatttttgtatttttagtagtggcagggttttgccatgttggccaggctatactttctcttttacttaacacatatggatacttttctgtgacactaaataacctgccgcatttttaacagcctggtattatattgttagactacaccctcccttattagatcaactcctttgtggctaagttgttgggcacatctttggttacttcttttccataaactgacctggatctttttggatggtgaagcctctggttgaaagggcgtggctgacagtccagtcactaaattctgaacaactagcattgatgactggctttgaggatgatctgtggccaactccaatcctggctgacctctgtcccayggtcctgcacagtgttctggggtggaatggatttcgacattagactaggaagcagatggccaacagtgaaaaatagcagagtgcagattcccttgagtcgatgcttctcctacccacttcagagccctgtcctgggggtggagttctgactaatggggcaatacagagacagaaacagagatggaggggaaatgagactgaacgtggagccaatggagggcctctgaggacatgaggtcctgcttgactgctagggagatcatcctggaaaagggtgggaagctatatggtgggtggaaagagtgagggggtctcagtgtgggtaaggaccaacgtgaaggcttagatgtgtgaaaaggtggtagaaagggcatcacaaagcaggtttgtctggctgggatgagagtctgcccagagactggtgggaatgcgggaggcttgggatagtgtgagtgtgtgcatgtatacatgtgtttgcagcctgggtgagggaggtttggtatagctgtgagtatgcatgtaggggtgaccacagtgcaaggtgggtgggaatctcccaggggagagcagcccagacctactccctcctggaggggcttgtggtgggcagcacatgctgactatgatgctgcctttggccccagtaccaggagctccagatcayggcagggagacatggagaygacctgaagaacagcaagatggagattgcagagctcaaccgcaccgtccagaggctgcaggcagagatcagcaacgtgaagaagcaggtgggayrggtgcttagggagggctgaccaagccctgcacctcctacaatgccctgccagatcgagctctggaaacttaaccattaaatggtctccaactgtctctggagcagattgaacagatgcagtcactcatttcggatgctgaggagagaggcgagcaggccctccaggatgcgtggcagaagctgcaggacctggaggaggccctgcagcagtccaaggaggagctggcccggctgctgcgtgactaccaggccatgctgggggtcaagctgtccctggatgtggagatcgccacctaccgccagctgctggagggcgaggagagcaggtgggtctggcagctgtgtttctggggctaaggcttgagatgcacccatgaagctgtgggactggctatttggagaaaagataagccccacctttttgggaagattggtagcccagggtgagcagaaacattccaattagaggcagaggctgtgtgaatggacaagcctcttcacayagggagaagtcattgttatcattcctccacctccaagtagaatgtccttataccccaatccaagcctctgcagctgggtattcacccccaatgctaaaaggcttcatgaaaaccctgaaatttctctctgccccactggcttcctgacctctgctcatgcacacacatttccctaaggcttggggacacctctgatccagawgtctgtgggccacagccttctctcctcaggccctgtgggtctggctgaccgtgtgctttggttttacaggatgtcaggagagctgcagagccatgtgagcatctgtaagtagcagagcccaggggcagagagaggctggtggtgctgggtggagggagggccaggaggtggccagcagagaacggaaagtctggcattttagcttccagtcctgtgcaatagacaccaaagtaagcaagtgtaatggcaaagcctggaagaattcatttgaaataaatggttatgatttcaggtctgcttatcttaattgttatgatgcctttttattaaatgatgcctaggaggaatcagcagcggctagaactctttagggtacatattcaataaacaatgtaagtgtgttgctgagaggaaccctggcatccctttgtagtatgaagaatacttttcaagtaggaacactttcaattttcaatgtatggggtttgcaagtcgatgccacgggtgatcgaggatggaggagkctgcaggtgcaggggcgggtgcaggtgggggccttgccckgtccctctgaccccgtgtgcactgtcccctacccacagccgtgcagaacagccaggtgagcgtcaacggyggcgcgggaggcggcggcagctacggctcaggaggctacggcggcggcagcggtgggggctatggcggcggaagaagctaccgcggaggcggggcacgagkcrgragtggaggcggttatggcagcggctgcggcggcggtggcgggagctacggagggagcggcagaagcgkccgcggatcctcgcgcgtgcagatcatccagacctccaccaacamctcccacaggcggatcttggagtagaggcctcgtttctgccacacatcacgcctgcccctcaccgccctctcctcaaactcctcccctccacgcccttcctgatcccctctcattcacttttcttaatgggtctcagcaattttgccaataaattcgactctaatgggggaagcagggtggataagtccaaacagcagatctctctttggagggcactggcttgcagtcagattcacagctaggcacattctcactcagaccccgctctgctggccctgctgctgttcctgctcccacctttttggaagatcggtagcccagggtgagcacaaacattccagttagaggcagaggctgcgtgagttggcaaggtagggagaagtcattgttatcattcctctgcctccaagtagaatgcccttatgccccagttcaagccactgcagctaagtattaatccccagtgctaaaagataccaggcatctagtttagcaatggagggaaacagaaacagcctgtagagagcatcgacaaggcgcataatggagagttggtatctcaaccccaagctccctttgctgtacctgggctgctctgtgaacaagaatccacgcccccctgccctgctggggaccacataatgatccctttgggggaagttgctgattgcagggcaagctagcttggtaaggaaaacctctgcaccagcggcctattcctgcctcttggtccatagcctcatacactcatgttgatggatagtatagatttgctgcccacaccagatatctgtaaggcatcactgtcctgattctgaacctctgtttcaggaagcattctcccctgtgtaaacaactcaaggtggaagtatttcagagggcatagggtcatgaatccttacccaaaggaagcctgttttagcagtggatgcaggagttgatgaacagacaagcaagttctgcttctgtcctgtttcctcctgacagctccattcttttgaagcctgacccttcctaagctctgcatcataaccactctgagaattgccccattgggtgggcatgtgaagcccagctctgttccatccaggtgcctcgggcctgaggagtctgaggatctgacttgggtcttggaagggttccaaccccaagtcagtcaggaagctgcccatttttttgcaaggcattttaatgccctttcccagacctctctagtccctcctgccttctgttctctgtagctgtgagccctttgtgagaatatgactcttaattttgaatcttatgtaagaggcttgagatgtgctggagagggcaggaagaggaaagtatcaggccttgagagagggaatgtagctttgcttctatgatctggagtcaccttcacttgctagctgagtcctaacacaacttccaagtccatgattctcttggggcattggatgggctcagtgtgggtctcttaggctgttcttgtgacttcatcatttcctggttcaaagttgtactgtcaaggggcagcatttctggtatttctataataaatttttctgtgatctcaaattgctgtttggtcaggagatgcattatttcttcttcttcttctccttcttctcctttgccttcctcctcttctccctcctcttcttctccttcctcctcttcctcctcctcctccctcctcctccccctactccctcctcctcctccctcctcctcctcttcttcttcttccctcctcctcctcttcctcctcctcctctcctcctccttcttcttcttctccttctccttctcattcttccatcttcatcttcatcttctcctctttttcttctttcttctaaataaagatggggtctcaccatgtttccaaggctggtcttgaactcctgggctcaggtgatcctcccaccttggcttcccacattgctgggattacaggtgtgaggcgtggtacctgggctatttctttaaaaatttctgcagacctctgaaattatttatatttgggaagttaaaatttcttcttattttttattgtacaagtaatacacagtcttgaagaatcttacagacataatcttattaatccttaaagtggctgatcatccaaaagtcaattatacatttgttcaatgagcacttattaagctcctactgtgtggcaggcagtggcttaggcactgggaatgcaatgttgaatgaacatgtttctgactcttaagttgctcacaactaaatgacatattatgggggagggacgattcagagagaagagaaatctgagtgtgcttctaaggacctcctagcctgagagtggaagcaaggcctatcctgaggacacaggcagaccccccaaaacaggaacagtgggacttacgacaggtgccagtgctggggaagggacgtttggttccaacagactcctggaggactgggatatggaacagggccaaggaagagaggtgtgggtggggagatgagggaagggccctccaaacagggggatagtctgctcagagactcaaaataagagagagtgtgggggtgagaaggagcagctggacaggagaaactgagctagggaaggaaggggctgaggcccacaaactgagtggggtcatgggcagagacatcttcaattgatgccttgagggaagcagagatgcagaaattccataatggagcaagttaagccatcacctcatcctatgtgttagttctgagtccatgtaaaagaatcacataaaagatgtgatctactttctaattccctggagggactttgatgaaatttggatatgggattcattcgaatatgacaggaacccatattgataagacactgtgttcccaggcacacccctccattctgtctgagaagtttctccccatctcacctgtcctggcagcaggcctgtcaggagatgggtaggaaagggagaaatgggcagagaggctgtctgaagggaagcagagagggagcagacagatgcagtgccccacacttgcagccaagagccaagagcagccaagagccaggagcacacggactaggaagggaagacatggatggagagcagtgggcgtaaacatgactttgagtgtccagctggcaggtgaggagacgtgagtcagaaggtgtggcagctgctggaggcagccttgggaatcaggaagagagtcacgtctagagcttgtttaggctcttctggagtcagatcactgtggggactctgagctccaagaactgtaataaataggagcctactcagaggaaggtgaccaggacagtggtggtggggaatcagaagcccgatcacaggaatgccggtgaaaggccaggagagcagtctctgggggagatgtggcagctaactgcaaagatttgaaaggcttccgtgggaccacaggaagggtggctgactcaagctgatgacccagataggcagtgtctttgcagttagctgtcacatgtcccctgaaaggtgggcttctcctccacatgtgggcaggctctctgcctgcctttcccttttctgcctgtcctctgacaggcttgctgccaggatagatgagatggggagaaacttctcagagagaatagaggggtgtgcatggaaacagagtgtcttatcactatgggttgatatgatgtttgcagttagctgccacatcctccccaaagacttctggaggggcatgcctgggaacacaatgttttattcatatgggttgctgtcctattccaatgaatcccatatccaaattccatcaatatcgcttcaggaagctacaacatattcggctcaatataagaagcacctttctatgatcctgacatgggagaggctacctggggagtgatcaagtttcaagcagagattggctaaccgtttggcaggacgttgagggcgggagtggagatgggtggggatatgtgtatggaggcatctcacatctttgctgtactaagagttcacatggcgaaacctgagaaaaaaaattctactctctgtgttatatgggaagaataaggtcaggtgccagtgaaagctaaagtcacaaagaagccaaaggccctagccagaactgttaaatgaggctaagttttctggcagcacagggtctattacagggtgtgagtttgattatccctgggatcatgcatgtgtgatactctaatgggatccacgttggctctgagaaaacacgcaaggataaggccaaccacagctctcctttcccatcctctcttgggaacaagttgagattgtcccagaaagtgtggccctgacttatctcttccgaattcttgattttgtcctgtcatggaggcctgggggacagatggagggaatcatgtgcctgaatctgaagaatattggaatagagattccacaaggcgggggcaggagaaataaaggacagaaaggagaggagttggtcaaagaaggcatctcaacgtctaaatgagaagtcttaattcgatgttcagggaaagagagagtaactttagggacctaaacaaggaggactagcactaagacactgaagagatttcctgaaatagacaatatttccatcagagacaatgagaaatcccatcaggagaaaatgtctctcactttcagctcaccccagtgaaaacaacaagcaattctataaaccatgtaggaaatgcccacacatgcattatctcacctgagtcccactcacctgggagtgcggagaccaggtgtgggggtctgcagtacttctagggaccatggagtgctccatccctgcccctaatcaatgctattcccacaaggcagatactcagagggagagccaagcaggctcattcatcaataaaccaagaggctggcaggagggagcaaacacccgggttggtgagagtcccagggaaagtctgccagctgctctttgctctgagaggcagggtggcagggtggggcactctggaaatataaatttagttccaccagcttctcatccacagagattttgatctgaggacatggttaactggaggagcaatcattgactcagtaaaattctaactgcatctgaccttagacaaggtgtgcgtttctgggctgggaaagttcctggtctgaggaagagtctcttgagaatgtcatctcttttcaattacccagccttttggcccagaatgcatcttcaaattaatgagccatttgctggttaatttggtcccagggaaaaaagtccagcaaattactgggcattacactgagcttgaaggtccctcttcaaggttgccctggttttatcagctttccgatcagtctgggaaatgggatgtcttcaggctgatcaatgctctgttgaagggctggctgggaatttggggtattgggaggttttctagcatggaggacgggctccgagtggcccaatcccaagcctggaagggcttccagggggctctaagtgtgcattctgacctccacacctgcccctgtgtgctcagccctcagtgtttgtgctccccctgcagagcaggcactctgcagtgagggcaaaggctcctcgcatctggccccagctccctccagcctcaggtgagyccggtgatgcacctgtgatcccttcttccatgtgatgccccctagctttcccagggcaagtccgtggacttcttaaggctttctctcacaagatgaggaaatgggcccatgtcaagggcttaaatgtcctgttccagccttttcactgtttccagtaaatcaggggcttgttctaaagtttgtttttttttttctggttattatatcagcttctgggttctctcaaatgcaagagtgagggaaaaatctttccttttttccttttttgagatggagtctcgctcagtagcccaggctggagttcagtggcgagatctcggctcactgcaagctccgtctcctgggttcacgccattctcctgcctcagcctcccgagtagctgggactacaggcgcctgccaccacactgggctaattttttt

SEQ ID NO: 10668 - DNA, 144013 bp, Homo sapiens
  misc_feature (1)...(144013): n = A,T,C or G, or insertion/deletion polymorphism (see Tables 1-2)
tcttcacatatagcactaatttactatgctatgtatttcatctttgcctaattctcaatactggggggttatatattgtgtaaagatatttagatcattctaatttgttttatgcattttttttgcaaatttgatttcatgaaagtgtattatcacaacattgactttgtgggttagtgttgtgcaagtacagaaagtccttgaaatttcctcagtaaattaaaaggtgtcacttttgtatatctgcatttgcacacaataaaatttctcaagatcttagctctttaagagactgcacccattacagtttttgatctatcttatttgaacaattaggtagtccattatggtactttaaattactgcagttaaaagctaaaaaaaattgggtgcacaaaattgccaactacagtgctatgtgtttatacattttactttttgacctatttatttatgaatatggttcatctgctcatactttatagtgatgtgacagttcttagtataccagtgtctatactcacaaaaatatgcatgtcattatttcctaatttattatgtaaagtggtccatgaagtattctttcatatttttaatgtttctgaagtaaatctatttaaacatataaataaacattttatagaatttttaaatacttttttcagaattatatttttgggattttgatcgtccaggactttgatttccaggattttaaactgtaggaatttttatcttttgggatttcagcatccagggtcatggcattcaagattgtgtctttggggatcaaggcccaaacccattaaaacagtttgcctattagtatacttattactattaagtgtattacaacgatttaaatttagaaagagaaagcacaggaataattttaatgtttgagcagggtgatggggatgaagaaagacacagaaacctgatttgaaaaacatagatctgtttatatatataatctgttcatatatatataacaccttctgttttcaaaaaaattctgtttactttatatgaattttcttgttagatttcataaaagtcctataagattcataatgttataaaaatgtatcagttaatagaaatcttgagatcatataactctttaattagaagaaagagcttcttgaatccatacaatttccagtaaatgatgccattttctatatgtatctttcttacctatgtgtttgcctacatctaacaataatgtagcttgatgtatacagtattttgaaaatctgctcattangtaacttcctgaattccaattctttttatctaatatgtaacatttttgcatgaatactgacacaaaataatacagggcaagtggtttgcctttagagtcctattttgttttctctttcacctgcccatccccaggttcagtgtcttccaacatatatttgggtagcatttagcatagattaaaaacacaatttttattgtgaggtcctcgaagagaaaccacagactggaagtttgtatttgtaacacaaatatctgatgaaggagctatatctataatgtactaagaaatcttaaaactcaaaaataagaaaacaaattaattacaaaatggacaaaagatgtgaacaaacacctcaccaaagaagatatacagatatcaaatatgcatattaaaatatattcaatatcacgtcattatgaaataagacaaacagatgccacaaaacatcaattagatatggctaaaacccaaaacactgacaataccaaatgctggagaggatgtggagtgacagcaactcccattcattgctgggtgggatgcaaaatgatacaaccactttaaaagacattccggcagtttcttataaagttaaccataagcttaccattcattcccacaattatactcatagctatttaccaaataaatttaaaattatattcatataaaaacctgcacacaaatactcatagcaacaaacaaggtttcctttaataggaaggacaaacaaaatatggtacatccttacaactaggtatttttcagcaattaaaaacaattaatgagctgttaagctatgaaagaacatggaggaagtttaaatatgaattgctaagtgagagaagccagtctgaaaacattacgtactacatattccaactaatgacattatgggaaaagcaaaactatgaaaatgataaaatcatcagtgatttccagggcttagaggggctaaggatggatgaacaattggtagatagaatattttaggtcaccaaaactgttctgtataatattgtcatggtggatacattttgcatttgtcacaacacagtaaaacacaaactgggaaatctaaaataacctagtgaaattagttaatgataatatatcaatgttggttcttcaactataaaaattttactacactatgaaagatgttaaataataattaaagaaactaatgttgaggatgtgcaaaggattattaggaaaatctgtgccttatgcttaatttttctgtaaattaaaactgctctaagccatgttgttaatgttaaaaatgagctgaaaagaagtaacacctcaaatggagactaaactgaaatgaaatgctttttgttaaaaaatataaaaaataggaagtgaatataatgtaattttttctgttcagtgtttttaacaactaaatgcaactggaatgaagattccatcttttgactgtgtatttttattaatgtgtgtgtatttttattatttttaaattttaaatatattttaaattggaatatagtttaccaaatgatatccattatctagtacgagtattaattcaatgttattttcattgtgatatgtttagcaaaaccatataaaacaccttaacaaataacaaatattttgtttttaaaactacttcatgtataggtaataaaataataagtagtataatatctgaaattttttacttcccttcaaaatttttaacttaggtgaatagatgcaattttcctcttttcagggatactcgcccccccatctttttgtctctttctacattccttgcttttgttattattttggtgggtgtaagtttattttacaccttttattttggaatgattttatcagacctgagaaaaaagtagaaagttttgtatattcatcactggatttaccttaattttacatattgcatcactatagtagatttaccatactcagaattaacattgatgcaatacggttaaactacagatgttatatttatttcaacagattttcccactaacattcttttttggttccagaaaacaaccctggatagcacatcgaatgttccagtagtgtccctgtgtaggcttttctgatctgtcgcagtctcaatttttctcgattttttatcgtgttgatacttttgaatagtattggtcccatattatgtaaaatgtccctcaatttgtccttgatgtattcttgtagctggattgagataatgaggtttggaggaatattacaagagtgaagcattcttctcctttcatgacataatgagtacatgaatggcaacatgacttttcatggtgataatagacttggtcaagtggttaagatgctatctgctttccggatttctcttctataaagtggctgtttttcccttttcattcattattttttgtaaatgtgtcagtaattgaaacccacactcaaggagacaatatatccataaattatgtggaagtcttgtgtaaggaagacttgctcctggttcttatttatttatttatttatttattatgtattcaatcatttatttataatggtatgaactcctaggtatactgttttgtgaatttgaacccattattattagtacttattttgttgcttgaattattcaaactttggctatgagagctctttccaattggcttctgaattcttttgactatttctttttctttttcttttttttttgagacggagtcttgctctgtcacccaggctggaatggagtggtgcgatcttggctctcagcaacctccacctcctgagttcaagtgattcttctgcctcagccttccgagtagctgggactgcaggcgctcgccaccacacccagcgaatttttgtatttttagtagagacggggtttcactatgttggccaggttggtctcgaactcctgacttgtgatgtgcccacctcggcctcccaaagggctgggattacaggcgtgacccactgcacccagccaactattcctttttttaaataaaaaaaaaaaaatctggagaaacattatatgaatagtgtttaggtcatttcaatataatgcaataacttagcacaatatcattctgttacacattcaaattatactttttggtcattaattaatttatttaatactgtttatggatcaccagtccatattagaaactgttctaaatgctgtaaataggttaggggatatggtcagagagatgtcatagggtgctgggtgatgcagaactttgcaaacctttgcaaatatctttggcttttttttttttttaacataaaatagaaagcccctgcagtgtgttgagcagattaagttacccacttaatatagaaccaggtcactccacctactgttttaaaaatagactattgattgactagtgttggggtaggaagagcagtttggatatgcaatacaggtgagattcatgcttggattgtaactgtgaacagattgtgtagtggatctctgatggattagatgtgaggtgtgggagaaatggagaagttaaagatgattccaagtttgaagtgctgaacaaccagatgataaagttgcataatgtgtgcccacacatacgtgtaaaaagacacatatccctatcatttatatttttgaaaatataaaatattgaatgtaatgtaatataaaatattaagtgtcaacataataactgaagagtgtaaagtgaatctctagggcataatgtataataaaattaaaaatgaatacattattttagttgtttataaaagtaaagattagcctcaggtagataacaggtttcctcccctatatattttgtgtcattttatttgtatgttttcattgaaaatcacattccagaatattttcctttaatatcattttgaatcagtgataatatgttttggatttttttttcagttgtttcttcatcagatttacatatctcagaggactaggagtttttctaaaagctcttttgccaggatgtttttcagatttcatttttcattctgaggctatctgtattttccataacatagtgttgtggaaaatgtgatgctgactacagattttgtatatcagttcaacagatttccaaagatatacaatgttaaaataatgtttacttctttttccccaggttacaaaattgttctctatcaaattctaatctcatagtttgctatcttttcaatgtttatatgaagtgaagaattcatcattttatattgtgtaacagttattttaagttcgttggtatttgtaattagtactgacaaaaataaatttttcactttagaatgctttacatgcacatgcacatatatttatataaaaaacatatataaacatatatatgccacttctctttaccttagacaggattttttaaatgttacatagtaatgtactaggacttttaaaaatttaactttaagatagcactttgctaatgttaaatacatctcaatgcaaatgtgtgtgtgtgtttgaagatcagtgcatccagaactcagagatgatgaaaatgttctgtctattcttgctttggaatttcagataagagtagtcatattacaaagcagagataaaaggagaaagcaagaaatcattcaattgctggtaaagtaatactctacacagcaaatcacaatagcgtgttatatatagaaataagatcagtcactgttttcaagcctgctaaataaaactgaactcttggaatggcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggcyctctaagaccaactccagcagtcaaacattcaaaaacgactcactttgagattgaaatatttgatgctcaaacaaggaaacagatatgtattctggataaggtgagtttatttatttatttatttgtttgtttgtttaagtgtttcttctctgccccaaatattattgattgcttgattaaattctaacacgactgttctgaaatacatttctgacttttaccttaattttgtggtgaacaggatgcatactttatgcattgttttaatagaagatgttcaatgcatctctcatactcaatttaaattaattaaatggtagataataatgaggttctgtcattggtctgtgaattttatgctgtcattgaccattgtccacaggtaaaattacaaatgctcaacctattttcctacatgtaaaatgtctccaggtttttgtcttcgtgtacttcattgtatatacaaattatcatagagtttgattagtttctatagaaaatagtaagcaaaagccacagtagttgttagaagtaacatgtaatatgtctgaaaaaatttaatcatttaagcattattttgaattgattttattatttttcttaaaaagtgactacctcactttttatgaaagtttacttgcttcaaaaacactatttaagttcatgaaaataatgttttgaaatgttactcgtccaaatccatattcacaggtgttgcactaaggaatgagaaaatatactcttcttaggttagaaaactaaattataaatatatgtttatattttagataaatatatgcataaataatattccaagcattttcagtttttaataaatttgaaaagtactattaacttaatatgagaaaggcatatttgtacaggtaataaaatagagcttgatcttgttttacaaaaatattgaatacgtttttgttgctgtgttctaaaaataaaatgcaatcaatcattccgtttttccatgttctagctaggtctttagaaaaaaggaaaaaagaagctgtttagtcctttctttaataattgccaagcacataatatataatttcttattcagtaattataacactatgagcagtttataaattgagttatattaactttaattcatagatggaaaagaaagattaagaccttttattagtgcacacaggtcatgaattgaactaaaagatctaaaaccatttctgtacagttttaaatcatatgctttttctatagttctactgaggccatatataagcgatgagtatatatcatacaaaatagaattttgatatatttatttcaggacttctataatttacttttattttagtatcaaggtgaagttttgagatttttaaatatcatacaaaatatttaatatttaaatatattacayaaatattttatatttaaatatcataagaaaaataaaaaaataaaattactcttcagaagttgctaatgtttataatattccactatgaaaaacacaaatcttacaagaaaaaacacagttaaattcaaggacacagtgcaacaaatggaatgaaaatcaaataagtcaaggatttccaaagactacaattctaaaatgacactggttattgtgtcctttctgacaggtgtatagaccctgacaggcaatccaccttaaagtaatgaaaaactcatgatgtttaaatgttcttttacttaattacacacacacacacacacacacacatgccaattagttcytaattatttgccttacacatttaaattttttcttattcatattttatttgaaggtaagacagggatttttatatttttacgtgttaattaaattgtgaaaaaaattaaacatttagaagaaatgaaatttaaatattcattattcagagataagaattttgcaattttgcatgggagtctcatgtttgaactatgagagtcctgacatttgcatctcaagtggcagatctttatagaaacttagcaggctaaatagaggattaacactggatagctcataatcctttattgcacaatcagccctatataatgtgcaatttactgcattcaaatctttgatgtctgagtagaagtggatcttgctgtgtcttgttttagtttgtaaattgataaactgtttcataatagtggtgagacacttcagagaaaaaagtcttctagattaatttttttttttgcttagtaatttctaacattttgaatttgtaaacataaaaaagactgatttatttattattattattattcctgatgttatttttcttagacaaattaacaactttgtagtaagatcatattaagtgcccttcattgtacctggctctacccagtgtaaaaaagaaatgttgcttataacttagtgcccgtctttcattacttactatgctgtaaagtggtacaatttacataccatgtactttggaattaagcatatctggactcaatccctgttacatcatttgtgtctatcaaggagtaagaaagtcactgaattgctcatccccaagacccttatttagaatatgggttaataaaatcatatcaataaagttaataaatgttactttggaaacttctagtagagtagggataatatatgttacatgcttagaatagcgctttgaccataatatggacaaaattattattattattttatttttaataatcatttggagagagaaagtaatatacataaaatataacaataacaaatgctgagccttttgataacttgctaagaatttaaatttgacttcttaatatttaattattctttgacatgatttgttataatgcttaggatagatatatttatcaaatatcttaaatgagatgtattatcttagtaatgtatgttctaacagaaactttgttttatgtctattactcaaactttaaaatggacaaagtatagactcaaaatattcatgagataaaaattttgagaaaagtcctaggatgaaagaaaatatatttattatgttctttaacttaattacacacatamacacacacacacacacacacacacrmgcgcgcgcctaacaaataaaaaagctttctcttgcctctgctgtcgtctctagtttttgcccatttctctcattactttccttaggtattcatattgtcagctttcatttgcctcttctcactgtatcctagtcccaattcatttgggcactcacttccatcagttctcagaatctgaacttactgaggtcaccagtgaggcacggcaaatactttgctaaatgcagagccctattctcacgtcttatcttactgggtatatcaacaacattttccactgttaatcgcctcctccttaactagcatttgttatttgagttccaggagaatatacactttttttaaccaacttcgttggcttttccctttccttattgctgattcttcaactgacttattaggaatggactttcaagaactgagtcatcacaacttctcctcctctacaataatttactttattgagttccataatttaaaaaaaacttcctagtgatgtctcataaacatatactgtaacctattattttccttggactgtaaatctacatatctatatatcgatttaatctattgagctatctggatgtttaccaggcatatcaaacttaatatctctaaaactgaccacttggtcttctcccaaacatcttccacagagctacttaagccaataagtggcaactacatccttcaaatagctcaggccaaacacttggagaaatcatgacttgtcttttaatctgacacctcacatacaatccatcttcttggcaatagcttcaaaatatatcaacccttctacttctagcactcctgaatcttcctcctacttgtgtctttatcactttcaatatatcctctactaacaacaagaactagcctgttaaatcctggcagataatatcatttgctcctcaaaactagtcaatgcttttctttagatcttaactgttaacatttcctggaggcttttcctgactactaagagagcaaagctagccaacattttttattatgcttccttgttttayttctttactagacttattgccaactaaactactatttatttttctttctttagttcattatttggcctacccttagtatataagcacaaaaatatcagattgtttgtttgttttacacacttgtatcttcagcattaatagcaatgtttaacacaaataaagtgtttaaacaatatgtgttgaataagtgcactccggttcaagaaacatgtgaatttgacacagcattcatgttcagtagtgatagttttgagatggaggagtataatatttgaaaataaagtttatgattttctacatcaaatcaaattattgttagaatatttgttcatacattcacataaaaagacattctctcaaacccttttacctactgctcaaattctccccagcttatnctgaaaacaaatacatataatttaactttgtgttagtgtataattcattaatagacagtcatgttctgatgacaattttaataanattttcataaagcagatgggaatatttatttagctcatttagctagttcccatgaatgattaaaataactaatcatggataacaaaatggagagcagatttaaaataattgttaaataccattttcaagtatttgttggaacattaaaaataagagattgtaggaaaaataaattttaaaaatataacaatgaaccatttccagttgctgcctgctgttgtctcatttctttcttgtaaaatgtcagaagcttatctactgataagtcaatgattgaagagcatgcaagaactctaagagcctgagttgataaatggtaaatgtttccaatatcatctcattctattttcttcaatcttttctccaagtaacctgacctcaagagctctctttctcctattgttttttttttttttttggtaaaactctcaaaagctttttaaatatttcttatgaataaaataaagcattcaataattctctaattcttctaatagtaaaaataacaattgtcctcagaaaacagtagaaataattacaggatagtaagagtgcatacaaattataccyttgtaaccttaraaattttgacaattcttaatttttgacattgccattttaatactttaccttgtacatgatacttarcatatttatgctttagtttgttcatctgtaaaatgggaatagtatctgccttagaatggccacatggcagttttcagaatttcgtgtacatgcaaatgacagtatcttttttttttgtctttcttttcatttttccttctcttttgctccatctactyttctgcctcttcctcatattcctgccccccttttcctcctccccatgccccctcagtcttctttttcctatttcttatggtgtttcatgatataagaattaatcaaaagcatatgggagttgaattcagaaagtcttctatattagtataaatctgagagtgtgatttctttttccttaggcatggtctggtatctctgacttttattcattttttatggaacaggaaggctttcctggagaagttatatttatgtgtgtcctagatagtttataagaagratataacagggagatatgcctgaggctaaaataatttactaagtctatgtgtgtgtgtgtgtgtgtgtgtgtgtgcgctcagggagggaagaatattgtttgtttgcttgcttgcttgctagcttgctttcttattttgagtgcagacaagtagacaggcagttagaaatcatccttttttttttcattttaagttggagattcctgtgtgatatccatgtatagttaaccattagacctttggctgtgaagaactcaggggagtggtcatggttaaatatgttgatttggaaatttaaaatgtataggtgatctttgtagctgttggattagagaagatacatttgtaaagaacaatgtaatgagtaggaagagaaaagaaccagttacagaggcctgagaaacttcagcatgtgttttaaataaagagaagatgataagggaaaacaaggagaatgtaccagagagataggaacacggggaatgttbatcacagaaacctcaccaagataatttaagtaaaaaggacaagattagtggtgtcaaatatggctaagaagcacagagaaatgcaataagtatcccttatattaaatggtgtgatattcattgagtttaactagactactttaggcagagtgatttagggagaactctaatctgggatgggggattataaacaatgggagattgggagataagacacgtgagttcactggaaggcattgcttttgtaggtagcagatctttttacagacttacccttcatttttcaactttatacatctcttatgtaccccaattcacattcttgagattactttctagctcttctctattactacatgtgtcaacattctatactacttatcaggctcaatacacattttgtaatttttatttcttgagtttcaggaaaatttgattcccttgcttgragtgtgttccgtcacaatctgtatagttcatattcattccgtattgtccaaaagagatgacaactcctttatgtgccacttagggtctcctataagcagatgtactcctcatcccagtaatgattcaaatatctattattactgtatataatccaatagttaggagtgggcttttgtaagctatcatagacgtttaaaagagatattttatgcttgcccaacctactattttaatcataaaatagtgaggcttataattgatatattagtatttttttctaatagtttattttcattgtattttacaaatgtatcagtccatgacaaaatagaagtttaaaaaaaattactttactctacatagtttgagaagcaccaaattagatgacatggaaatatttttaacactgccatgattcaaacatttgaaagccatctaaatgttattttacaataaaactatcttgggttcagaaaaaagaataggtcatatccaggcttttcttgaatttgattctaaagtttgtatttcccttggtaggcaagggaaaagtaactctsaaatgtttgttttgtacatataaaaaaatagcaaaaatgatntaaattttttagaccaatgaaaagtgaataaattgtgttttctttggaaattttctacttaaaatggtaaatctgagaagatgaggtaaacaaagaaatgctaaccattaaaggaatgaaattaaggggagcatattgtgcaaataagagaaaacctatttcctattaaatcaagattgaatgaatacaattaatactggaaacactagtttaaaaacatacataaagcttaaataacatttctgtctacggaaactagcagtgaagtggtgactatntcaagagagacgtacacatttgagagagctatgcctgctttgttattcaaatagtttagattacacgaagcttataatgaaatgtatttgctaaccttaaaatgcatgaatttaattggaaagacagataacacatttaaaacaaattacaatataataaatagcatacacaagtttaacacaaattatactgagaagtctagggaaataattcttttatgtaaaagaaatttagttatgagtatgagagtcaaagaattgtttagctgaagatggcacttgaaaggatcttgaaaagtatatagtatagaacattagcctggttgaggtcgaaagagcaacccaggaagaaagtttagcatatccaagaaaaaaagaggcaggaaagtaataagccaagcttcctgggttggtgtaattaagtacatggtgtgatacttcaaaacagagcaaactgagattaaaatggtatagctggggctgatcagagagggcctgattgccttgctagggcatttggactatttttctttgaacagggtaatcattttttttcagatctgcctttcggaaattaaatctgtcaactacgtggaagataaaatgtgtagtagaaaccctgaagacagttctataaaacggagaagaaatcttgtgtgagcttgttcaagactgccacatttgggaggcaagatagtattgggatctgcttaggctttaagacactcagccacctcacacacttatccaggttgtgacactgggcaaacttattatgttttcccttatatttgttgcattgggccattctcacattgctatgaagaaatatctgagactgggtaatttatatagaaaagatgtttaattggctcacagttctgcaggctgtacaggaagcctagtggcatctgyttctggggaggcctcaggaagtttccaattgttgcagaatgctaasggggagcaggcacttcncatgaccaaagcaggagaaaagaggaaganaggggagatggcacacacttttaaacaatcagatcctgcaagaactcactcactatgaagaggacagtgccaagagaatggtactaaaccattcatgagaaatcttcccccatgatccaatcacttyccaccaggccccacctgcaacactggggattccatttatacatgagatttgggcagggacaaattcccaaactatattttttctgcccttggtccctccaaaatctcatgcccttstcacatttcaaaataccatcatgccttcccaataatcccccaaagtcttaactcattttagtgttacctcaaaagtccaaagtctgaagtctctctgagacaaagcaagtcttttccacctatgagcctgtaaaatcaaaaacaagttagttacatscaagatacaatggaggtacaagcattgagtaaacactcccattccaaaaaggagaaacccactaaaagaaagtggctacagggtccatgcaagtccaaaacctagtagaacaatmattaaatcttaaagctccagaataatctcctttgatatcatgtctcacatccaagacacactggtttgataaagtgagctcccaargtcttggatagctccactcctgtgactttgcagggttcagtccctatggctgctctaacaggctggtaggttggcattgagtgccagmaacttttccaggcaaacataagctggtggatatatcattcttgggatctggaggacagtggcccttttctcacaacatcatgaggcagtgccccagtgaggactctgcgtggagactccaacttcacactctgcacggccctagtagtggttctccatgatggcttcccactgccctagtagaggttctccatgatggttccacccctscatcaggcttttgcttggacacccaggctttttcatatatccgctgaaatctaggcaatggttcccaagcctcaactttggcactttgtgcacctgcaggcttaaaaccacttacactccctgaagcagcatcccaagctgtacataagtccctttgcaccagggttgaagctccagcagccaggaggcaaaagcagtgtcctgggtctaggcaaggcagcagggctcaaaacctggcccaggaaaccattctgtyctcccaggcctcagggcttctggtgggaggggctgcctcttagatatttgagatgccttccaggcctttttctcattgtcttggctatcagcacttgccttcttcttagttacacaaatttctctagcaagtggttgctcagtagcctgctcgaattacttctcaaaaaactctttttttttctatgccgtgtggccaggctacattttttttgcaaacatttatgctctgcttctcttttaaatataagttccaacttcaagttattcttctgctactgcatctgaaattagggtatgagaagtagccagtgtgcatcttgaacactttgctgcttagaaatttattccacaaccagaggtgtcccagggagagaatacactcgtgggttctgagtttctgtttgtctggttgggccataaagcctcttctttatctctcttttatgcttatcactgaagacagaaactaaaaccatgtctacaggctgcttcaagcctaaaacaacaaaataaaacaagaacaacaacaacaaaataaggaaggctacacacgcttgcatcattctcaagtttaaagttccacggatccctagggcatgggcacaatgcacccatgctctctgctgtggtatagtaaagtgaccttttatccagttcccagtaagtttctcattttcttctgagacatcttcagcctagaattcactgtccgtatcattatcagaattttggtcccaatcattttatcagtctttaagtttcaaactttccctcatcttcctttcttcttctgaactctcgaaactcttccaacctctacctgttagtgaattccaaagctgcttccagattctcaggtgtgcaatacttcaccctgcattaggctgttctcacattgctataaaaaatacctgagactgggtaatttataaaggaaagaggtttaattgtcccatagttctgtgggccrtacaggaagtatagtggcatggcacctgcttatggggaggcctcaggaatcttacaattagacagaaggtgaagagggaccaggtgtatcatayggtgaaaataagaacaaagagacagagagaagagatgggacacacctttaaacaaccagatcttgtgagaactcactcacttttttgaggacagtaccaagagaatgatattaaatcattcacgagaaatctgaccccatgattcatttccctcccaccaggctacatctccagtattggagattccatttcacatgagatttgagcagggacaacatccaaactatattatttaatgatatgagttttctcattagasgcacctgagaaatacaaccttccataagaaaattttccctaggaaatggctatggcacagagccttgaataaattaggacatagatacaaattcaaatttacaaatttaataataacatgaaaattctcacatccattaaatktatcaaactactataaaatartgtttaatgaaatatacacattgtaataaaatttttaaagataaataattactttttaatatatgtgtttataaacagtgtttggggaataagyataaaacagttcaaattaaatataagtcattgggcacattttttaggacacacttgaaactatcagaaatacacacacacacacacacacacmtatttctktcctaacttaatttttactgaatatcaaccctgtgtttaagtcagtttgagctactgtaacaaaaatataaaataycaagtggcttataaacaacagaaatctgtgctagattcagcagcacattggaacaataaagagattagcatggctgctatatagcaatgacatacaaatctgtgaagtgttctgtatttttcttctggttggtaaaaaaagaaaaaatatttctcatagttcaagaggctgagacatccagaattaaggcaccagcagattcagtacctaatcagggccagcttcctggttcatagtttatggccatcttctgcttgtgtattcacakggctgaagtagtctgggagttttctcaggcctcttttgtaagggtgctaatccctaataacctcacaaaggcgccacctcccaataccatcatctgggtgttaaaatttcaacatattagttttaggaggatctaaacattcatcttaggatcatgtatgtatcaaaacttaataaatgtactgtagttcctttcaaaggtacttacagccacataggttaggcaaacttatatatccagtggtaataaaatttagagtgtggtattacagagaaaataaatatgacattccattctcacttattttagttaaatttagtttaacctagattttactgtttgggtatataatgaatgaaggcaatctccctacatagaaacctgaaaatgtgcatgacacactaattagcaaaaaagttcaagataaatttttttttgttgttttataatataagagttcaaacaaaatagataaagctgtgtggctttatttctgggttctctctcatgttccattagtttatgtgtctggttttgtaagctgttttggttattgtagccttgtagtacagtttgaaatcagatagtgtgatgatcttcaacacagtcaacaaaaacaagcaatggggaaagggcttcctattcacttaatagtgctggaataactggctaaccatatgcagaagactgaaactggacaccttcctgttgccatatacaaaaatcaactcacaatggagtaaagactcaaatgtgaaacctaaaactgtaaaagccctggaaraaaaattatgaaatacaatcatggaactaggaactggyaaagattttatgatgaagactcccaaagcaattacaacataataaaaaaatgacaactgggacctatggaaattaaagaggtcccttacggcaaaagaaactaccaacagagtaaacagacaacctaaggaaggaagaaagtgtttgtaaactatgcatctgacaaagtctaatatccaagatctataaggaacttaaacaattgaacatgcaaaaaaacaaacaaccacatttaaaaatggacaaaggacatgaaaagatacatataaccaacaagaatatgaaaaaaatactcaacattactaatcattagagaaatgctaatcaaayccacaatgagaaaccatcacacattaatagtcagaatggttactattaaagtcaaaaattagcaaatgctggcaaggttctagagaaaagggaatacttatgtactcctggtggaaatgtacattcattcaatcattgaggaaagcagttggagatttctcaaagaanttaaagcagaactaccattcagcccagaaattccattcatatttccacaggaatataaattgttctactagaaagacaaatacatgcacatgtatattcatcacagcagtattcacaatagcaaagacatggaatcaacctaaatgcccatcagtgatagactggatatagtcaacatgatacatgtataccatggaatactacacagccataaaaaaacagactcatgtcctttgtagcaacatggaagaagctggaggccattatcctaagtgaattaactgaggaacagaaaaccaaatactgcatgttcttacttataaataggatctaaacattgattacatatggacacataaaagggaacaatagacactggggcctacttgagggtggagggtagaaggagagtaagaataagaaactcactattggctactatgtttattacctgggttgtttcatactaagctaaaataaccaaactcctgtgtcatgcagtttacccccgtaacaaacctgcacatgtaccctctcaacctacaataaaaattaaatagaaaaaaatgataaagatttttcttatataatgtatttgtattttggggaaataatctcagtttgccctttttatggttttgtttgatgcttattttagaagtcaagtccagattacatgatatcgatacattttggtagtctgacaatgaatctgtcaaatcattagctaacttggttctgtgatcttagtgtgtacttaaatataacacattgtgatcrtgttagttgttccttttcactaaagttttgtgctcaaacttatctaatgatctagtgacaactttctttcctcataaaattagcatttaataaatgagcagttatttatgacaatgttaagtaacttttataacttaggttaatggtaaatgtatgcaattgattaagtattaaaatataatttgggtaaaatacataatttacagggcttaaaaaaattcacgtttggctgggagcggtggcttacgtctgtaatcccagcaatttggggggctgaggcaggaggatcacctgaggccaggagtttgagaccagcctggccaacatagaccagcctggccaatctgtttctactaaaaatacaaaaattagccaggtgtggacgaggtgcctgtaataccagctactcaggaggttgaggcagaagaatcatttgaaccccggagacaaaggttgtggtgagctgagattgtgccactgcacaccagtctgggtaacagagtgagactctgtctcaaaaaaaaaaaaaaaaaaaaaaatgcttgttaattttttgacttgtaacattaggaaaatatttatatttcatgatctcaatttttttatcttttaaagagctcagtgtttcctacttcacaaggttatttttgataatcaaatgtttatctgtatacgtagtaaagtagtacctgctgcacagtaaatgcccaataaatttttctcttcctatttccattttactctcctccaccacgtagtgtagtatagtggttaaggacaagtatggaaacactctgtgttcaagacctatctttagcttcttaactgtgtgaccttgttaaataaccttgttaatatccactttgggtcacagtattttcatttgtaaaatgtatgtaaaatatatatcttatgccacgggaattgtgtgtgaattaaatttttaataaagataaaattctaggactagtacctttggctgccttttctacattaaagtctgtggaatgaatacattctggaggcgcatgtccactacaattatcgaagattaagctttcwactttcaaaagacactaataaaattaatgtttaaaaatctagctacacaacaatgaggaaaatggtgctattatgtttgatagttgtctcttctataccataaggagcataggctacgctacctgccatactgcagtggagaggaaatttttattattatctgcaatgatgattttacagtcactatacatagcaggtcatgttggtaatgaaagtgacgttataattcacataasaaaatagttgatagtatatttttaacatcagatgagctgaccatttttatttatcttattttgcccaagaaatgaatgtcttggttaaagatggagagaacatattttgtttgaagaaggaaaaactaaattacattacttatcaaattttcttactccaaaaaagtctgaatttccaacagcattatatatatacatatatttagacatatacacaatgcttaaaatatgtatgtaacattttatttttatctagctagctagctcttcagaaataaaaataatatgcatgatggattcttatgtaagactcagagaaaatattgtaatcgtaactgggactctgaccttcttgaacactccagataataatttttttaattttaacaattcttccttgagtctataatttctaaatacaatcatatatgatgtattaacaataaatatattagattcattatattaatatttattttctgtaagatagtataactactcaatacagaagcagaaatgggaaagctatgaactctaagtctgataaaatatattttaagaaactaaaatatcctcatattgttttcaattttaatgtccttaggaaggcagtataatcaaaacaactcctcttacaaggaggaatttgtaaaattattatacaattaattttgaaagtaacttttccattcgaacatctctgtgattgcaagattctgatggataaggcaggagcattatttatctttccatacacatggaagaaattcatgttccccccctttgcagtcaaaatcacatttggatttggaatcacctctatccctttggagttaggtatgatcacatgatgtgttttgcaaataagaaaatgtaaaactaagtgatgcatgtccttttttgccaaagatttcagtcagggagaattcagaatattttcccccctctactttaaatgccaaaagccttctaggtaataggtttactatcaattatatcacagattttggtaacngaaacagactgaactattggtagaaatgtagcatcatcaaccaatcactattatttccagattctgggacttcggggtttgttagtcaagcacaaatgatactacagcaccacctcattcctagsaccaagttatgtactaagcaggatagtagagtgactagtatataacttgatgctaggaatgaggtggtgctggaagacatatttacatgatgtagagatggcttaattgttcattkgtgagtagtgagaaaaacatcagaagctggaaagatgaaaatccaggtcatgctgtggtaatttgtaaagtgttgtgtatagtaacttataaagtacagcataggcctgatgaaattgctgatctagaaaaaagttgttaataccacctgtggtagccaataaaaatttgatgcttacagcaatacatttcaggagagaagagtttatatgaaagcttgtgaagctgacagacaataaatataaaagcagagtttaagtcttaaattcaaaatatctatcagcctcgactaaaaaaaatactttataagccttaaaattattgttttctccccaaatgcttggggntaggtaatgggctctaggaaagcagataatgtcttttagttcataggttgctaggttaaataggcatatcttatatcattcagagagtctggagtttgagctcgatgtcatgattagaaggggttttgcatttcttgaggatatgctgtgtgtatctcgaaaatgtaaaggagattggactaaatagttggtgatcagaagtgtagacgcaaataaatattactatttttattatggtttttaactggttctcatacgggaacatggtaggatttaattcacctacctccctgaagtaacatgttttgtgctgatgaaatatgggtggaatgcatacatttatcaccagaccgaagctggaagaacctaacctaatttaattaccttttcttttagcttttgccttagaaacagtcaatgttgcagatgacttctgctttgtcagtatagattctaaagtgaggagaatgcagggcagatacaccagttaatctgtgatatatatgcagtatstgtagaaaataagcatggactgttttaaaccactgggttttgcaacacaacctagactattctagcaggtgcattcaattaaatttgaattaaagacagctttcntgattttgtcagtttatttttaaagatccttcaatcattagaagaacctgtaacaaagacagtgtgacagcagctttctatatcattgtaacatatttcttcttaaattattgcttgtatatcaatgtcatatagttcatttaaaaatgggaggcatatttataaagtgttttattgttcacataagagcattcaataaactggctatatgagttaatctatccagtctctgttaatgtcttcartgaatgtacctactatatactaggatctctagtcaataatattgagaatagagacagcagaaatgagcttatcttaaatatataaagttgtatcaaaagaatgatgagatttcttagataattaagttgaattatcacagttgacgtaaagattctggcttaaaaactgtttgagtgttgatgttattaatggggtagacacagttttttgcctaatacatataggactcagttctggtcatttaactttgaaattactctgagacaatcatgcagactggttaaacatccagttgtatgtgtaagtctgcagctntgaaaacaagttggtgctggtaatatacatttgagaatatgaaaatatatggcattcaaagtaatgggaatgagtgagatcaacttccttgacaaaacataagctatttttacataggatcaccaaagcaattcaattatgtgttgaaccntcatggttcatataatcatcaaactttttttagaatttcagacatatgtaatgataaaattttcattgttctctctaatgtcagatactctgaatttgtttatacgttgaggacaaattcttccaagagcatgcaatccacatagttaaatttaaaaagtaatgcaatcatttttagtggctggcaatacgtggtagcatttatgaggacagtgagccaatgatgcagaaataattgtagcctctatctctgtggtttgatgtcaaacaattcattagtgatatgaactttctaaaantgattttcctccctaattatttttgcttgaaactcatttcatatttgtcatattttaaaaactgtaacataaatctttaagtaggaaaaataagtatatgaccatcacttcaaaatttgaagtgctctaaatttttgaaatcaattttaaatctgttatctctcagggatataggatgtgaggtttctttacntcagtagatttattctagttatcttaaaataaaaccacactacttggacaatayaattaataagaggactgctcagtttaaagtaagcaatgactccaaataatcaataatgtacaataacaaaagtctaatgctcacttatatgacatgctcaatgtggatgaactgtagctttcctcaaagacctattcattatggagcagattaaattaaacagcttttgtctttattattgtcagtttccaagtagaatgaacagaaatgtggtggactcataatggctcttaaaacttctgcttatatgctaaacttgtaacttcctgttacatttcacaggccaatcaagttacatgatcatgctccactttgacatgttgaagatataaaacattccctctgagagaaatgcccagagagggaacacagcgatttgaacatttataaccttgtgaggttaaacaaagtctctttgcatcaaaaatacttactccaaaattcatgtgctaaagttcattcactttaattatgtaaggagcctcaattttttatgcaaagtttattaatgtgtttgttcagttggaataattgtagctgcctggcttctaagccagataagtgagacctgtaacaggcaaataccgggacaaaactaaaacagtaagaaccagcagctttgagaacatacactcatcaggtagaagtcagtagctcccaggtatatgaacatttataatgctttgtaaagcaaggcttaacatggacatacttcttctgttcatattccattggctgaagcaaaccaaaaagctaagtccaatgtccaccagccctccctttctaataaagaggagggatagaacaaatatttgctaaaataacctaatttgtcaccaattttcagtttccaagaacaatttaaattatctttcatttttgaataggcatatatttntttaaaaattgaatcaataattaataatctatcaaaacagtagtaccaggaccagatggattaattggtgaattctactacatatttaaggaagaaatcacacccattctctacaatcattttgtacaatatttcctaactcactctatgatgccaacattaccctgacaccaaaaacagagggcttataaaaaaagtaaatcacaaaccaaaatccctcaaaaatatagatgtaacaattctcaacaacatattagcatatgaatttaacactgtataaaaagaagtatcctttgcaaccacgtgggatttatcctacttgtgcaagcctagtccaacatttaaaaagcaattaatgtggttcatcacatcaccaggataaagtaaagaaaatcacacaattttatcarcagatacagagaaatcatttgacaaaatccaacactcctccataataaaagtctcaataaagtaggaatagagggggaacttcctcaacttcatcaataatatctccgaaagacctacaggtcacgtcatttttaatggtgaaaaactcaaaactttcccagcaagatcagaaagaaggaaaggatgtttagtctcaccactgctgtgtggcatcttactggaagttctagctaatgtgaaaaaaaggaaataaagagtttacagataggcaaggaaaaattaaaagtctttgaagatggcatgtttgtctatgtagaatatctgaaataattggnctggaaaaacccaaggaaacaaacagtaaaagaaaacagaaagaacccctggaattatgatggatttgcagcaaggtttcaggatacmaggttaatatatgaaagtcagtcatgttactatattgtatatcctactaatgaataagagcaattcaaaattatatataaaacaatcatgtgtaattgttatttatgcatattcacattatttatatttatttatttgtatttatgtaattttcattactaataaaaattaaaatacttaggtataaatctaacaaaacatttacataaccagcatgaggaaaactaaaatactctggatgtgaaagaaactaaagaactaaatatatggagagatactttatgttagtggataggaagattcagtattttcaagatgtcaattccttccaaatagatgtacagatgtaatgcaatccctactaaaatcccagcaagttattttgtgcatattagcaaactgtttctaaagtatatatgaagaggcaaaagatccagcctagctaaaacaatattgacaaataagaaccaggttgaagaactgacgtcaccttacttcaaggattcctctatagctanagcaagcaagaaaatgtgatattagtgaaagaaaaaacaaatgtatcaatgatacagaattgaaaacccacaaataaagttatctaaatacagtcaactgatctttgacaaaggaacaaaggcaacataatgtagaaaatatagtcttttcatcaaatagtgctggagcaactagacatccacatgcaaaaaaaaaaaaaaaaaggatttagactcatcttacacatttcacacaaattaactcaaaataaatatcagacctaaatgtaaaactataaactacactaaaactataaacaaaactatagaactcttawggtataacaacaaaatcttcatgaccttggatttggcaaagatcttttgaaaaaaaattaataagatggaattcattaaaattaaaatttctactataygaaaataagtaccaaactggtgccaagaaaataaaaagacaagaaacaaactggaaaaaatatttgcaaaagtcttatctgataaaagacatatatgtatgtaatatatatttataaaatatacaaagaactcttaaaatttatcatacttgtgcaagactagtccaacatttaaaaagtaattaatgtggttcatcacatcaccaggataaagtaaaacaaatcacatagttttatcaatagatacagaaaaattaaaagccaaacaacccttttacaaaatgggccaaagaacttaacagacacttcactagaaaagatatacaaatggcgaataaatatacaaaaagagactctacattatatgtcatcaggaaaatgataatgcgatattactgtgaaccttatagaaaaaccaaaatccagaacactgacatcatatgctgggaagatgtggaaaaacaggaactctcattcattgcttttaggaatgcaaaatggtaaagccatttggaaggcaatttgatggtttctcacgaaactaaatatattcttaccatacagtacagcagtcatgctccttggtatctactcaaatgagytgaaaacttatgtccacacataaatctgcataaagatgtttatggcagctgcatccacaattgccagtacttgcaaacaaccaagatgtctttcagtaggtgaatggacaaactgttacacagggacagtggaatgttattcagcactaaagagaaataagctattaacccatgaaaagacattcagggaatttaaatgtgcattactaagtgaaaaaatgcaatctgaaaaggttgcatactatgatttcaaccatatgaytttctgggaaggcaaaacaatgatgacagctaaaagattagtggttgscagtggggatggggtgtgaagcacagaggatttttagtgcagtgaaaacactgtgcataataytataatgttagatatatgtcattataaatttgtccaaacttatagaacgtacaacaccatgagtgaaccccattgtaaactgtggactgtggggattatgatgtgtcattgtagatatatccgytgtaaaaaatgtaccatactggtgagagatgttgataataggggatgctatgcatgtgtaaaggcaaagagtaccttggaaatctctggtccttctcttcaacattgctgtgaacctaaaactgctctaaaatgaagcctattataaaataacgcaaaacaaaacaaattgattttaataatttatgcctgagtaacaggcttccattttggcttgaaatagtaattcttaattaaatataaaccttgaaaaacagcataagtattaatatctgtcataaaaatagagcttaaaagacaatgaaggataaatcctctaataagcaaaagaaaaattacacaggaaaaactacatatccaaaaatcacttcccrtactttgtcctctacgctgacatatatatatgcatacagctgactcatgaacaccattggtttgaaatgcatgggtccacctataaatggattttcttccacctctaccacccctgagacaacaaccaaaccctcatcttcctcttcctcagcctacttagcatgaagatgatgaggataaagaccttcatgattatccatttccacttaatgaacagtaaatataatttttcttccttataattttcttaataatattgtcttttctctagcttactttgagaataccatatataatacatattatatgctttataatggttaataatgctgtaattatatagatgcagtatgtgttaattgattctatgttattggtaaggcttccagtcaacagtaagctattagtaatcaagcttttggggaatcaaaagttatatgtgggcttcaggatggctgactagaggcacctgacatttgcttcctatacaaggaaggattgaatcacaaagcagatagatgatcacaggttggatagggcatctaggagagaacactgaaattgagcaggaaagtggcatgaaagctctgaatcatgaaaggtgaagaaagtaaagcaagaagcccaaccaagtgtggggaaaaggtaagcaagagtttcccaatggtacacattttcaccatggactcctctaatcctagccctgggatagcccctcagccctcatgggccccaagactagtataaggagctgcctggagtccacacgatgacattattccagagagggagttcacattgcgttccacacatctcttaagactcaaattagctgctgcactgctccattttgagagctcagtccccaytaaattatatcctgccttggggcccaacaacccctgcatctccacattcctagagccccactgacatcccctcatatccacctagaaagctatggcaacatggcaccagatggacatagcagctcggatgtttcttcagcacccagcctatgcagtatcctgtgtcccaggaaacaggagggtggtgtagtgcatgagggaggctgctgccaggacaaagagagttaaagtacacactcccacaagcctgagagctgcctgtttgcagccactgcaacattgcaccattgacctccctancaacaggctgctccaaacctgcatgctccagggtgtctggggactggccaaattggacactatcctggggcctgaagacaggcctggctcacacaacaatactactccacaagtggccaaacatgctgttcaggagcttaaggatcaatccacctggcctgccacagctaataagctgggaactatcaggggcctgaggactggcccacctggtcaccagagccaccagcctctatgaggattgtgcaggaactggaggattgacccacccatctgtctgtccctggtacccacatataccatcaggaaaacctgacagcagatccaccccacccacggccattaactgtgtgcatcatccatgggcctgggaactggtctgcactgcccaccactgccactgctggatgtgagcacactgtttggaggcctgtttcacccaccatagcctatgcctgcagataacattggggagaactgaagacaggcccacccaagctgggaccaccttttccagtgtctgtgcacattatccagggggctgaagccacaagaattcatgcataacttccaggaggctagggactggcctattcatgctgtcagggccctatacaatgtccaggggtatggagataaaccagccacaacctgtgtccatgcacaccatcagggggcctgagaacaggtccatacaaactggcactgcccctaccaatgcttgcatgcatcatttaagggtgtaaggattgacccctccatccactaccaccagtacctataaatgcattctagggggcctgagaatgggaccttagcctactgatgactgcacacattgtctagtgctctgaggattcacttgttccatctgtcaccaccagtgcctgcatgtgcctcttgaaagcctgaggatggcccctcccagcctgccaccwccacagttaacagcactcatttgcatatgccaacttggggcctcaggactggcccattcatccagttgccaccactgctgacacctgtgcatgctaccagaggtcttaagggttggcccayagacaggactggcatgaacaccccaaagcaagaggcctgagtacccacctgcctamccagctgaatactgtcactgtaagcacatgagaagccaccaagaggcccaagaatcatcctacctggaatataccacctgggtgcctgcatacaccacctgggcacccaatgactggcacacatggcctgctgctgacactactgatgtctaagcattacccacctgatgttctaatttccagtaaagcctcaccacagccttcacctacaartgcagcctaagcctctgagtaccacayagacaatacggatgctgattacagcataaatcatacagagactacaatactgcacccaccaagaatcaaaggcaaagtgccctgcccaacaaacactacagggacatctacaggaaaaaatttttgccatgaaagccaatccataaaattagaagaagcaactgttacatcagatctgcagatatcagcatattgaggcaagaaacatgataaaatgagaaatcatgacaagaaatgtagtaattctctggcaacagatctcaatgaaaaagaaatctatgaaatccctaaaaataaattcaagataatattaaagaagcttagtgagacataaaagagcacaaaaaatacaaataaatcagaaaaacatttgtaatctaaattagaaatttaacaaaaagatagatataataaaaaagatttaaactgaagaactcaattaattaaataaaaatacaatggagagcttccacaatagactagatcaagcagaagaaagaatttctaaacttgaagacatgtcttttgaaataacacagacagacaaaaagaaaagaataaagaagaatgaagagagcctgcctgacatatggggcatcataaagcaaccaaatattcaaaatttgagtgttccagaagggagacaaaaaaaagcatagaaactccacctaatgaactaatagctgaaatttcccatcttgcaagatatagacatccagatacaggagcttaaagatgcccaaatatatccaaccaaaaagatattatttaagacatgttgtaatcacactgtcaaaaatcaaagacagagagaatactaaaaaaacagcaagagaaaagcatcaagtcacatataaaggaatcttcatcaaacagctaagttctcagcagaaaccattaagtacaggagagaataggataatgtattaaaagtactgacaatcaagaataccatatgtagcaaagtcatcctccaaaaatcaaggacaaataaggcatttcccagataagcaaaaactgaaagaaatcattaccacaagactgatcctacaagaaatgcttaagagagtcctacatctgaaagcaaaaggataatatctaccaccatgaaaatacaaaaaagtataaaactcatgggtggagcagacacaataagaaagggagggactcaaatgttaccgctacagaaaaccaccaaactgcaatgatagtaagaaaaaaaagaaaggatcaaaggacatacaaaataatagaataacagttataaaaatcacaggaataagttgtatcctataaataacaacctacaatataaagagattaaatttttcatttataagatacaaattggctgattaggttacaaacttgacccaactatgtgttgcctacaagaaactcattttatctgtaaaaacatatatagactgaaaatgaagagatgaaaagatattccatacaaacgaaaaccaaaagaagacaggattagctaagttagttaaatttgaaaataaaaaacttaaaaagagacaaagaaggtcattatataatgatgaaaaggccaatccagcaagaggatataacaattctaaatatatatacactaacaacaaacacctaacaacactatatagtgtgtgtgtatgtgtgtgtaagtgtgtgtgtatgtgtgtgtatatatatataatatagatataatatataatataatgtataatatataatataatataatatataatatataacataatatatattatatatacataatattatatatatatatatatacagaaatttcctctggacgtacacaacctactaatattgggtcagaaagaaatagaaagtttgaagaccaataatgagtaacaaaactgaatcagtaataaaacatctctcaacaaagaaaagcccagcactgagttgctatactggtgaattccatcaaacttgtaaataagaactaatgataatttttctcatactattccaaaaattctaaaagaaaggaattcttcataacattccattgtccagctttatcctgaaaccaaaccatatgatcacacatgcacacatccccccacacacacgtgcacttgcgtgcacacacacacacacgcaaatagtactacaggccaatattcctgatgaacaaagacacaaacatcttcagaaaagtcctagcaaataaaatcttacaacacatcaaaaagataataccctatgatttagtaggatttattccaggaataaatgtatacttcaatatatgcaaatcaataaatatgatatatcatatcaacagattgaaggataaaatgcatatgattactgtaatagatacagataaaacatttaatacaatgcacaatccctttatgattaaaaaaaagaaacctctcaacaaattaggtatgtaatgaacatacctcaacataaagggcatatatgacaaaccttcagctgacatcattctgaatggggaagaaaacgacagccttttatctaagaactggaacaagacaaggatacccattcttattcaacatagtacaggaaatcctattcagagcaatcaggaaagaaaaagaagaaaaaaaaaaagggcatccaaattggaaatgtggaagttaagttgtcctttgtagatgacataatcttatatatgtaataacatgaaaacaccaccaaaaatattttagaactgataaataaattcagtaaactttcagaatacaaaatcaacatatgaaaatcagtagcatttttatacaccaatgagaaactggctgaaaactaaatcaataattttatctcatttacaataggtaccaaaaaaaattgaataaatttaaccaggaagggkaaagaactttacaaggaaaactgcaaaactctgatgaaagaaattgaagaggacacaaacaaatggaaagacatctgatgctaatggattagaagaattaatattgttaaaatatccacaccaccccacccaaagcaatctacaaattcaatacattccctatcaaaacaccaatgacgttctttacaaaatagaaaaacaatcttaaaatctatatggaaccacaaaagaccgtgtatagacaaagcaatactgagcaaaaagaaacaaagctggaggcatcacacttcctgacttacaatatacttcaaagctatagtaaccaaaacagcattgcattggtacaagaatagaaatagacctatggaacatagaacccagatataaatccttgcatttatagtcaactgattgtcttcaaagwtgccaacaatatacattgaagaaaagacaacttctttaataaatgatgctaaaaatactggatatctatatgcagaagaatgtrattagaccccatcttttatcaaacactaaaactcaactgaaaattgattggaaacttatatgctaagaccccaaaccataaactactaaaagaaaacataggagaaaagattcagaacattaggcaaaaaattcataactaagacctcaaaagtataggtagcaaaaacaaaaatacacaaatgggaacatattaaaataatcagcttctgcataacacaggaaataacagagtgaagaggcaaaagagtggaagaaaatatttgcacactattcctctgacgagggactaatattcagaactaaataagcaactaaaatacctcaattcccagaagcataaaaacaagcaaacaaatcattccatggaaaattgggcaaataatctgagtagatatttctctaaagaagacatacaaatggccaacagatatataacaaagtggtcaacatcactaacataagggaaatacaaatcaaagctayaattagatattawcttaccctggtatgaatggctattatggaaagacaaaggcaaaacaaatgctggtgaggctgcagatcaaaggaaattcttatacactatcagtggaaatgaaattagtacagacattatggaaaacaatagagagtgtctcaraaaacaaaaatagaatttttataaattccagacttccaccctgggtatttatccaatggaaaacaaatcagtatatcaaagggatacctgcatcctcatgattattgcaacactattcacaataaccaagctatagaatcaactatttgcagcaacatagatggaactagaagtcattatattaactgaaaaacgccaggcattgaaagacaaatactgcatgttctcattcatgtgtgggggtttaaaaagaagtttaacactttaaaaagttaatctcatgaaggtacagagtataatatttagcagaggctgggaacaacagtgaaggaatgaagaggggttagttaatgggtagaaacatagagttagataacagaagtagcttctactgtgtgacagcatagtagggtgactataattaacaattaacatatattgtatatttcaaaatagctagaagaaaggatttgaaatgcttccaacacaaataaatggtaagtgtttaaggtgatggatattctaaatactgttttgatcatttcacatttcatgtacatatcaatatagcacatgcaccccgtaaatatgtatagttattagatatcaataaaaattgttttaaaatatgactacatggtgggttggcacctctgcattgttcaagggtcaagtgtgtgtgtgtgtgtgtgtgtgtgtgtgtgtgtatgtgtgtgtgtgtgtttgcataaataaaagaccagtaatgttttaggctgtacttctaaataaaatttacacataatttcctagaaataaaatttttcatataaaagagcattattcagataaaaactttctttggtaaatactttgacaaaatcaatttatatgttaatttttacatttttttcaatagaaacrgcataattgatattaaccaaattgttattgcaatataaaaagaaacattttgtatgatacaaaaacaggatatgtgtgtatgcatacatatatatgtatatacatatagttttacttaacaaagaactaattttaaataatttagtttataaayaaataaaattgatacaatataaaacatttcaatttcttagataaataaaattcagwtaaatttaaaaggcgaaaaatttatatgatctgaagagaaaccatagtataattcagttaaaatttaaacatttaaaccttgttaaaactcatatttcttgagattcactgtgcgctgtcaattttattcatagtgaaaattcttgctattctacaaaatactgaacacattttgattgtataaaaattattttctatagattntctacttatctgagcaatctgaaggttacttattagtaaaataacatttgcttactgagaaaatccttgtcyattctgaataaaatatgcaaatatacattctatttgctaatctactaccttatttatctttgtttgtttgtttgtttgagacagggtctccctctgtcacccaggttccagcatagctgngactacagacacacccctccatgccctgctaatttttttttcttttggagagatgggatttccgccatgttgcccaggctcgtcttgaagccctgggctcaagtgatccttctgccttggtttccaaaagtgtttattctacaagcctgagccaccaagtctggcctaaaatcttctaatggaaattctcagacctatttttttccattttcctgaattaatcaagcttaacatgtgattctttcggcaattttcttccttgtgtcttcaaaaacagctctgtttacgtaggaaacctgcatttggcattttgtacttctctgtgtatctgtgtctgcattttcacaccactatatctaattatttatatcagttcatcttttactttggttttatttctgtacttttacttttagacaagttctttgttttaataaagtttagtgacaaatttaggtttttatactacaaaaaccycatcaaatgaatgtcaagtggttgctgttttttcttatactttaatttttattgctgtaatcaggatgagcagtattttggagacagctgttcatcttaagaatttactgtgaaagtggctaaaatacggttttaaaaagaagcaatattacaaaaaaaggtttctgtgaaaaactgtagtaaatgcatattgggcaaattcaaacaaattccagattaaatgcttgaacgaaaaagcttttttgttttcatcaacttaaatgtaggataaagtaattataactcaaattttaattataatcagttaaaatttagaagtaaattcttggtttaactaacatcatttgccttgcctactcactattttaagattcattttcttttaagaggaagaaacattaatgaagggaatattaaggtttcaaatgtagggtttcagataactcccatctgtataattatggaaatgaataaattatcacgatgatagtttatcctttttaagatgttgtaaaactgactaaaaagtggaagttatgataactaaactccctgatgaagccactgagacatcaatttagtcatcagaagctcttatatgctcagctaattatcatattttcctctctttgtgctttcagtacaactaaaggactgaaaagagcagatcaagtacaatcctgtggctaattgaatatatgtctcaatcatttagtagttaatttctttctgatttattttgtccaaaattactgcagaaagggcagttctcaagaatttattcaaaatcagcacttttctaacaagtgaaagtcaaatgaaaatttttagaaatgttaagagtgtataatacatccctattccacatgaaggtttcgttcaggaaaacaatgttagtcttgaaaataagcaaattgaaagaaaaaagcatatatcaaattagaagtttgtctattgcattattctggcgtggagaatggcatacagcttttgcatatcagattaagaaactttgatcttactctggttttacgtgtttgcactcacagctttatttttgacttctacaaaagttaattaaagcttattatatgctctgtggtgtactacatgataaaacaaaacaaaagtaacactaggtcattatcctcagctccatatagattaaacaaccaatgcataatacaagataatgtgccctcataaagtgtgagaggaacacatatcaaactcaaatcgagggattattgattatgaaaattattttttatttaaaattacatggcccttgatacgactaatggacaaatatttgttactctggggaatatcacgtggcctttactccactctgtcagagaaagcaacatataaaggtgctgaatgaataagaaacattgagataaaacaacggacactgttaaaacaatattttaaaaattaaatttaaatattaaaggttaataaccaaaattaaaatatatgcacaagtatataaatatatattactctctatgtaaactgtttttaaatttttttctaacatctttcagagaagagcattgccatgaaatatttataactttatatacacagaatgttttaggatcattttgctattaatagcataacacaaattgaaatacctgttactttttagggcttaaatcttataactgtcctatttagtaaatcatatacacacaggaaatcataaaaacagttctgaacagtatactgaatgcttagtcacaatcctgttaagtagaaggcgaaatatgttaaaataaatgtatttgttgttatactttcagtgtataataaaacatcaaatgtaatgtaacaattcttatggactattatgcaccaacattttatgcattttttatttaaccctttcaaaacagttataaggggattttagtgtagcataaataaatcatgtagacatatgattataataaatttcactagtatcgtatgcttattcagggaaaggaaatatattttcttgaattatcataaaatgtcttttgagacaaattcagaaaaaaaagtattgcgatggcttgaagtatttgcatggaactttagtcctcaataatttttaaatttagatgaataaaaaatattttattcattttttaatttatagagtttgttttagtaatttagtaccaaatattttatcaaattactatgtacttaaggaatccaaaaaatatatctcatatgcattttaatggacctttagtacttttatttggggatttaaataatgtcagtaggggacttaaggtgacttttgtctcataaaattctgaggtaaacatttctctcatttgtccatataaattaacttcacatcctcgggtactattgctatacattcttttacattcctgtgcattaagacatatttttaattgatagttttatgagatgtggaaaaatacattgactattttggacaaagaaaattcaaaaatatatcttagggatacaaattggattgaattaatgtaataaagctattactgttgtatacaaacaaatttttttaaaaaattatattgttactgattgcaacctttcaagcttgtcaaaatagtaatcactaaaaagataaatgaagcaaaaattcttattgtgtaagaattttatgatatatttaaacttttttttcttaaatggatagaaaacaaattaacagtttttaaaaataactctattttcttttccttttcaggtgacacaatcatctactattcatgatgttaagcaaaagtttcacaaagcatgtaagttttatatattatttagaatttacatcataatgttttattttcaaataggtttaaatttttctataagtgcaatatatgatagagtgtatgaaaaccatagttctacaaggagctcaggaacaatagtttgctttatatttctttggcataaatattctagcatttaactctaattgatcctttaatctccagcatttccaatttttcttcacaaagttgtttttaatttatatttaaacttaattttattataacaggaaactttctatatgttataaagacacatgcacatgtatgtttattgtggcactattcacaatagcaaagaatttcaaccaaaccaaatgtccaacaaagatagactggattaagaaaatgtggcacatacacaccatggaatactatgcagccataaaaaaggatgagttcatgtcctttgtagggacatggatgaagctggaaaccatcattctcagcaaactattgcaaggacaaaaaaccaaacaccgcatgttctcactcataggtgggaattgaacaatgagaacacatggacacaggaaggggaacatcacacaccggggcctgtggtggggtggggggagcggggagggatagcattaggagatatacctaattctaaatgacgggttaatgggtgcagcacaccaacatggcacatgtatacatatgtaacaaacctgcacgttgtgcacatgtaccctaaaacttaaagtataataataataaaaagaatttctggaaaaaaaaagaaaacattaaaaaagaatctatgaataaaaaccttcccataaagaaaaaaaagaatatagaaataaattgcaaatggtgaatgtacctaaaatttataaacatttgagtacaatctatttaaaattcgtaatgaaaaggaaagcctacacaggaaggaatagaattgcttgaaatatgcttactcagtttaaaattcttgaggaaggtgatattttttattttgctataaagtcatataggaattggttatgttgaacagtgccagaagagcactataataagggacaaagaacaaaaccaaaaagataaatatatatatatatatatatatatatatatgtatctactatatacatatatatatatgtatctactatatactatactatagtatagtagatatatatatatctactatatactgtatacatatagtgtgtatgtatagtatatatatagtgtatatagtatatataagtatttttggtgtatttctacttaaaataaatttattttaatagttatttctatcttagcataaaacatggatctcattaagctagtaattgaattgccacctttgtggcattacactgacttagaccaattctatctaataaagtgtctccagacagtttagattacagtagtaagtaggaagacatttgaaaatgactttttaatataaagtagaaaggtgtaacaagaagattgtatgtaaaacaataataacaaagtcttatttctattgttggaaaatgggtacatgaatcaaagtcgagtttatgtgtaaaagaatgtgcagtcaccctgacaaaaaagtattatttttataataatttatgtcaactaatagacataacaattacttgaaatcttaaacttttaaaggaacgcgttttctatttatgtgatttagagcctgcttctaatacttaggaaactgaagttaagtaagcagcttacaaaaaatcctagaaatgtcctgttgcaaaagtagatagctgacaatatgacaatagtatagttagtttcaatagttatatcagggcaagaattattgatagctattattttattttcctttgtaagtactaatctttaacagctttacttaaatagtgacttttttcactttttcaaaattatctttattttaatattatttcaatcatctaaaatataaaaataatatttcagcattttcccatatatcatagtgtatttcaaaattttattgatctttaggttttacaaattgaagacacacaaaaacactttttgctgcattacattatataaagtatttaaaagaatgtatttgccaatttttgaaagacattgaaaaacattgctaatcctgaaaaatctgtaaacatatggacattagtaaaaagaacttctctcttaattgccttaggatcttatatttttagcatattttaaaactagataacattggatacttattaaagtacataaatatataccaaagagattaatcatatacttacaaagccacatttgtcaggttttaaaaaactttactttttgacaccaaattaatttttatgacatttctgacattgtttgttttcaggccctggaatgggaatttaatcttgggaagaaaaaaaaaatatgttatcagaagacattatttcctgaaggcagaattcttgttatatgtcttttatctctatcttttgttctcgttttgattaatcctgatattttgtcttcctacgttttctcagacttatcagctttacatttttctttgttttattttagaactttttttactgtaatatgtcttttctwtacagtgacaatcttaatgttcttccaaggtttgtaatttttaagttctgctttgttataagaataatctcttagtttactctagtaatgccacagtaatcagactggtgaagaaatagaaagagagaaaaccactcttcatgtgttagctgctaaggcaaggagagaggaatgtttttcatgaaaacagaagcatataaaactacaaattagatctatgcatacacatacaaacaaataatttcactcatttcttatgcttttctcatttaatgcagctaaaatgcatgaaatgtccccagctgcaaatcctcagttggtctttctttatcttgatctatttgtttcttaacacttgtaattattgttcttgtttgcatcttcaagtctcttctagagagcttaagaaattttcacgctaatgtacctttatatcatgctctattcatgttcatctgctcacaagtattccatagaggaattgtacattattttaaaaacctagctgaaaaataaagaattattagtcccagtgacactctgaccaaaactgtgtaaatattttttaacattttaaagatattttaaaaactactgtgtgtctctattatttattctagcagagtaataccactctatttctatcgtcacccaattcaacaagtaacccacttttctcttgggataaaatatgactttattagaacatgttgaaaaataaaatcatagcaaattacacttaaggacataattggtggttattagctactcataaattgggcagtatcttatctagatatagatgtaagtagaaacgaacttcaataagcatgacgggacagaacagttgattttataaagtggctagctggagcaggaatgagaaaaatgtttctgcctgcaaagaaaagtgaaaaattcctatagtctgggtttccacagaaaagcagatgaatgtgatattttgcattaataaaataaaatatatatttatgtaaatactttgaaaaattgataaagcgaaggtctgcttaatatgttctataggaactgcagcacgaattattgtaagccaggaaatctctaacagagattcggaaataccactgtatgaacatgtgtaaaggtagcattttgtataaaaactgtttgtaaaattatttctaattatttattatttaattgtttattataattatttggttttgattaaatgtaattaattgtaattgtgattgttttacaatttagttataattataatttaattaattataatgataaggtaattgtattttattattgaattgaatttataatttacaatgtaaattacaatataattaatgtaaaaataattatgtattattattactaggtttgtagtaaaaagtgctttgttttcacaagataagatgccctaaatggcactccaaatagcatatacagtttctacagccatccatcagttataatggatgaccacttctgtgattattcaatgtgggtaaacaccacaattacaattaaaatcacaggcttgaagttgggtgaaaaaaatagtgtgtgaaaatattgaatgaggttcaattttcatgcagcagcaaatcatgccctttattaaatattttcaaaattatatcaaaacatattttcaaagcttacttcaaagctcatacaaaatgtacagtatgaactatgtgatattttagtttagattagcatattactaagcacatgattaatagttttctttctggataattcatcataaatatcatggatccttacttgagataaaagttttattacatgttttggcaatttttaagtagtaaatactttttagggtttctagatcacatttctttctatattatcaaaattgtttaggataactaaagattaaatagagggaaccatcagaaataacacccttatgaaattaggatgatattactggaatttttctactcactgattttgtgtggactagtaacatattagtcaaattgataaaaattatttgcatttaagataataactggagataataatgaaaaggtaaagatatgaaaaaaactttctgcttgtgaaatttattttgttattgcttttccttcttttctcaaatctaaatgtctctgagaaattattagcctcctgtgcttatcaaatattatccctcagaaacaactctcttagctttcactggcattcttcgcctggtgaaatctactttttttttggagaatctatttctaaaacctacaaagtttatctccaaaaaattgtcttctcatacttaacatccatatttcctcttcaaatgaatttctatttgttaaatttcttattttctaccaatgttatagcatcggtatttcttggtttcttgaccatttgaactacctttaaaacatttttctttaagtttaaattgtctcttatgcaaagtattcctatacctttctccatgtttgttcacatctttttttataccagtaagaatcatctttctctgtttaaaaccctccacttaattatcaagatatatatgcctttgggctaagaaaattttcctcactcyttcaatctgtactctcattttttctatataatttaaatattatagttaatcacaatgtgtagcacttgttgtcaaatacaatgtcttataacatcactacatgtcctactctactttgcattaacatttataatactaktaataaaaacaattaacttttttcaaaatttattatgtgccacggacctaaaatatttctattgtagcacagttttaaaataattgtgacaatactatgatcatttaggtacaattataatttttatctttcagataaaaatctttaaagaaatattatataacttgccccaggtcacgcagctaataagtgacaaagatggaatttaatctcaggcagtgtgactctgtaccctgtactatgaccactaacctccattccctctattttcctgaaaaaatctcattaatttcttcaggcagaagtccccgtagtacccagttattttacttgagaaaggttatttattaatccttattttcaaatagaaaactacaaagttcattttagaaattatgtaatgaataataacacagtaaatctgaacatagttcacaattggttacaataactgaaatccctgtctaaggtcatatggcagtgtaaaaaaactactaaattattaataaaaacaacagctaatatgaatatagaggaagagtgaaaatatggcttaaaattgctaacgaaatattctcctttgagattgttctaaaaatagtaatatataaattgaaagagtcaatgaatgattaacagctgaagcataatttgtacactgactctgtgtcataaacatttctgaacaaaaaaagcaaaatcattttgcccatgactttcgtgttatctattagttgaaaacaccatacaaagttttagtgatgtttattatctatcagactacttgtctaagcagttcccagaaagaaccatggggaacaaagcaaggtaagaaacaatgaaattagcaggacaattgtagtttcagccacaagaaagggtatataatttattgtgacagttggaatgcatataaatctttgccaaaatgctgggggatacaaataatgctaaactttgaaaggttcaaggatagtaactaactcaggacaaagatagcagagcaggaggatttatcacatatagtagaaaataatgagtgttctctgagcaatttggaagcagtcccctggacaaggctgtggaattccctgaactcttaacaaaaaaagccagaaaaatgataaatgcacccaatgaaaaaagtggcagaatactttaaaaaaataaaatttcctctactgctacctcaaaaagtacctaagattctccctctagtttgttgggttaaaaaacaattatgagggctgggcacagtggctcatgcctgtaatcccagcactttcggaggccaaggcgggcggatcatgaggtcaggagtttgagaccagcctggtcaacagggcgaaaccccgtctctactaaaaatacaaaaattagctaggtgtggtggtggcgtgcccctgtaatccmagctactaaggaggctgaggcaggagaatcacttgaatctggtaggcagaggttgcagtgagccaagatcgtgccattgcactccagcctgggcgacaacagcaagactctgtctcaaacaaacaaacaaaaaaagaaaacaaacaaacaaacagttatgagccttgtcaacattttagatggagaaatagggtaatttgccaaattattcatgaattcattttttggtaacatggtaacattttttggtaacagacatggttacattttatgaaagctatatacacaagtggacattctaagaaccttctaggaactttagtcaggaaggtccaataagcccttttattattgggcagcaatatcaccagctttttcatagtatatgtggctttcaagattgagattaacactaccaggttaataaaacctggtagcgttgatgccctggttatggaggaaatcctaacaaatgtgcccactggagacaaagaaactaaattatgaactcccttcccacagttgagcataacaaaagagatacatcagcatcttccgtggaattgaaataaatatttcagcaagagtgaaagcatttttgtgaatcatattttaccaatttacaactgaaaaaattttaaaaatttctactctttatttagcatactacatacattcttaaacaattttataccatatactgttattattcttcaattttagacaaaagatcattatgattttgaaggtattattatttggtaacaaaaaatttcttattcggcattaaaaattgactactcagtgtgattgcaataaaatactggtcaaatttatttcgctgtatatttaatgtcattgatattcatataagtgatgagaattttatgtgatatatgacactttttgtatttgtattttgtgttggttttttgcccacatacatgcacaaattgaaagacattctggaatgtattaatgattgcattagttttaaaattataagaattttattttattattttattcaacttttaggttcagggggtgcatgtgcaggtttgttacatgagtaaattgcttgttgttggggttggtgtacaaatgattttattacccatgttgtgaacatagtaacgaataggtagttttctgaccctcacctccttcaaacctccaccctcaagcaggctccagtgtctattgttcctctcttagtatccatgtgtacttagtgctttgctcccacttataagtgagaacacacagtatttggttttctgttcctatgttaatttacacatgataatggcctccagctccatccatgttgatgcaaaggacataattttattcttttttatggctgcatagtactccatggcattatatgtaccatattttctttaaccagtccactgttgatgagcttctaggttgatttcataactttgctattgtgaatagtgctgcagtgaacatgagtacatgtgtctctttggtagaatgacttatattccttcrggcatatacatagtaacggtattgctgggccaaacgatagttctgttgtaaattcattgggaaatctccaactgtgactgaaccaatttacaccaccaccaatagtgtataagtgtcccctgttctctacaacttgccaacatctgttatatggtgactttttaacaatagccattttgactggtgtgagattgttaattcattgtggttttgatttgcatctctctaatgattagtgacactgagcttttttcatatgcatgtgtatcatcttttacatgtctattaacgttattttcccatttttaatgcagtcgtttgttatatgcttattcaattgtttaagttcctgctaggagctggatactagacctttgtcagatgcatagtttgcaaatattttctcccattctgtaggttgttcattcacttcattgatagtttcttttgctttgcagaagctctttagtttaattagatcagatttgttaatcattgcttttgttgcaattgcttttggcatctttgtcatgaaatctttcccggttcctgtgtctggaatggtattaccctatcttgtcttccagagtttttacagtctgggttttacatttcagtctttaatccatctttacatttaagtatttaattcaccaaatcaagttgaattttgtgtatagtgcaagaaggatgcccagtttcaatcttctgcatgtagctagccagttatccatgtgccgtttattgaatggggagtccttttcttcattccttgttattgaccactttgccaaagatcagattattgtatttgtgtggctttttttctgggctccctattctgttccattgatctatgtgtctgtttttgtactagtaccatactgttttgattactattgccttgtagtagagtttgaagttaggtaatgtgatgcttccagctttatttgtttgcttaggattcctttggctgtttgggatctttattggttttacataaattttagaatagttttattattctaattctgtgaaaacatgtcattggtagtttgacatgaataacattgagtctgtacatcgctttggtctgtatggccattttaacaatattgattctttttatacatgagcatgtaatttttttttgtttcttggtgtcatctctaattgccttcagcagtgttttgtaattcttattgtagacatcatctacctctccgattagctatagtcccaggtatttatatttttgttgctattgtgaatgagattgtatttttgttttggctctcagctttagtactattggtgtgtagaaatgttactgattattgtacattggttttgtattgtaaaatttgctgaggtggtttattaattctaggagcctttgagcccagactatggagttttccygatacagaatcatatcctctatgaagagagatagtttgacttcctctcttcctatttagatgccttttttcctttattttgcctaattgctctggctaggacttccagtactgtgttgaataggaatggtaagagtcggactctttgtcttgtttacggtatcgggtggaatgcttccaggtttcacctgtttagtacgatgttggcaaacatggttttcattattttgaggtatgttccttttatgtatagttttttttttttttaacatgaagcaatactgaatttaacgaaaagcctttttgcrtctattgagatgatcatgtgagttttggttttagttctgtttatatgataaattgcatttattgacttgtgtaccttgaaccacctgttcaatatcctgtgaagcttattttattatggccaattctgatgtgctgctgaattcagtttgttactgttttgtcgacaattttgaacatatcttcatcggggttattgtcctcaggttttcttattttgttatgtctctgccagattttggtatcrgaataatgctggcctcatagaatgagttagggaggagtccttcttcctcaatgaaaaaaaaaatagttttagtagcactggtgccagttcgttttgaaagtctggtagagtttggctgcaattctgtctggctagggctttttctggttggtaggttttgtattcctgattcaattttggattttattattggtctgtacaggatttcaatttatttttttcaatttcaatctggggaggctgtatgtttccaggaatttatcgatttcttctaggtgttctagtttctgtgcacataggtrtttgtaatagtctctgagtttctttttgtatttctttggggtaatgttatctatatcatttctgctcatgtttrtttggaacttctctcttttgttcttcattatctagctagccatctatcaatcttatttattattttaaaaaataaacttttggtttcattgatcttttatgtggtttttaacatatcaatttcattcggttcagctgtgatttttgatatttctttcygcctactagctttggatggtttgctactacttttctctagatgttcctctagatgtgacgttgttaatatgagagcttaccaacttcttaatatagatgttttgctataaactttcctgttaacactgctttagttgtggcctagagattctggtatgttgtatctttgttttcactagtttcgaagattttttttttaatttctgccctaattttattatttacccaaaagttattcaggagcagattgtttaatttctaygtagatatatggctctgagagatcttcttagtgttgatttctatttttattttgctgtgctctgagtgtaactggaataatttcagtttttcataatttgttgagaattgcttcatggccaagtacgtggttgatcttagattacgtgtggtgtgcaaataataatgtatatttttaggggtgcagtattatgtagatatctgttaggttcattttgtaaaaagtaaagtagaggttcctcttcaaagactttcctccccatctaattaggaataaacagtaacttctcttagaagcaaaatttattcaaatacctgtgctaacattcttaaatatctgctagccataataaagaaatcaatgtacnttatyttcttagctcccacactttagcctaaatatttgccctgacatgcttatactggtccaagcaagcattaggttatagcctgttcctcttccttatttaaaaatgtttttacctttctcagcattccataagttacttcctacttcctttgttctcctcttttaaaaagttctaagttgctagccaatcgggacaaatacagaatgtgagttcctgttccagccaatggaaaccagacacagcagtagggtggacgcgtcaggttataaatgaccctgtcttctttgttgggtgtactctcgtggcaaaactagtgggtagtgtaccctttctgcaggaagtaaattaaattcatgctaagtaaattaaatttatgttgaagtgccatttctttatggcaccggggaacgagcacttcaaacaatttcttaaagtgtcgattttaggtcatgaatatctttgttagttttctcccttgatgatctgcctaacactgtcagttgggtgttgaagtttcccactattattttgtggttatctaagtctcttcgtaaacctctaagaacttgttttattaatctggtatttacagtgttgggtgaatatatatttaggatagttaagtctttttgaattgaatgctttatcattacgtaatgtcctcctttgtactttttgatagttgttgttttaaagtttattttgcctaaaattagactagcaaccacttctttttttttttttatgtgcctgatatatctgtctccattcatttattttaatcctatgagtatctttttatatgagatgggtctcttgaacatagcctacagtttggtcttgcttctttacccaacttgccactgtgatttttaatgggtatttagaccatttacattgaggttaatatagatatttaaggatataatcctgtcttcatgttgttaactggttgttatgtacacttgattgtacacttgtttttagagtcaatgtactatgtacttgagtgtatttttggtggtggcaggttatggtctttcatttccatgtttagcactcccttaagaactttttgtaaggcagtctggtggtaagaaattctcatagcatttacttctctgaaaaaagttttattttttgtttatgaagctcaattgactggatattaaattcttggttggaatttctttttttaatggtgctgaatatgggccccaatccctcctggtttgtataatctgtgctgaaaggtctggtgttagcctgatggggttatctttctatgtgacctgcctctttcctgtagctgcctttatttatttatttttttcttttgcttgactttgaagaatctgatgactgtaagtcttggggatggttgtttttcatagcatccctcagtggttctctgagtttcctgaatttgcatgtcgacctttctagaaaggttggggaaatttttgtggacagaatcctcaaatatgtttttcaagttgctccatcacttcatctctttcagggattccaataagttgtaggtttggtctctttacatattctcacatttctgaggttttgctcatatttaaaaattmtttttctttatttttgtctgcctgtgttgatttaaatgagcagtcttcgagctctgagattcttttctcagcttggtcaattatattatgaatgctttctattgcattttgaaattcctgtagtgaattttttattaccagaagctcaatttgttattttcttaaaatggctatgtcatcttttaatacatgcaccattttagtttttcttggattggattttaaccttctgctgtatcttgatgagcctcctttctatccagattctgaattctatgtctgtgatttcagccatttacttggttaagaactattgctggggagttagtgcaggtttttggaggtatgaagttactctggcttttaaagttgtcagagttcttgcactggttctttctcatctgtgtgggctgatatttccttaatctttgaagttgtctctcagatagggaattttgcttttgtgttctttggtgaccttgagggtttggctatggaataagttgggtttagtctattggttttctttcaggttgctttcaggcagtgtaggtttagctcagcactcctgggctgcatgttttaacactggagggctgggcccaggcctgcagctttgttctttgacctctcaaggttaagtgtgtactgtgctggagggtccaagatgttcccaatcttctggcaaccacactccaatgggggctgcatgaaaaatttttcagtagagtagaagtgggcccttgcacatttgggtaggtgacggcagacggtccatgcatatgggcacacctgtagatatacacacacgtgtacattggtgggatggtgacaggttcatcaggtaggtgttctgtgtatgcgtataagtcactaaagtggcaggtggaaggctgcaggcaagtgtgcactggtggaggactgccgtgtgtgggtgtatgctggcagaggtctgtctgcaaaagcactctggtggatagtcagggtcggctggtgaaagctatggcagtgaccactgacaagctgaggctgtgctgcaagtgggtgcagtcatgctgagaccctgggagaggctgacaaagggctgcttagatcagactggccctgtcacatggggaaggccaccccgctctgtctagtccagcagataacaaaggctaaagccacctagtggagtatgttgagccttgtgggttgggtgaccatggctgtgctccactgtgcctgttcctgcaccaaaccttctgcgccctatgcaggctggagttctgtctctgccaattccccaggcagttctatctgccagctcagatgtccatggacagtatacagtctctcaccgctgggattccagaactccatygtgagagtaggccattccacacctatrgcactcaccctttccccaggagccattcagggccaggaatgagtccraatgcttggccaccccatgaagagttcccagttccttccccttttaacccaggatctgtgtcctccctctgtccatactcaatgacttccttctttctgaagatctgtttatagtgtgctaatctacttgatggtctggtctgtcttggtgagagaagttcttcctgactccgtctagtcagccatcttggctgttccccacaattttattttaagttaatgttatctaatcttactctttatgctaacagatgttctcttgattttaaagtttgtctgtatattttcattttacctttgctgaaayatacttcaaaatagttcaacaacttgaatatattaatgaaaagaattgtcaaatcttagaaaaagtaattctgaagaaattattactcaactttaaaattgcagataaaataatgattcatttgcctcaagtgactatctgacatttaaaaaaaattaagtgggtatctcccactgaatttatctcccattatcccattagattatcaagagctgcaaacatactgagataatactattttgggaggaatctacatttcaaatatatctgatgtaagacatattatcaatcaaaaactgtacgaataaatcatactttgaacatatggttacttacgatttctcgttttctgttttgaagttcagctaatgatatatagaagaatacaattttcttgtctctatgattcttgacagtttcactaaaaggtcttttaagtacatcacttaaatttcttacttaagcctgtattttctttgtgcgtcaataaaaagtaacacatatactattcaggctgtatttggcattgcaaatgaacctgttttcactgttactactttaaaatactagtcaaatttatattgctatatattaatgtcgtcggatactcatataaatggtgagattctatttacctatgtgatatatgattgtaaaattgcaggagatcaaactcttattaagggagagccattttgccagtcaaggttcatgtaataaaactgtcatagctaatcattcttgaagtgcatgaaatgtgattctatgaatggttttgtttctcattatggcacagcattaaaactatgtactgctgtgcaatgtcaatgttattttgattcatctttcatgacatggtgatgttttccaagcctgatattatggactttttttttaataatcatcaagcatctagacggttgggttagcaatatttgaatgtgagcaacacattacaaatgcaataactatttgaaaatatagtctatttatagcagaatcatttattctatttgaatatgccacagtataatggcatttacaattcaacgggagatagatatctggatggtgagaaaaagtagtcatcattttctaaagaatgttctcaataataagaattttaaaaaatatacccgcaaacacacacaggtaataaaaatattgttactataatcaaagaaagactctcaaactttaataagcacacatactttttctttcaacagccggtgtttctgatttaattgcatgcattaacaggattagtgtatgaggagtaatataaaaatgctagagaatctttttttctctttaaaaaaattttcagaaaaccataaaaagcatcacaatggaattccatataaacaatctaaaaataaatacatgagcttttaaaatgctttattaataatacttcattattgcaagaaaatatcataaattattggtccttatggatattctcatcaatatagttgatttaaaatatcatttatttttcacgtttcctaaaagaggacatattcaaagttacttagattcctcctgtgataaatcttttgaaaatatactgaatcttattgctaatttcagacgtgctatattgtatctcaataatttctgttattccaaaaataatattgcgtcaatgcctcatttataaaaacaatttttaaaattcaatttgtgtatgttatgttgggaaggcatcagattcawtacaatgagtttatttttgaaagataataatagcttcagttttcaatataataagatatatataccayatacttttcccaaaatacaaattacaaagaataaagtattatacacttactgctagcattttcattaatatgatgacccatctcttctgatagacacaaattttacctattgttctccaataccttttcctatcaaaatatatctatatgtatttccacataaatatatattgatccaaataatattactggaaatatacttttgcttgatgtgcaatatacatcctgtagatataaattctaactgcctccataagaaggcaatacgatgattatttatttatttaacaatattttttagatgttgaaaaatatttcctaaacatttatgacatatcatacattaaaatattcgctatgctcatttatccttctgaacttcttcagtcatatttgtaagaatgaggcaaaataaatgctgtcataaataagctcattttaacgtttagcatacatcgctgaattttatctcctaatttacagactgaaaatgataattcagaatgtctttttttttcgttttttcaataatactggatattcacagacctagtaatttttaataattggtgagcagaaaagagacttcatttagtattagattgtattttggattactagtgaatacattttttcacacttattatttatatttagtttttgtagaaatcacatgttcatggtctttacccacattcttcttcatttggatgctttcatttttcttcctaatatataatgtctttatgaattaatatacatgtaacagatactttcctcctctatttcttctgaaaaaaatgaatttcaaacatcgaaatttatctattacatattttatattttgggttttgtatggcttatttagaaataattacttttcatctaatttttaaaatagaatttgtgcttgtaatttctagttttattttctacataaaatatctgagtatctataatttattttggcataaagaatgaataaaattctcataatttttattttaacttttyatagttttaaattttattataattgytaatgaatttgtgtgacagctttcagataaacttatattaatttctttgttttcaaaataatatctgaatatcagagaattaattctactttaaaaattgtttccacgatcatttattttgtaacatgatttgtccatttttttacctgataattaaattgtgatcagataacttcttgacatctcttctatttatttttcagggtaaacttgaataccaaacattctcaggactgtattattttgtcagtattatagtccaaatatttatataatacagttatatttcatttttaatagttatccaatatgatgctgtatacaattcttatctttccatgacttattttaatgagtactattttttacatcttgaaatgtggtaatttattcttataatacatttacattgacagagcttttagtcatagtatcatttaacmcataggagggtgatattatatggcattatataagaactatctgcattttaatatataggtctcagttatgggtgctagtttatatgtatttgtgtgtgtaattacatggtagaacattgtcataaaataaacatataattaaaatatttaccttttctactatagagttgagaaagtatagagataatctggttttagaaaattatcagatgcatctgtaaattaatctcctccatccaactttccttaatgaacactcattgttgaaggaggccagcccctccacacctgtgggtaattctcatcaggtgggacgagagactgagaaaataaataagacacagggacaaagtatggagaaagaaaaatgggcccagaggaccgccacctagcatatggaggacctgcaccggcattggtctctgagttccctcagtttttattactattttcactatctcagcaagaggaatgcggtaggagagcagggtgataatagggagaaggtcagcgagaaaacatgtgagcaaaggaatctgtgtcacaataagttcaaggggaggtactatgcctggatatgcatgtaggccagattcatgtttctctccrcctaaacatctcagtggagtaaagaataacaaagcagcattgctgccgacatgtcctgcctcccaccacagggtggtttttctcctatctcagaattgaacaaatgtacaatcaggttttataccgagacattcagttcccaggggcaggcaagagacagtggccttcctctatctcaactgcaagaggctttcctcttttactaatcctcctcagcagagactcttcatgggtgttgggctgggggacggtcaggtctttcgcatcccaggaggccatatttcagactatcacatggggagaaaccttggacaatacccggctttccagggcagaggtctctgcagctttctgcagtgcattgtgcccctggtttatcgagattagagaatggcgatgacttttaccaagcatacggcttgtaaacattttgttaacaaggcacatcctgcacagccctagatcccttaaaccttgattccatacaacacatgtttttgtgagctcaaggttggggcaaagttacagattaacagcatctcaaggcaaagcaattgttcagggtacaggtcaaaatggaatttcttatgtctttccattctacatagacacagtaacagcctgatctctctttcttttccctacaattgttttcagaaactccataccatgtatatatttttaaaatatttttataattaatgttttaacttttctttttttttttttttttgagacagagtctcgctctgtcgcccaggctgaagtgcagtggtgcagtctcggctcactgcaagctccgcctcccagcttcacgccattctcagcctcccgagtagctaggactacaggcgcctgacaccatgcccggctaattttttttttggatttttagtagagacgcggtttcactgtgttcgccaggatggtctcgatctcctgacatcgtcatctgcccaccttggcctcccaaagtgctgggattacaggcgtgagccacagtgcccggcctgttttaacttattcttaataatacaacttcttaattcccttttacataatctcttgagtctaaaacctatgttggtcatttctaatgtaatttttttttaatttggagagtacaaaagttaatatagaaaaatattttaggtagaaaattccatagcaacatcttcatgttgaccgaatgtttttagggtgaaatgtacatattttctgacaatctacagtacattattcatctaatttcattttaatttttaacacattaagttttcactcacataaaaacttcacctactatgagattcatgtcattctagtatattacttttcattcttctttgttttataatgacctatccaacttttctctgtttcctttgaggcctctgaaatgcagcttaaagatttccccagtctaagctttgattttacaatgaaaataagtgaaattataattctaaaatgatgatatatcaagtatgctaatctcaaaactactagctttcctgaaatattcacttccactctactttacttactcacttatccatatcatggttctttttactaaaggaaaatagtttacttacttatccacaccatgattcttttcactagttaaaactgaattttattatttgaaactctgaacaaagccagttgatcatctatcattctaattgtctcattctctggctccaggactcctggtttctagagctcatagacatacattgcctagaaggtttccttcttcagatttatcacctagcttagtttattttatattttatcaactgctctattactagttggtcaatacagatgcttgggtttaccgtgcaaacctcagaccccattccatctaaccttattctttctctgtcataaaaactccttcactagagctctattaaagaaaatcacaacaatcatgcccctccagcgaatttgttcattctctgctatatcacttagagctttcaccaatatmtttaagattatttacttctcctattttgggcaattttggaaaaattttccagaaatctgtcatgttattcaagctacttgtcctgctgtaaaagagagatttgtctcctagttcatcaggaatttcattctcctctcttatattacttaccatcctctgtttctctacttttaaagggtaagcaaattattctgtacatgattatctatttgtgctatgatttccctctccatatcctagaatatttcctcctttgatcttgttttttctacaacttcaaattctacctttcaaattgttcttttatcaaaatttttccaacttacaaaccactgatagcaatgtcatcacttcctctcctatctatcatttaacactcacttcaaaatggtgttctttgtcagtatgccaatgacctttctaaggtcatcagcactttcttttgtgctaaagtataaatccgtatttgagcatgtctagtttgaactttcaactgcatttgacgtggcataccattcctttctttgactcattttgtttgtttgttttattgtttgattttagctgtctcttctcacttgatttgtagtatatagtttgtctctcctggcctctcattttcagacttctttgagggctttttatcgttttttggtctcttatatgttgggattgcctagattccatcttcaacaatcttcccctttaattctactttttttatttctggtgtgctctcaaacatttgcatggtttaaaaaatatcatggtgtaaaataactgaaaaatgaaatcaaaactaactgattcccagaactttccactgtacattaatctgtcagtatggcatctcgatatcttatatattagtatcttgcagatacttcaacttcagcatgttttcttgagcttgttcttctctttccttattcaacgaatactaatttaattcaaatactccatcttgaaacctgtgtatcattataaacaccactgtctctcttacgttctatatccaattatccactcagtttatcaactttataccgtactatatctgcaatcagtacattaccttaattataacaaacacagttcaagtctttataccttttaatctgtatacctataatagtctcctgttggatgccttattcatgtattgctctgttctcttattttatccattctttattacctctagcatcaagttgaagctccttatgatatatcagccctcataatatatgcacattgtgtattaactatgttgaatttttcgatttttactttaacagcatggtatttattactctctaagaacttcttattctgtgtttatatcttcacttctcagctttccccactgttaaactgtaacttactaaagaaaaatagttatacactatttacctgtatttaccatataattattatggctcatcattagaaaaatacaactagtccagtagtataaaaatttgtgatttagaaacaaagtattgaattgggtgcagtggcttgtgcctgtaatccaagctactcaggaggctgaggcaggaggatcacttgagctcaaaatgttcaccagcctgggcagcagaatgagactccatctgtaaaaacaataataaataaataaaattagaaaaaagttgtcaaaacaagttatactttttttagagatatatttgtcatctatactgtaaataatgagcatcgaagacaagaacatactttgaatctgatattttcttatgcatatgcctaaacacatagaagtgcttacatgtggtgtgtgtgaatgtttggatatgtatgtgcatgagcatatacatgcttttaaagcagcttcaattttactatagaggaagtaatgctatagttaaaaaataaagacatataagttagccagaattcacatacaaattaacatctacataagatattggtgatacatgtaacaataaaattttctgccctttactgttcttacttggtgaaaaagtaattgaaattattgagctcagcatcttcattggagaaaagcaatattattatgaatcatgcaggcttcctgtaaaatttagatactatctctatctatgtatctgtctaatctatctatccacttatytatctatctattcctctctcaggacagatttggaatacaataattgttttttaatgatgactcaagactctgttcaatattaatttcttatcctagtttcttcaagagaaattgttgatgtgccttggtgcttgtacagcctattcatcaatgcactaatattgtactttgaattttttgtgtgtctgttattggtagactcaggtatttgaagtaataaactgtgtatttcactttattattcttgacancaggaaacagctagcttntaacaccattcatcnatatttctttaaatatttgtcttagaatttgaacaaaaatagttttaacttaagaattggaaaatgatatggcaatcaatattagttcaatttttctttcagggctaggtaggccttgatccaaatgcttaacataaatgcttattttgcattaaggatctgatgtcagtgctttgagcagattaattagtaagatttaaggcattcaatggattggtattaggcatattttgctctatactgmattagactaatttataaagtgtagttcacaaatgccctccataaataacatataccatttactatgcaattagactgccacgctttttattaaaaatgtttgtcatgtacaatgttttaaaatcttttttatcaattcataataatttacatattcatggagtacacgtggtattttgttacatgcatagaatttgtaatggtcaagtcagggtatttatagtatacatcaccttatttatcatttctattaatatatattgggaaaatttaaagttgtccctttggctgggcacagtgactcactcttgtaatcccagaacttttgggaggatcacttaagtccaggagttgagaccagccttggcaatatagtgagacctcatccttctaaaaatttaaaaattagctaagtgtggtggtatgtgtctccttcccagctacttcagaggctgagacaggaggattgcttgagctcaaggctgaagtgagccatcctcatgccactgcacaccagactcagtgacaaagtgagactctgccaaaaaaaaaagttcccttttctagctactttgaaatatacaacacacagtttttgactacagtcactctattctgcaatcaaacattagaacttatacctgatgtctaattgtatattcatatccattaaccaatctctcttcatgcccctttcccatccaatcacccttctcaacctctggtatctttctactctctacttgcatgagatcaacttttttagtttctaaatatgagtgagaaccgtgaaagtcatcctctgtgtctggctttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccacccgcctcggcctcccaaagtgctgggattacaggcgtgagccaccgcgcccggcccactttttataatgatctccagttcctcctttggtgttatccaccataacccatattttacttgggggtacttacataaattatcagcttaaaaggttaactattgaaactgattaattaaaatcactgatttctataaaacttttcacacaacttgactatattaccatatttattaaattagttggagtttctagagaaacagaaccaaaagaatgtggagggtggctcatgtgattgtggaggcttggcacgtcctgatgggataggcgggcagactggagactcagggaaaaattgctgttcgagttaaaaggcagtccgctggcaaattttcttcttcttcaaaggagatcagtctttatcaagtgaggctttcaattaattggatatggctccaccacattccaaatggcaatctgctttattcaaagtccacctatttagatattaatctcttaaattatataatcttaatattagtcaataaaaacttgccaagaataaaatataataaaaggttaatctcattcaaaaaacaccttcatagaaacatccagaatcatgtttgaccaaatatttgggaattgtcacccaaccaattcatcagataaaattaaccttcacacctagttatgtaatttgaacttttattaagggaaatagtttgcattattctatctacttcatccagagctgagatccacaggacatttttctgaaagcatcacaatgacaacaacattgtaagctaaataaaatatgaaaatgctactattttggcaattatttctcttgttgagaaaataaatcaatgacaatgttttcacagaataaattgaaactaaaaagatgtgttctgattcagtttagccatacattaaggtacaattttgtgggacattgataacttttaagtaaatgcccagcactgcttctgtcagcagacaaatgttgattctttccttatgttaaaatgcagaaaagcacactccatattcattaaacatgaatcattaaataatgttaagtattttataatttctcataagcagtgcatttattatctgagaaatcaactctgaaaaaatataattgagaattgaattagtgtctgcttaagttggtaagtagtctttttgttttcaaccacactattactcttcacctataaattccattattatttttgatgtatagtcaacttatttctataatgaaattgcccttctggaaatgttggaattcaattcatgggtcgaattcrtgtattatctcttcaaggcctggctgtgcaccacaacataatgtgatatattcctaagacttactccatagttctcaattaaattaactatattcaatcactatatgctaagtaatattaatatttaaaactatgccctgagtcataattcattcacatcacacagcatttgcaattgtgttaaagcttagaatctaggttcatcttcaggaataatgtcttcaaggattttggattttcactcagggtaatcaaactcttccatatttcaaagcaagatcaaagcaatgggaccctgatatgcttattcttaaaaggtttttataggctgggggaggtggctcacacctataatcctagcactttgggaggccgcggtgggtygatcaygaagtcaggagtttgagaccagcctggccaacatggagaaaccccatctctactaaaaatacaaaaattagcctggtgtaggggtgcatgcctgtaatgccagctactcgggaggttgaggcagaagaattgcttgaacccaggaggcagaggttgtggtgagccgatatcattccattgcactacagcctgggcaacaagagtgaaactccatctgaaaaaaaaaaaacgttttttataaattattttcacattttattaaaaaaaatttatgaaaattttaggttttttttttttttttgtaatttccaaaaagcctctagtaaaggaattacatttaaacacaagatggagttttgcaattttgttttctcttgaatctgttctcctgattggaggcaccagacattgtatcctgaagaatccaagatgttctcaggactgaggtaactggaacaaagaggagggatctcttccatgccattacctgcgcagtggacattggatattttccctgactacaacatcactttctcaggatgtagagtggtcaatctcaccgggaaccatgaaaaattgtatataggatgagacatgttctgagctacaattttttaaaaaccccaaagattgctcagacaaagaatggaccattattgggaaagatagtggaagcagggacacagtaagaaatatgctagaacagactctaggagactaaagtggggtacagaccactttgatgtcagtagatgagacagaagtgatcagattctgggtagatcaaaatgacagcaccggaaaaaagaattcctgctgcattagatgtggaaccgaggtaggatcaaaaataaagggtgaaataactttccacatttacctaccagaatatctggaagaatggcaatggtgaagttatatggtttggctctgtgtacccacacaaatcttgccttgaattgtagtcctcacatgttgagggcgggaggtgataggatcctgggggtgctttcttgaaaccatgctgttctcctgatagtgagtgaattctcgcaagatctgatggtttcataaatggcagtttcctctgtgctttatttttccctctcttctgtcaccttgtgaagaaggtccttgcttcgtctttgccttccgccatgattatatctttcctgagacctcctcagccatgtggaaccatgactcaatgaaagctcctttgttcataaattacccagtcttgggtagtgttttatagcagtatgaaaacagactactacggtaaattggtaccyggagtggggcactgctataaacataacatgaaaatgtggaagcaactttggaactgggtartgagtagaagttgacacagtctagaggctcagaagaagacaggaagatgtgagaaagtttgaaacttcctagagacttgctgactggttgtcgtcaaaatgccagaggactgttggaaagtcatgattggttttaatgtgaaaagacattagatttgggaggcgccatggggtaaatgatatggtttggctctgtgtcccaacccaaacctcatctcaattataatccctgcatgtcaagggagggacctgtaatccccacatacagagagaggaggttactggatcatgggggccgtttcctccttgctgttcttatgatagtgaatgagttgtgatgacacatgatggctttataaatggcaatttcccgtgtgctttatttttctctctcctgcaaccttgtgaagaaggtgcctgcttcccctttgccttgcaccatgattgtaagtttcctgaggcctccccagccatgcagaactgtgagtcaacgaaacctctttccttataaattgcctgtcttgggtagtatctttacagttgtgtgaaaatgaactaatacaggaagttataaaggagtagattttaaggccattaggcattaaatttatgaacacattgattttgagatgtcccagaataaagttgtcacatgggcagctggacacattcccatgccacagaaatgcctatgaactctaggaagggctgtgtggtatttgaggatatggccatttacttttttccagataagtaagtgttcttttatgtgactcaaagattcctgtatcatgttggaatgatggattattttgcactatggcctcactgcattaatgacattgagtggaggatgaagaggcaactttttgaacaggctatttatgtaagaatgtcacaattcaggattgtaaaggcagatccgtgcatttatatggcccactcttgtgagatacctgtccttgacttaaaggatgtttttcacctgactgaatgtcaaataacacaattctgggtagaaactgtacagacgtaggcacacacagaacaggcttcaagttcagcaaaattttcaccagaacgagaagcaaaacagtagcgataaatttttcagaagtaaggacagggtttagtttgtaaagaacctaaaagcaaacatatgaaaaaagtccttcrtatccaggagactaggagaaacttgcagtccagtgctgcagtaccaggccactcatgttcagggaaagccacacttaatcaccaagacaatggggacaattctccagggcacctcagagaccttcacagcagcagcttctgtcacaggtctggaaacctaggaggaaaaaatggttctgtgggcctggcccaggggccccctgatctgtgcagtctcaggacttgttgccttgtgtctcagctgctccagttccagtcatcactaaaaggggccaatgtacagcttaggcttcagagggcgcaagcccctaggcttggcagcttgcacgtggtgttgagcctgcaggtacacagaagtcaagaactgaggtttgggaacctccacctagatttcagaggaggtatggaaacccccggatgtctagacagaagtcggctgtaggagcagagctctcaagaagaacctcttctagaatagtgcagaggggaaatgtggggtcggagccaccacacaaagtactcactggggcactgcctagtggggctgtgagaaaacagccaccatcctccagatcccagaatggtagatccactgacagcttgcaatgtacacctggaaaagccacagatgcttctttcatgagttgaaagatgacttttgaatatttcgtagcaagaaagtatttttcccataacaacatctaatgagatgaataaaattatatttactagaattcattatttttattaaagagtaaatttgtctggaaagaatgttttaagtaagcctgtgtgtgtttgtgtgtgttgtgtttatattcttgtgtgtgtgcttctgtgtgcatatttatcttagtggcagtaaataaaaatccacttaatactttgagggatatgataaatgttttttttttttttttttttttttgctgttgaggcacccatcagtgttgggttagtcttattacagtggaagaagatgttacaatgtgtagtcaaagtggaaaagattacctgcaaccatacagttcttctatatcagttaatccacacaggagaaaggcattaggttcaacaggaccttaactggggtctgcttgtgacttagaaaacctttaacttctttttttttattattatactttaagttttagggtacatgtgcacaacatgcaggttagttacatatgtatacatgtgccatgttggtgtgctgcacctattaactcatcatttaacattaggtatatctcctaatgctatccctcccccctccccccaccccacaacaggccccggtgtgtgatgttcctcttcctgtgtccatgtgttctcattgttcaattcccacctatgggtgagaacatgtggtgtttggttttttgccgttgtgatagtttgctgagaatgatggtttccagcttcatccatgtccctacaaaggacatgaactcatcatttttatggctgcatattattccatggtgtatatgtgccacattttcttaatccagtctatcattgttggacatttgggttggttctaagtctttgctattgtgaatagtgccgcaataaacacacgtgtgcatgtgtctttatagcagcatgatttatattcctttgggtatatacccagtaatgggatggctgggtcaaatggtatttctagatccctgaggaattgccacactgacttccacaatggttgaactagtttacagtcccaccaacagtgtaaaagtgttcctatttctccacatcctctccagcacttgttgtttcctgactttttaatgatcgccattctaactggtgtgagatggtatctcattgtggttttgatttgcatttctctgatggccagaaaacctttaacttctttatggacaatgttaatctcacttgacttgtgatggattgatttaacctccatgtcactcagtcaagagctacctgactcacattggcctggtgtgtgaaataataaatgtcttattgtttaagacaacaaaaacagacaaacaaacraaaaacaagatggagaataaaaatctatctgaaacgttttcagattgtcattttgtttttctgttttctcttaccaattcctctttgctgagagctatggttggtagcatgtagtttcattcaaagccttaaagccattacatttcacataggagctttgttttaaattacaccttaattttaaattacactttgttttaaatttaaattaaatgtcaggcaccattttcaacattcaccattaatgtttgtgcatttgaatagtaagcaagtgtaaagtctctcacctcattctactttccaatctgaatgcaaataactccagatgctaccttttccataatttatataaaatgtcctaaattgtgtttttttcacaagacagagcttctcaaaaatgcaccaggaatttcagactcctatatcaaaactaaaaaaatataacatcaaatatcatgtctttatatctatctatctaccatatatcaataaaatttgatagatgtatagatatagaatcttatagatagatatagacataggttatatagagatataaatagagattatatttgtatcatcttatatgtataaatatgttacatatggagctataatatatgtatatgtgtgagtatatatatatatgagttttttcctatgattttgtcctattacttcctcttctaaatgctgacaattgaaaaacaaatcaatgcaaatggtaacctagctggtttgcattggattcacttatacatttcacagatatttatacacagattactgtgggggagggtggggatagaccccttcctctcatctattaatatttattttttttaaaattttatgttttctggtatttttttaaaaagctttctatagattacaaatgaaagcaggttaaaatgttctccacaagccatgacattttgttcatactttatttttttctctccgtggctctaaagtgtgtaattgaggttaatcttttgacaaactgatgtatcagcaatcaaccagcaagattttgaaagaaaatcattcttccatgagtagaaacctaactgttgaataatttgtagcaagaaagtattttccccataacaaggttgaatgagatgaataaaattctatttaccagaattgatttttgttaaagcattaaatttgcctggaaagaatgttttaagtaagtgtgtgtgtgtgtgtgtgtctgtgtgtgtgtgcatgtttatcttagtgacagtaaataaatatccatttaatgctttgagggatatcatgataaatgtttctttgatttctttcctgttgagcaacaactacatttgactgtaagaatatgtttacttggttatatagtttgctttatttgtctctataactttaattaactcatgcaaaattggtaaatagggtaatggtatcagtatgatgtggaatttacaattgtttataaacctttctttgagcacggtatcattttgcaccaccaagtaacactagctgagcacaaactatacaacataaacacggagagatataagctattaatatacactgtatcacaatatctatttcttaccaagctcctttggccaggtgctctgtcttagaaatgtattttgtctaatttccctttatctttgttaatttaagcactggaaactcattcttacacacattttcatcaccctttattcccccttttttaaagaaggcgaactatattttctgttgaattttttattagaaacataattttaactgtactattattttttattatgactattgctggttttgttagtgatcacaacacagagttgtgaagattttaactaatctttccctaactttatgtttttataaccttgtattttcatagwgttattttttcagaaaacgtgtctcaggaatgcatatatcatgttttagcagaaatgcttccacctatacaaaagaccaaaagtttttaatgttgctttaaaactataatttaatagtatatttaatgagttcttaataatttttttgtaatttgacatattattacatttattcctcacagtgtcctgaatagatagatacttttgtggcctccatttatttttgtttttattgtttgtttcacagatgagaacactaagattcatggaaatcatttacctgagaatagtaaaacaacaacagagtataatttcagattttaaacacagtgaatgtggacagactttggtggttaagcagtaatcaccttctcttcagatagggaaaggattataagtaacagtctcacatttaactaaaatcatggtatatataaatataaataaacacacacacatacacacacacacacacacacatatatatatataaaactactaccaagtcttcttctaaaaaaggccatgcatctatttaaatattataaaatcacatcacacattcttcagtgtcatgcagtcctccaatcactgcatatactagtggtgatcaaaatgatccagagtacttgttctcatggagatttcacaacagtaatgagaaatgtacactaaaaatcttaatagacataagtaatttcagatataaagaccaaaaacagggaagtggggaaacaataacaggcagaaaatactaggatctgctccatctggcagtatttttangagatttttagggtgttgcttttctggctggaaacttgtggctagtgatgcctttgcctgagttttccttgggcctgctgggctcattctgcccactcggcctggcaggttgcactgagctcatgctactggcccggatcccacacctcgaagggaaactgaagtcaggtgtggagtgacaaagggtgtgtgagtgagtgttggatcaggccactccacagtcagacatgctggctcctgccacagggtagacacctccaggtgccagcatgggtgttagctctctgtgaggctgcagctggaccaggcacaccacaagctgcttccccagctgtcaccagggagtgtgatagcacccagaagcttagaaatgccagcaaccacaggggcccaaagagggagtcacaggcctggctctggaagctcccaggtctgggctccctgaaaggctgcagcttttctctccttctcttcacctgcaacgtggcaagcaagggggatgttttagccccattttttttttagatggagttttactcttgtcgcccaggctggagtgcaatgatgtgatctcagctcactgaaacctcacctccacctcccaggttcaaatgattctcctgcctcagcctcccaagtagctgagattacaggaatgtgccaccacccccagctaatttttgtatttttagtagagatgggtttttgccatgttggttaggctggtctcaaatcctgatctcaggtgatccacacaccccaacctcccaaagtgctgagattacaggtgtcagccaccttgcctggcctttagctccatttttgttatagctcttttagccttgctgtttggtggatcctgagttcttgtcccacaaacagcaagaatgaggtatgaagacaagtggagggtgggcaagatgaagangagcttggactgagcaatagaacagctcagagaaaacctatagggagaagctcctttctgccaccagggtctcccaacaagtgttcagctcttagcagagaggagaccctagagtgggaagctcctctccatgggcaggttgtcccatcatctctgcagctctcagcagagaggaggtcctgcaatgggttgttctccactgcaagcaggtcatcctgctgtcttccaagctctcagcaaaaaggaggccctggagtgggttgttcctctctgcagctggtagttcccgcctctcctcagctctgcctgagcctggggcctttatgggnttcagatggaaggaagtgtactctgattggtccataggcagccaagggagggcccagaaaagacaccacaagttcacatcccagtctgtgagactggcagctgggtccccatccttcaggcacttcacggcctgaagatgaggcctcaccaggaactggccccctctgcccaggagcctgtctgcttcctactgctgtttatggtgcccaggctgttcatgccaaggggcatctacatgccagtgccaagctgcccttagtacccctatggctttcctcccttgcttgtcagtgcccaaagtccagagggggctagagcagcaggcagcagggggctggtgtgtcagcactgctccaagtgtgcacaaacccggtagggctgtcacagtgcctgggcttggtcccaactttgctctgaaattggagtgggcactgagagcagagagaagccagacagctggagcagacactttcaaccctgtgaaggcagcggggcctccctagacctctgagagttcagggattcctgggcctgcagccatgatttgggtggctgcagctgtgttcggtggggtgattgtcatgcctgctccatggagtgagaggctggggtctgcagccacagtttggatggctgcagtagaacccagggaactcctgcccctacttataaggggtgaatctcccgctttttcctggcttctgccagctccatggagcatgcagtcctggcttcacctccctactgcagctggcatgatggcaacagcctctacagatgacctgatgctgccatcagtatcaggaaaattntctctgtatagagtaattcagtaactcagaaagtcaaatagttgagtaaaacgaggtttacggttgctcatagtgagaccaagagagaagagggcaaagtaaagtaggtacgttcctcaggttgtgatttgttatggatcctataatttagtccagaatagcatgaaatttaggagaaatgaggaatttatgatcgtgaaaatagtagaataattcttggaaaatcaaggaatgttttagagagaattattagtgtaaataagcagaaaggagagatggtgattataagaagtaagatatttgaaatctctagtttgggggtagtgcatttcttagtataagacgcggggaaagagttgcagagcagagaatcttcagatttgagtagatcaaggacctaaagggcagaaaattaaagtgatgttaaaatcatcaacattgataagtaaatagtggaggagaggatgtgctatgctaatatgatcagtgatttaggtggaaagaacattagacatagcaattagaagaaataatattagatagtaaagtctagtgatatgcattccacaaggaaaatggaaaacaaatatttttccatatatatatatatatttttattatactttaagttctagggtacatgtgcaaaacatgcaggtttcttacatatgtatacatgtgccatgttggtgtgctgcaccaattaactcatcatttacgtcattyacattaggtatatctcctaatgctgtccctcccccctccccccaccccacaacaggccccagagtgtgatgttccccttcctgtgtccaagtgttctcattgttcaattcccacctatgagtgagaacatgtggtgtttggttttttgccattgtgatagtttgctgagaatgatggtttccagcttcatccatgtccctacaaaggacatgaactcatcattttttatggctacatagtattccatggtgtatatgtgccacattttcttaatccagtctatcattgttggacatttggsttggttccaagtctttgctattgtgactagtgccacaataaacatacatgtgcatgtgtcttcatagcagcatgatttatattcctttgggtatatacccagtaatgggatggctgggtcaaatggtatttctagttctagatccctgaggaatcgccccactgtcttccacaatggttgaactagtttacagtcctaccaacagtgtaaaagtgttcctattactccacatcctctccagcacctgttgtttcctgactttttaatgatctccattctaactggtgtgagatgatatttcattgtggttttgatttgcatttctctgatggtcagtgatgatgarcattttatcatgtgtctgttgaatgcataaatgtcttcttttgagaagtatctgttcatatcctttgcccactttttgatggggttgtttgtttttttcatgtaaatttgtttgagttctttgtagattctggatataagccctttgtcagatgagcagattgcaaaaattttctcccattctgtaggttgccggttgactctgatggtagtttattttgctgtgcagaagctcttgagtttaattagatcccatttgtcaattttggcttttgttgccattgcttttggtgttttagagatgaagtctttgcccatgcctatgtcctgaatggtattgcctaggttttcttctaggtattttatggttttaggtctaacatgtaagtctttaatccatcttgaattaatttttgtataaggtgtaaggaagggatccagtttcagctttctacatatggctagccagttttcccagcaccatttgttaaatagggaatcctttccctatttcttgtttttgtcaggtttgtcaaagatcagatagttgtagatgtgtggtattatttctgagggctctgttctgttccattggtctatatctctcttttggtaccagtaccatgctgttttggttattgtagccttatagtattgtttgaagtcaggtagcatgatgcctccagctttgttcttttggcttaggattgtcttggcaatgtgggttcttttttggctccatatgaactttaaggtagttttttccaattctgtgaagaaagtcattgattgcttgatggggatggcattgaatctataaatgaccttgggcagtatggccatttcacgatattgattcttcctatccatgagcatggaatgttcttctatttgtttgtgccctctcctcttttatttcattgagcagtggtttgtagttctccttgaagaggtccttcatatcccttgtaagttggattcctaggtattttattctctttgaagcaattgtgaatgggagttcactcatgatttggctctccgtttgtctgttattggtgtataagaatgcttgtgatttttgcttactgatttcgtatcctgagactttgctgaagttgcttatcagcttaaggagattttgggctgagatgatggggttttctagatatacaatcatgtcatctgcaaacagggacagtttgacttcctcttttcctaattgaataccctttatttctttctcctgcctaattgccctggccagaacttccaacactatgttgaataggagtggtgagagagggcattcctgtcttgtgccagttttcaaagggaatgcttccagtttttgcccatttagtatgatattggctgtgggtttgtcataaatagctcttattattttgagatacgtcccatcaatacctaatttattgagagtttttagcatgaagggctgctgaattttgtcaaaggccttttctgtatctattgagataatcatgtggtttttgtctttgattgtatttatatgctggattatgttgattgatttgcatatgggagactttaacaccccactgtcaacattagacagatcaatgagacagaaaattaacaaggatatccaggaattgaattcagctctgcaccaagcggacctaatagacagctacagaactctccaccccaaatcaacagaatatacattcttctcagcaccacaccacacctattccagaattgaccacatagttggatgtaaagcactcctcagcaaatgtaaaagaacagaaattataacaaactgtctctcagaccacagtgcaatcaaactagaactcaggattaagaaactcactcaaaactgctcaactatatggaaactgaacaacctgctcctcaatgactactgggtacataacaaaatgaaggcagaaataaagatgttctttgaaaccagtgagaacaaagacacaacataccagaatctctgggacacatttaaagcagtgtgtagagggaaatttatagcactaaatgcccacaagagaaagstggaaagttctaaaattgacaccctaacatcacaattgaaagagctagagaagcaagagcaaacacattcaaaagctagcagaaggcaagaaataactaagattagagcagaactgaaggagatagagacacaaaaaacccttcaaaaaatcaatgtatccaggagctgtttttttgaaaagatcaacaaaattgatagaccactagcaagactaataaagaagagagaagattcaaatagatgcaataaaaaatgataaaggggatatcaccaccaatcccacagaaatacaaactaccatcagagaatactataaacacctctacgcaaataaactagaaaatctagaagaaatggataaattcctggacacatacaccctctcaagactaaaccaggaagaagttgaatctctgaatagaccaataacaggctctgaaattgaggcaataattaacagcttaccaaccaaaaaaagtccaggaccagacggattcacagctgaattctaccagaggtacaaagaggagctggtaccattccttccgaaactattccaatcaatagaaaaagagagaatcctccctaactcattttatgaggccagcgtcatcctgataccaaaggctggcagagacacaacaaccaaaaaaaaagaccaatatccatgatgaacatcgatgcaaaaattctcaataaaatactggcaaaccgaatccagcagcacatcaaaaggcttatccaccatgatcaagtgggtttcatccctgggatgcaaggctggttcaacatatgcaaatcaagaaaacaaatatttttgaagcagcatttaataagaaaaaggactcctaatactctttctgacatacaatcatgtaaatttattatgaaatataaatactagttgaagaagaggaagaaaagttttatatcatagcaggacaatgaaggactctttggagtggaatttgatgatttagaagacagatcatgagtgccctaaagcagcagtccccaacctttttggcaccagagaccagtttcatggaaggcaatttctccacacacaggggatgtagggagtggtttcacggtgattcaagcacattacatttattttgcactttacttctatcattatgacattgtaatatataatgtaataattatgtagctcaccaaaatgtagaatcagtggcagccctgaacttgttttcctaaaactagacagtgtcctcttggggtgataggagatagtgaccattaggcattagattctcataaggagcatgcaacctagattcctcacatgcacagtccacaatagggtaggtgctgctatgagaatctaatgctgccacttatctgacaaggagccagagctcagacggtaatgtgagtaatggggaatggctgtaaacaccgatgaggctttgctcacatgcccaccactcaccatgtgctgtgcagccaggttcctaataggccagggaccaggactggtctgtggcccaggggttggagacccctgccttaaagtatgttggaaaatctgagaaggtatgaagaggtggacaatcaggtctgattactgtttctgcaaagtaaaattgggaggactgtcactgagttaaagggtcctctgggagacttgcacagcggatagtatctaatgtaaatggggacatagntatgatgaccaatcttgcttcttccttagatgatgttgggtaattcagtgagcacactggttacaaattttaaccagtgagcataaataaatagtttggttgcaatctgtcttcctgccccacttaattcttgctttgtgcttcgtatcacaggcaaccagcttgttgctttatgcatccttccttcatcctattttttattgtataattcagagattttgtgcagctttaaaattttccatttccagaagcatgtctttgttttcctatagaaacttttttctgcagttgctgattatattgtgttagtgcactctatctttgtaaaagtaaactctttagcagttgcattgtttttcaaggtcagcaaaattatagacattgattggtgctggtttcagtgttaaacacttttagttgttgagaatgagagcggaaatagttttctcatttttcagatagataaacactatcatacatctcatactaaaccattaaatgtctcactggcatccttggtttcattctggcttgatcacttaattatgtaggtagcatttacaagactgcaaagaaatggtttacagagaataaaatggtctatttaatcccagtgaagtattgtactaaatgaatcttttttaacaaaataaacccagctaatttaacaatattaaatcagcagccaatatctttagcacatcaaggaagaattttgggtaatatytgatgtttattacttaagaagaaagacaagaattcatgtgcctgccccttttcttaggtctgtaggcttccactgtttagaaggagtataacaattctaataaaataacatattcaaagtgacaatgcaatttacacaggacattctctctttttctttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttttttgtatttttagtagagacggggtttcaccttgttagccaggatggtctcgatctcctgacctcatgatccacccgcctcggcctcccaaagtgctgggattacaggcgtgagccaccgcgcccggccaggacattctctcatgccatgacacttcctatttagcattccattccccaactaatacttcctattccttaattttgttttgtgcattcttcctaaatttgcaggatggtttaaagtcaaagaatacttcccattttgtacattatggttgtatatattttttgcatatgcacatacattattagtagtattataatcacattgtatataatcaaattataagatattctgcttttttgtatagaattatccatatgcatgccagaattttgctcaatattgttttatttatttcatcatctcatcgctttctcttgaaatcaacttctttttctcaaattggtcctttagatgttaatctaatgacggaaagacgtgttctattgacagtaagacttgttagtcaaattaaacttgtccttattttacattttctttcaatagtgtttcatttaaaagctatttggccaatatcttatattgctctttagaactcttctattaatttaattgccattaatttgttggtaatatttatgacattttttgttttttaatctgttttttaaaaatatttttctattattgtttcaaatggtttagcaattatatacttacatctggttttcattacatatatattcagtatatagatcttgtcatcataygtctttaattatatatcaatatatgtgtatgtgtacattttattttatatatctatatagttatttacagtaattctttaatatttatcttgatatattttgccagtattggaaaactctcagccatcatatcattcaatatatagctttttcacttttctttaacttttttattctcacacttcagtttcacatatattagaatgatgtactttttcattgctcatcatgtatatatcctacacctttcccgttccacatatttatctctctttgctttagttgggatattttcttccaacttccagttcactatttttctctctaccattaaatgatatctcataaacccacttactatactttgcagttccaaaatgtctgtgtttctttccgtagtttctagatttccaaataattctgtcttgtattttatgtttatatcaatcatagttattcttaattgtgtatgaaaactttatctgaattgttggtgaatctctataatacctttttaatttccccctggtttttcatcatgtcttgtcttctagcattcttcgttctattttattgaggcctggtattatatatgaaaaaatttagagataattatagggtctgaataaagaagcgatctccttccagagaagatttatatttgcctctgccagcagtaaggctggactttggaggttacagatcactttaattcaaacagggatggagatgactcaaaattgagcttagtttcctttaagaattgattgatttctgattcatccttatttaagggtaactactgaaattgcggacttttaccagggcttctctttgtgcataaagtttgatttttgtcccattaggctcataggtgtgtgaaaagccctgctcagcttcctcgcctcttagcttcttcttccaatataaacagatacccttaggggaatgtggctaagggtagttgctagactcagctttctgagcttctcctgtctcccagatcttggttccctaattctttttatttttcttaaccactctgtggagattttgataaaatattttctcatactttttcagttgttctcagcaggagggatggatgagatggaatatgtagtttgtcattgcaattaatggactttttttgcttattattgtggatgcctgtgaacatgttatatcatttaattttggtccctatttcttttaatctatctttcatattttctgaatccctttatctttctgctttctgagtaggttcttcaggctcatcctttcattgactaattcttctgtttgttctgcatgactacactatcattccattacattttaatcataaggtacaaaaggttttatttcaataaattttatttgatcttttctcaaaaaatcctgtaggtttttgcactaccatgtttttctaatatttttgattctttattttaaatcttccaatcatctttaagtgatttaggtgactttctatgagattccatatttgtgatgttctcttgagttaatcttattatttatcatgtccctggacactgtctgatggtggattagtttttatatgatttttaaaacttaaattgtaagtttacctacttgagggttttaagctatgttacctaaactgaatgcatagtcctccagtgggttattttttctagggccagatgtcccagaagtattacagcttgagatcaccattagtggaacacaactaaagtttcaatgagagtgttccaaaaacctgacagtaatattataatatatacttaagcatcaaaacctaatatggcaccagtggctgtttacaaattctcaggggatatatattttctatctttgaacaggcagagattgacatattttacctgtactggaggtgaatttctttctagttctctcttttaattaaatatgtgtatctgtgcataggaatcaataccaacactagtactggcctagggctttatatagattcccaatgtgcaagaaaaccaaagaaattgtgtaaaccccaaaacttactgaattatttctcaggttcttgattatttcctataattgggttttccttttttgtcttgtgatctctatgcataaaagttatattttatctaagaataatagttatatgcgtgtctatattgccagaaataaaatatgttcatctttaggatgtggtatttgtttagaatagaactgccattcttattgtattgactgcatgcttcaaatttagttaataacaaatataattctgtttttcttgacaactagaatgttttctcccattaatcactttatttggggggaggatcagctatagtctaatatgaattcagtgatattcacctttgttatttctttctatgggataaagttttgtgattaattaaacttttatttgtggtagagacagtctcattatattgcccaggctagtcttgaactccaagggtcaagtattcttcctgtcttggcctcccaaagtgttgtgattacaggtgtgaaccaccasgctcagctgattaattaaagtttaacattaattaacatcttttttacttgagatatattttactcctattataatgttaacaccaccctatgggctatcaacatttgaacttttgatcaatattgagttaaatttccacatgtgcaatgaccatatatatcctgtcaatcattaagtatccttaagaggtcgctaatgttcagttccaaacaggagttttgtaaggtcttagaattacaagagtcaacattcaattcattttagtgttcatatttcagaaaataaattggcaggttttatttctgtaaatttgttaagactaccagacacttcacggttcttctaacattgttgcattcaatgcataatcaggtgttgctaagcagcacattatgactttattattttaggtagcatataaacatattttggttactttaagccatgatagaygtttcyctgattttttcttcatttttagtttctcctttttctctttcctcaatagtacagtaaaatagtactattttactgtacagtaaatagtacagtaaatagtacartaaaatagtaaagtagaamcctcagttttcccttataaaatagaataagagttttatgtatcattctgtggcctttcaacatttattgtactatattcaatcttacaaatatttattatttaaaaagtactaataattgagtatattaatttgacttttaatatcacggctatatttggggtatttatttattattattgtaaatgcattgaaaagttgtaatcaaagcaatataatttttaaccaaataaaattacttggctatagaaagtcacggagctaattatctctaagtagcatctctcagctatgttttatgttttgatttactagttttaggaaaataacatattttctagatagttaaatttacgtcagtgtatgcatttacaatacccacacataatagactttagaaggtaaaacatacaatatattcttaaaattacccacatatatttttcatccgaacttcctcttttctttcaactagtaatatattacctattaatagaggctctgtccatggtttctcatttccatgaagcactctcatccctttctagtcctgagtcatctctgctttctcccatgaatgtattgaaaaaaaagaagataattgtggaaaattcctttaaaaatactcttttaaaaatttattatacgtgtggtaaatttgtttaaagtttaatctcaaagttaagaagtaaacttttaatggagactttaaaacgatagtatagaatttattttaagataaagttatattctgataattgtgaatcaactcttcattatggcagtgtataataaagatgattygatttttctatagcgacagaattatttagtgctctctttattcctaacggtagtacaaaaagaaaatttcaagtgatgcttctgctatgaccaataaactcataatattaaaagtcaatgatacatataattctgatagacatcttagtatttactcttgatagagaaaataacccaatttcaggtgcaaatattagatgaatttgaaatgagattaaagttcccaattttaaataaaatattttcaagctttttattgatgaaaaacttacatagactgaagtgcacaagtcatagctcatactacctgatgcatgtccaaaacctgaacacacctatataacaagtcccaaaatcaaaaagcagaaacttaccacttttaaagctttcctcatgctttctctcagtcactatccgtcattgctggtcagtaccctacaaaaggtaaccactatttctatttctgacactagataacccattttatttacttcctagatctaaatggtcttcccatggaaacagttagttttataagctatagttacactttttctgacaattaaatgttatttttcattgaataggtccaaagtggtacccttctcgagttggtctgcagctagaatgtggtaagaagcatttttcactgatgtgtttatttaatttataatcccttttctattttcaaaagctgacattcacttatcactttgcaaatatacaaatattagtattatttaattgattcgcccaacaaactagagctccacttttataaatgaataatttagtctcaaataggtattttttacatattcactgtctgtgagttttagaagcagattctgaaactaaaatatttttgtttgtgaagctttaactggtcgtctgtgaagytttaactggtcaccttctcattctactgctccataatatattcttaaggttaatgcttagctttttcaattttttctttttctttttgctgttataaagcagaataagtgacataaggaacaaaactaatgaatttggagaagaagcattatgcccactattaaacctcaaatttctcagatttttaaaccctatgatctcaagaaatttatcaataaatgcacttaaaaatggctcctaccaataattactgttgctgacactacatcaactttattttaaatttggagtttaaaattttaatgaaagctgtgggtagcatgtactttttttcaggatagaatgaaaaagcctttaatagtaaatctataggaggtacctcttaaggaatttcaatctcccaatttttcataaataatgagttgaattttttttctattgcttttcctaatatttaggttgccctctcttaggtattacatgcacttaaagacaaatgattatttctttgagtctctcgaaactgttacgagtgttttcattgctgtcttaaacatttaatcgttctctgagaactgtatgttcaaaacaaagaaatatgcaagatttctaggagccacacttttctgattctctcaaatttatttttgctcaaatgttcaagacaaattcccacctacctagagtttaagaaagacaaattattgtctcatctacttttgccttcatagggcctagcacatgtcagcacataagtgcctttcaatacatggatgttgacatatatgaaatgaaattgactcttacacaaagaagcctcaaagagtgtcacagacaacattgtcaaatgtaacttccatttgaaggacactattaagagactgataaatttctgttagttcagtgttctggtgaatatgacatattccttttctcccaaatttatttacctagttgagtgtaccaggatggggtgtgagatgagtaaaatatagttgtcgcagtgtccttaaaaagaactgtaatgatgtatttgaaaaaaaagtcaactgatttagtgagatatggtgcaaagaaatcaaaatccaaagctcatttggattgattcagatttctacatttgattgaccctctcatacttacttgcctacatggtcttcttttatatggcagaactaaaaaaaccacttaaatcatttttaaagtgttagtgtttatatgtttataatgcatatgatgattggcacaggctagttgctccatcaatcttagtcataactattaatattaagaagaaaaaaaggcaataccaaaacaaagcagggtcttaatatttatacatttgctcccaaaatatacgtactagaatcattgatcttatatgaatattagagacttctatagtttcctcacacaaaagaaacctttaaaacacaaataaaatagaagcattgattttcatgggtaaaattttaaccagttctttagctctgtgtctctgctgagctgtgctatatttagctgaacttggataggttcatgcatgcagctgcagtgagctgctgggctgttagggaatgattggtctacaataaccacaactttcatgaaattccctttgttcaatgtggtctctcacccctcagcaaaatagtttggactactcacaagctgggagtagaggtataaaaatgagcagaggtactaaagaattgttgaagcccaggtttggaaatagcaaatgatcacttgtcctgcaagtcactagttagcccatattcaaggggtgggaatatgagaacagctatcactgagaagaactacaaggtcatactgtatatggtgtgcatatggggaagaatttcagcaatttttacaataaatctgtcatataatctggtaagtaaaatattttgtatattcctacctttattaatatgctttataatgtcctggaaggactgggaaaatttctaatgtttaaaatgattggatttctacatagaaaaaatagatttttttccatcactgtttccaagcaatacatcaaagctccatccacatcctttatacaatagtcttgacaaaccactaggtttgttgtgtaccccagttccaggcccatacttgggagggaatatccaaagaccaggttgtgcttgtgttaatttggtcaggaaattcagggcccttaagtggctgaagcatgatctagaaagatatgtcatgggatctagttaggtatttcctgtcctcttggccctatatattcctctccctttgataagggacataatcatggaaagccaaggacaatggtccctttttcttgagtctgaangctatgattattgatacatctagattttatcaagtcattttttcaaaatctcwtattcatgggaccacattttaaaaatagaatgccaatgatctgttctttgaagttggcaagcatgatagaagggtagaaactaaccccttttctaanggtgctaatagatgtatattggaaacatattttcagcacactttcaagtgatacaaagccagctgaattttttgtcctttttaacattttcttgttcttatacataattgtcttaatactactgacaattttgatatcaaagccttcaccttgatccatattgtgaaagttttgtattgctatgtaacaaatttacacaaatttagcagtataaaaaaactatcatttattagattgaagccatattatggcttgattctctgattaggattgtataagactggaatcagagtgttgactgaactgaattctcatgtgaagactcttgacaaaaagccacttccatcttcttttgtgttattggaagagtttgtgttggaaatgcttgttccctggtgctccaaagaaatagcactcaaacataaatttaattctctcagcaaggcaattattactttctgcagaaagggtgctcatcgcagatggaataatggtgagagcacccttttgcattttatgtttgtttgtctgtttgtttggtctttgcagttgcatggaagaagttcctgtgttcttgctggctgtcacttcctagaggtggctgtcttttctcaaaggccacctgtatccttgacgttgaccttctccatcttcaagccagcaatagcacagtgaatcttcccaatgcactggatctctgaattcctctgtctctgatttctgcacacacattataaaaactcatgcaataaatcaggactacctagataatctcattttttaaagccatgcaatataatttaatcaacagagtaatagcctatatcatatgcagaacctcagggattatacaggtagcagaaatcctgaggattatctaagaaatctgcctaccacacatgtgttcttaggtaaacacaggactacattcacattttcaaagcaataccaaattatatgtaattatatatgtatatatatgtatgtattttacaaatagtaatcaatttacatgaaatttctaaaatataactatgaaattgttttcaataaagtacccagagaaccatatacattaacatgaccacctaaattatctggctgttaaaagtggatttatcaaatttctgccttcaaatgtaatatacaataattgtatattttttgtttccttttaaaagacctttaattataaatataagcagatatcttggattctgaaagatcatctaatggtagatgcaaattaactttttttatttatttcaaaaatagagactggaatgatgccttttaatgatgtagataatataaatcacaaataacatatgttaagtataacaataataataacaacaataataggattatatttgagagattaatccattttggtatttgagctctagtctactcatttttcttcctgcttggtatacatttctttaaataaaacaaaatatttatctcttaccttattaaataacatttaagtgtttttcaaatattttattataaatagtgcttaaaaagatatttttttacatatcttcccatatacacattccagacttgtctgatggttatttttaagaatggagtcaattatgtttattttacctctatcttatgagtagctcctttaagtaacctttgttatatctttgtcttactatgtctaaagtctgtaatactggaaaccttagtgtgttttcattcctttctttccatgctgaatacacaaacaatctcatgaagccccacggttttaaatgttaatgactttcaaatatctacacacacttctaccctgctgcctatttgtcagttctttcttgaatgtctaagagataccacacacttaaaataccttaaggactcttaattttaccctcagatcttgctttttctgtagtcttcttcatgtcagttaatgacattacaatgcatttaagtactcgggccaaaaatctaactgtctttacctcactgaatcttctcctttcaatcagctgatcaagaagttgaatctaggctatgttccaaatatatttacaactgatacattttaacattctcaccagtaccaccttaatctcaacaaacatcagctccagctggattaattttaaatgtctcctaaataatcaccttgcttcccttctttctatttttcacacagcatccagaatatattttaaaaagataaattacaccattctcccggtgctttggagggaccattcatctatccaccactaatttatgctcttataaaatcatttagaaagtagttgagrtgtagttctactaacactcaaaattacactttttgttgttttgttttgttttcattttgaggcagggtctctttgtcgcccagactggagtacagtgaagcgatcacagttcactgtagccttgacctccctggctcaagcaatcctcccacctcagcctcctgaattgctgggactacaggcacacagcaccatgcctggctaatttttttctgtttttttgtagagacagggttttgtcatgtcaccaagatggaactcctgggctcaagcgatctgctcacctcagctcgacaaagttttgagattacagatgtgagccttcacacctgtcctaaaattacactttaaaaaaattcctgtatgttatttgtttaggtcctaatatracatgttctcagaaataataggatagtaactaatggtagtctaaattttgggtagatggtattgggaaaccactgtgcatttgaagagttgctagatatatgttataaaatggcattgttcacattttgttttactttgaagatttcttgtacattgtaatttccatattaaattaatctttagcttttactgattttacactaagaaattctttatcgttatgctaagaaattgtattaaaataaaattttcttgttatttttattttaggcgggccttttttgaaggactacattaccattcaaagtattgcagcttcctccattgtcacactgtatgctacagacctaggtcaacaagtcagttggaccacagtaagtgttaatttgaaatgtaatatacatttctcatattttgctctaaataatttattgacagattaattctatcaaataaactcatagcgaaacaaaatgtagtgaaaggtatttttaattttctattcttactatgacgagtggccaaagttctactcaagtattggagcaatagaaaaaccacagttttgaaaaaggaagataagttccttttttttttttttttttttttaaagtcaacccactctattactgggagcttcaactttgttaccaaaataccagaggttcggtctaggtcctgctgctcactgcacagaaagccaatgatggtgatgacaagtattgccaaggaagaaggcttcagttggaagctgcccctgaggagatgggagctcagtctcacatccatctgcctgactgactaaaactaggggtttatatagcagggaagaaatgtaacaatgtgtaagaaaacatgtactagggagggacaaggaggcatctggtggggtgatctgatgaatttcagttctttgatactcttttgagagagctgaaggttctctcctgaggaatgagcttaggtagaacagatacaagtttcaaactttaacagtaataggggtcaatttctacatttatccaaaaataactgtctatgggactattgggctggtttcatctgctccacctatgctttgttatttacatggtatctctttaccttttccttctagtaatctaggaacatcacagattcttttgacactggagagaagagtatagaatatccagttaaaaaggaggttctcaggcagagaaacaaacttttggcaactgaccatgaaaaagtaaacttccttcagcctgtgaaaatattattttggctctttttggaggaaaatagcaggtgttaaaatcatggtatttgaaaatggcattagatgaatgaggacgacattgaaaagacatagagggttaagaggcagtgaaaatacttggtactagtgcacagtattgaaacactcatgggtaatagaataaatcaatggaatagcttcaacagcaagaggaaatgttaatatgatatttagtaacagaggcagtgaaaaattaataaacagttttgatatacaaakaataatgagctccttttctttcaattacattaaacttctgttatttgtattatttaaactatgaaagtttttctttgcatttacattccactccatatttgtgattacttttaatatttttctattcaaaatgacttttctttttgccacaattaacaatcaatcaacattaccattcatagtgatttgagctgtttctttacaattaaacaaccaatttttgtaagttttacaaatgtatgataatttatacattaatatttgttaattttaatctaacacaaatttaattttaaatttattaattaaaatattgctacatctgtgaatattttctaacagtctttctttttaagatatatttcccatgtaattaatgagttctattttatgttttcattaagaaaatattttctgtgtgaaaaactttaagaaattagtagtatatatgcccacaaaggtgagaaaagaagctgccaatgttctatggtcgtgtttgcagtacagtaaggagctcaataaatattttttgaacaaacaaataaatgaatatcaaatgaaaaaaaatagttgatttattttccaaagtatattgagcttttgagtactaacttgtaccactaaagattgagtttagaaccttatgaattcttgtgaagcacattttaatgtttagaaaacaacctatagacgatgcatgcatttgcaaataaagttttaatactgtacttaaatgtgatgtctacagacctttgcttaaagagattttagaaaagagtgtttggtcttcaaaggttaaaatattcacagggtctttgtccacatttacaacgaaaagggaactctgtttacagaaattgygtcagggtgagcagcattaaaccattaaatcattagaaatttcagcttcatcacttggataagcactgagaagaaaacacactatagtggaattatttgacaattgtactagaaaattatagcttgtttgagaggaaaatcatctatgtgacaaagagaactctgcaaataggctggatatttctacatcaaccccatggatcacacatctttttgctccaaatgagtcagttctattaaatgctaaaaatatacacattacattgcaattacacccatttcagatcaactaaattatgcaacaaaagtaatgttttaccacatatgacattcttgttcattgaaaaatatgaaaatttgttcctataataaataatataatagggaaataatctaatttagcaaggttaaaattaagattttaatatttttctccaactaacagtgtgttacaaaatattgagtaaaatcttgcctcatttaacttactaaaaaacttaggataaaagattaatatgaaaatataacaattctcattatatgaagactgttaattaattaaagttatgcagttttcaccatttttgtattaattcatgtatgtatgagttaatgtgtaattctatacaatttatcccttgtataagttcatgtatctaacaccaatgtcaagatagagaattgcttcatccttaagaaggaacttcttccttttatctttgcatacttacatacactttttcctatcctggagtaaccactgatgtgttcttcatctccatatttttgtcatgtggaaaatgctctataaaaggattcagacaatattttgagattgatgttaatttttctgtaagcatagtgtccttgaaatccatcctgatttttgtttgtatcaataattggttcctttacattggtgagtagtattcagttatatggatgtaatggactttgtttaaccacttactctttgaattacatttgggtggtttttagtattttgctattaacaaataaagctgcaatgaatattaggggtatttgtatgaactttttaaaaaatttatctgggatacagtgttgagtcttgagaattctttatgtaatgtagatacgagtccttgtatatgtggtttggaaatattttctctccttctttaacttgtcttttcatcatcttagcagaacttttcactgaaagaattgttttcaattttaatgcagtctaatttatcaaggttttcttttaaagattatgcttttactttcatatataagaatccttcaacttagttgtaggtcctggagttctctcctgcattttcttatgagtttagtagttttatgttttacactgtaatgataccctatttttattgtaaatttcacatttttaatgtctaaatctaattttcttcaatttgtctcacgtgttctataacccttatttctctttttttcttaccttattttgaattaattgtcatgctgtcttttctattacctttgtgttattttggtatttatatcttctattttactaattctaggggttaccaaagagattacagagtgaacccttgagatattaaatgctaatatacatttttacatttgattttactaaggtaaaaatatttcataaatattgaatatgacattgaatgactttayatttgagcacctcctgactcattttcatggttttggtacaatataattttccatatatcttaaatccaaatacattactaaaattttatctaacaaatactttatcctttagacttaacctttttgctgcgatttagttatttcttctaatgctgaacttacatctgtctccttctccctgaagaacatctttagtgttttattgtagttctgtcattgatgaattatctccattcttgtttatcttaacatgtccttattaacttttattgttaaagaatatttttacataaaaataagtttatgttggcagttctcttttcttgacttcacaatattttatttttttaatttstgaattccattgtttctgttgaaaagtcagctttactcctttgaaagtaatgtgtcttttctaaacaattcttgtttggttttgttatcggcaatttgactatgatatgcacaattattatcatatttttatttaccttgctttagttttatctgagttggtggtttcatgtgttcatgcgcacacacacacatgcatataatttgaaaaattagctaccattatctattcaactatttcttgtccattattctctttaaattcttcttttaaattttacattacatttcaatatttttcttttcaaagtttttacatatctgaaaatctcaaccttatctttcatttaacacataagagatagtttttgttaaagtttgtgtctgatattcctgttatgtgcatctttaatttttttatttttatttttgctatttctcttggttttgctcacagtctgtttggtctttgtatacctgcatatttctaagtacagaaaatgtatgtgaaaaattttaatgatagctgagacttacggtgatttttatcttctttcaaatataagttaccatcttctaaatgaatgaactgtattattggatccaagtcatcttgatcaaatcaatgactgaaatgattttaggttgagctttagaatctgtggagacagttttatgaggccaccttcatcctttggagatgatgaacaactgtttttgtttttttattcccaggccccatcaaaaatctgttcttatcaggctcatatgaggcttcttatgcaaggttcaatctcttctctggatcccccatttcaacatttttgaccttctaattcctcaatgacattaaatctctgaaggctgaaaaaggctttttaaaaatattttgatcagtttttctcactagactcattagtattctgtgtttgaattatatagaatagaaatctccattatatgttatttatctgtcaaactacaaaaaaamcacaatctttatctagcaggatactaacttcaacagtattcattaagtacaaagtgatcttactgtattacaagtgataaatgctcccaaaactttatgcaacacccttatcttcaggagattaaggttaaaactactttattttgttttcaacaattctgaaatatacatttttttaactgctgatagcaattttagaaaaagagacagtaaatccaacaatgccctaataatgatagcactcatttttttttttcaagataaaacgaaatgcattaagcacagtttaagcacatgggctctcaccaattcacagttgcagccatgtttcaatgtattttttaagcagattattacctttttctttttttctttttttttggagacggagtctcgctctgtctcccaggctggagtgcagtggccatgatcttggctcactgcaagctccgcctcccaggttcacgccattcttctgcctcagcctcccgagtagctgggattccaggcacctgccaccacgcccggctaattttttatatttttagtagagacggggtttcaccgtgttagccaggatggtctcgatctcctgaccttgtcatccgcccgcctcggcctcccaaagtgctgggattacaggcgagagccacagcgcctggccgattattacctttttcaatttgtacatatatcacgttgaagattccactgaggtttcaaagactctcaatttccttgcttgcctagtacaaacaatgaattttgtattcaaaacagaagattagtttaatacagttaactttttgaaagaggagctataaatactatttgataatagaaataaattgaaatttcaatatagtgtttgtcttcaaaataagaaaaaggtgtatctgcctctttagaatatagtcttcagtataattctgtattataggggagtttctagtctgtaagttcttgcgatgtacttggtttgtatatgactgcttatctgtttacttgattgtatttggttttgattttgttttatttccctttagtagaaaagaccagttccattttcagaagaccatattaatatgtgtctatctagcccttattttcttcatcttgaactattttctgattactttctaagtttaataaatcgtcttttcccctttcttctatttgcactgaaataatttttttaaatgcattgtccaaaagttacttatcattctctagtgctttcaggacatattattcataaccctccatattctagcagaaaaatattctttataaaatattaagccttctaaaacatattttatatactagtaggctctcttgaattatttttgagagatgattgagataagattatagtttaatttcctctcatgcgaagaaacttcagatctgtgttagcatttttattaagttaataaagattgacacttggtccaagttaactattgtacacaacattttatattcctgatatattcttagagaatttgctcaaatttgacttcactagatcaattggtgttgaaataactattttaaacattttattgtactaaaacaattaccctcatcattattccagagttttggcattctatcattacacattcacaagtggcaaacattttctttatatctgaataatggggtattttgtaagccataaattactacagtctctcaaatgagattgctttttatattgacttgatcagaagttgcattgtttttacttctcacacacaaatctttcttggtacatgagaaaatatatatatatttctaaaagacagaattataactgaagaaacctccatatgtaaattactatttatgtatttgtgtgtaattatgtatgtatataaaacttttaattacacacatatatgcatatgaatatatatgaaaccatgcatatgtattattcattctaacaatcttctcaacagagctgtgaacatgatttctaaccaatgtggacagctaactgcatttttgagcaaaacatgcagattcaaattgtttcttaaaaaaaatggtagcagatgaagacaaaatagttaatggtagtcaaatttattattgttaagttgtatttttttctctttgaaaactccaaagtaaattactttcccttatctgtctaaatacttcagaggaaatttaacatgattttagcactaaaaaatcaaacagctatcaaatttagaccagttagccaattaatcttttgcaatcacttcgtcttttttcaattacctttccaaatattgttagtgtctctctatagttcaaatatggttacccccactcagctcaagcactcaaaagttaattattttaaccatacaaccagactcattagaattaaaatataaaatttctaatagagaaaactgaattgtttccatttgaattagagtcaaatcaatggattcaagctgacaggcccatggagggtagggtagggaagaaaagaataagaaaaagaaaaagaaaaaagatactctagctcattcaatttattgacagggacagtttatacagaagattaagtgtgtattggactgggcaaatacacagaaaaatatattaataatggttagtttattaaaataaaatctcctttttactatatctgaagaaagaaaccagtttattaggttcaatatttatttttattccaaattaactatacatatattaggctttctccccctggttcttccaaggaagtcgttatttgcaatatcacttaatctagttacaaaaaatctacctgtttcaccaatttatgcagtaggctaatactcatagacacaaatgaaccttaaaaacatctatttttatcgtttaatctaaatcatgttttattttcaggtgtttttggctgaatacacaggacctctgctaatatacctcctcttttatttgaggatcccatgtatatatgatggaaaagagagtgctagaagattacgccacccagtggtacagtaagtgatacacacacacacacacacacacacacacacacacacacacmccatacacgttaaggaggggatgaactagtaagcaggtaaaatattaataaaggttgttactaaacgcgattgaagtggrtatcattttatggaaatgtattttagataaccacacatagtgtatgtacaccagcttccaaatttgtaaacyaagaactattaggtataccttaaaatagaggtaatttaccaatgatcacagctgtcaagagcaactgcgaaattcagaaacgtagtcaaaagaagtttacaattacaaaattgaaagaccatgtataggatataaaatacaaatgcttccctaaaaatatatttatttatttggcaatgttacataggaaagaaataatgacctaagtaatgaacaggaagaaaaaagtttacaagttactttttatttatttttatttttattttattttattattggtattattttttgagacagagtttcgctctgtcacccaggctggagtgcagtggcctgatctcggctcactgcacgctccgcctcccgggttcacactattctcctgcctcagcctcccgagtagctgggactacaggtgcttgccacaatgctcagctaatttttttttttttttttttttttgtatttttagtggagacgggatttcaccgtgttagccagggtggtcttgatctcctgacctcgtgatccgcccgcctcggctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaggcgggtggatcacaaggtcaggagatcgagaccatcctggctaacacggtgaaaccccgtctctactaaaaatacaaaaaattagccaggcgtggtggcgggtgcctgtagtcccagctactcgggaggctgaggcaggagaatggtgtgaacccgggaggtggagcttgcagtgagctgagatcgcaccactgcactccggcctgggggacagagaaagactccgtctcaaaaaaaaaaaaaaaaaaaaaggagtaaggcaataaacaaagtattctatataattgtggtgtttagcatattgtgaaaataatctttctctctctgtctctctgtaagaaatatatgccaaattaaattgaaagagaatatttattcaggatgctatagtgggatctggggagggaaatttgttgaaaaaaaaaaagacctgaacaaattttatgcattaaataaactccaagtgaattaagaagcaaattgtaagtatttaggtcatatggatactaaaagataaagaactaatttcatcctaactttcttacctcgaatcaagttttgcctacctttaattacagtactccagccacactgacctcctttcttgtcctgattagctactgtgttagttcgttctcatgttgctatgaagaaatacccaagactgagtaatttataaagaaaaaaagatttaattgactcacagttccgcaaggctggggaggcctcaagaaacttacaattatggcggaaggtacttcttcacattttcgtaagtgaaaggaatgaccaattatttttaaaagcggctgggataaagagattggaaggagaacctaaaagcgttctttttttaggctaaatatgtaacatataccagatacgtagcagagcatgaaaaaagttttctttagtgtcattctcaaaggaattgactcatatttacatttttttttttttttgagagagggtcttgctctgtagcccaggctagagtgcggtggctcaaattatggctcactgcagcctcactcttcagggctcaagccattttaccacctcagccccctaagtagctgagactataggtgtacacaccatcacaaccagctaatgcttaaaaaaaaattttagagatgaagtctcattatgttgcccaggctgttcttgaactcctgggctcaagggatcctcctgcctcagtctcgcaaagtgcctggattataggcatgcaccactgcaccagccttactattcttaaacagaaatacagcatgtttggtagtatctcagtgatgaatgtatttgtgccacattattcccaaataacaaatatgtaaagtttatataaagtaattccacagcagatacacaaactacttttgaaatttaggtatctagttttaggtacctagatttaggtatctagatttagaaaataatcacagggcttctgtcacctaattttcaggatgatgttgttttaagatgaattcttaaattccacatccaattgaaacacattaaaatgttgtctccaaaattgctttgaatcatattataatgtcaaaagaaatttctgctaagttcatgtagaaggcagatttctatatgtgaccgaaccaccacaaagttcttcagatcacttagaaacctccgcacacggggactaaaggtacatctcccataggaactgtatctgcgtcaagtatcttatgaacctgttacctgaacatttccttatcttcttcaacagaaaccagaaacctggtgtagcgccatgcctcccttgctatttgtaaagttgaagctgtgcttttctgtgctgtgccctcatatcctgaaccttacttgatttaaaataaataagattttatcaatactttggttgggaaaaagaattggattcacacctatttatggttttacagttaatttagcaatccacaaaaantaatcagtgtttggaagttaaacatcattaaatagaataataatattttgaaataaaatcagacttgatgagttagcagtgatgtgcatgatggcatatatataaactaagtctctagctgtacattctatggaggtttctatgctctcatggtataatataaaataaatgaatgtactaatatagagaaatcatagcttgaaccaaaatttctcacttagggctctgctacattgctgcttttttataaaacaaaaaaattttattactcaagggtttttgtaactacatctacaaaagaacaataaaatgaggagagataccaatttccttaactaccctgtgtgctcacaaggcagcttcttgtatctggacttctgcttttgtttgtctgactttctagagagctcttcccccagacattcatgatgcttgctctctcacctttttcagaatttgtctgccattatacttataggtatctgcaccacataatacatttatgttacataataggttcacagttttgtttttacgaattaatgaataatgataaatttgctgctgacttaaccaggttagtgtttatttaattatttgtttttcctaaagtcaccctactcgtaccagaaatcatttccactaaaatcaactcccaaacgtataaataaactcaatgtctaattttattattatatagagtaaatgatatgctgatttttatgctcaacctttactggttaaagtatgtcatcagtcggatgtggtgtctcatgcctgtaatcctagcagttggggaaccccaggcaagttgattatgtgagcccaggagtttgagactagcctgggcaacaaggtttaacccatttctacaaaaaatacaaaaaaattagccgggcatggcggtgtggtcctgtagtctagttactcaggaagctgaggtgggaggattgctggagcctgagagtttaagactgagagatcatgccactgcactgcagcctggacaacacagcaagatcctgtctctaaaaacaaaaacaacgcacaaaaagtaggtcatctttgatccgtattgaattttttaatagcaaccaaagtttttgagatttcacatttttatatgtaacaaaataggtacaaatcttcatgaaaaatacattgtttatagtatatccagaaaaatatactgctgtaaatcaatcacatttttgtttacttttaagatagtaattatataaaaatgataagaagaggtggtaacttagagtacagcaacacaaacaaacacacaaagggacaaaattagataggaaaaaacaaacaaaacaaaaacaaagcacaaagctacattattactgcacagaaaatgcaatttaaattttctcaatcttagtacttgctaaaggacaaccagacaattaaaaagttattctgactattataaaatgtcaaatacattccaactaggctttggatatttttaaaacttgtaaattgtctgtttcagtcgaagtatttcgatatgaacatatttgcaattattatatttatacccactcctgggacaggtgtgagcataacagtttatgactggtattataaaatatttctaatgtcatcagaagtaaatttatagagactcttataacagctacttttattactaaatttagaaaattgtgaaaataaaatattaaagcaagtatttgtgttttagctaccagaaacaatgtttcccaatagctagcatattaaactaaaaaaattaaaatgtatcatgcatgaggcaagccagaacttcaaaaggatwttcatgtttatgttttatttttttttccagcttggcttgcttctgtcattgtatacactacatccgataccttttggaaaccttatttgttcacaaagtttctgcaggacacacacctttgaaaaatttgataatggtgaggatgctttgtgtttttaataatgattgagacattttatatgttggatcctttgcaaaatatttaatcattgtttccttccgaaacttagattttcacgtttaattgcataagcatacttaaacattcttttcctaaaatgtcattctttttgcgtgatatatttaatttgaacttaaccctgtagaaagatttgtcattacctcatattacaagacaagctagatactcctaggaatcttttaattttggtaatactaagcactgaattcagattatttgagtgccacttgaagagcagaatatgatataagaacgttcctacaaatatacatctgtgtgggattaaaatggtgatactatattccattattatggcagttgtcaatatgatgctagtgtgtttgctcttctagaaattgtgaaagcaacagttatgaactatcaaataactaccaaaacatgaaaaaatatgtaaaatattgacatgggaaagtacattagacaacatgttgaaactcaattttcaatttaagctaaattttgtttttcaatttaaagtctattttcagaaaaaggtttgtctgtaaaaaaagtgtcctgttttttgtcaaatatctgctttgtaatatcgcaacagaacagccattctattgttgtcattgcagtaaagcagtaaactgaaattctgagacctcagaagttatttaggactgcttttttaatagaagatattacaatcaatcaaatcagttcaagatcaccattatagactacaactcctaaatccgagccatttccattccagtcaatcaacatgtgttactaccaattatcaaataatttattttttaaattcactaattgttagaaaaatattagtgtatcttatgcaattgataatttatgttttatttttagtaattcatttatatttactacttacaaaataattctcaccaaatttttctaaaatattctgttaacttgacatatatcacaaatatccattaatattagtacaagtggagcaaagaaatgcattttcttagtgatatcaaaatagtatttgtaaaatgcttctgttaccatctccttatgccttagtttagtgaggtctgagttctcgtctcacaaccaagaagaattaagacacatggccactagacagtgattagggcagagtaggatttattaaacaacataaaagctctcagcagctagagggtacctgaagaagattgccagaaatggggataaattcggataaattctgggccttttatgtgggaaagacaaggaagccttctgtggcttacaccctaaggggaggggtagagatccccctggggttgttgcatcggcacatgcctgcggttggccatagatacttcatcttggctattacttatgagtgcctaacgaaagcctgtggaggggggaagctgaagccacaatgctaatggcactatgagttcaggatcaggatcaatttagtatgcatctcagttcttgtctgtacctgcgcaggtggctggagagtttcttctgagtaagcatcttggtataagaggaaattcttaaccacatttccttctgccagctacataatgggtggttcaggtgtgttcttgtaggcattgtccctcttgcaagaccttctatctctatctgcctaatcagcccctacctacctcctctctcattccccactctggagtgttaaccctaactgccattaggtggaacggggagataactgctctggctttttcaggctgtgagagggtgttgttccagaaaggcagagggattctcatgtggtcctaattctagtacttcgtaagtcctccagtatgcacatttgaaagtgttttctcctccatcrtcccatattatcattagaagcctatttaggtcattcaacggtactgctgtctttccaactggataaggccttcccttgtctctggtattatgtgagatatgaagctcatatccaaatttctttactgcttgcaatgctgcttgtttctcagcagtggtcagagtttgatttaagagtaacatatcatccttttagaacactttatatacatgggttaaattctggaaggcctctataaatgagtgatgttggggcttgcccagagtgaacattagggtctgagggtaaaaggagtcccagtgatccaggttgttcttaaggggagtgcaggctgaagatggattgttacacatatggaaagagaggggagaaaaggcatcccttagtctgtcttccacttttagggtgaacttggatggggagagagagagaaaaagcatctcctttctcctctcctcgtccttgtatcctctgggtcccagcaacctttataggtgtcacctgtggatgcaagtgtgacctccaacaacagaccaggagggctggaaggtaggaatagtcacacttacctatgctgcaccccagctctccagtgttgaccacctttggggtcccacagatctatttcttcttttgagcttcatacccaaagcttcccacttgaaacttggaaaataccttgaagtaattgaactggggcaagaaacattaatgaagggggggtgtccttaaatctttaaaaagcatcccttcactgataggtaatggacagagccagatcatagcattcaaggaaatgaaagtgactgacctccaaaactagccccttcttcctgcccaggggttgttaaacttggaggaagaataggtgtctttgaaaatataggggttggcttggctaattctgtgtgctagtaaccagggaattagggctcccccagacataggacctatagagctctccacagaaacaaatctttgccttgtcaggcaccttggcaaagtttggaatgttagcctgtaactttgtgtccaaattcttttcagacagaggtttgaaagagaggagtttggggcttggtgagcatccctcaaaataagcctcctaggagaagaaaattgatttctcacatagtgcacacttcaatgcttgctgagcagtgctgacttctctcatggaaataagaagcagcctagatggagaggagaatagtcacccagggagaaatagcctcctttacagtgccagtgggtctccttgactggagaaaggaaactctctaaatctttatatatcccttgttctaagaacaggtaaaagcaacattgttctgggttacacttctgatgagtaagcaagctactcaattttcccaataatattatctctcctggttgcaaaaacatacataacattgaatataaagaagggagagcaacgatgatagtctcaaaagaaagaaaatgtgatataaaatactggaaatctttatccaacaccctaatggggtgtcagggactggagccagtccaaaggcctttgcgtaacaccaagatntagcctcwgccagataccttcagttgccccaggatatccttctaagtcccacacaacggctagagctccatgaagggaaactgttttggaacagaataaacattcccaacacccacggatgaagaggttttgacaaagtcctcattggtaagcttgtcttttgagtcttgtaggagcaacagccatgctattcactcttaactgactgacagaggcccagtgttttgtttggtttcatataataaagagaggcaagagctcttggaaatgaaagtaaaagaagtctgcccttactcacccttcccatgatcctgagcaatcccccaaaatgttgcagtctccttattccttagtttagtgaggtctgagttattgtcccacgaccaagaagaataaggaacatggacactggagagtgtgtaaggcagagtagcatttattaagcaatagaaatgctctcagcagcaacaagggacatgaagagggttgtaagaaatgggtctgagtcctcagtcttttatgtggcaaagacaaggaagtcttttgtgggttctaccctaaggggagtggtaaaattccccctgggggtgttgcatctgtgcatgcctgggtttggctatagctactccatcttggttattactcatgagtgcctaagtgaaacccatggagcagggagggttaaagcacaatgctaatagcattataatgtggtcaggattgttttaggacatcctcagtccttgtctgtgcctctgcaggtggctggaaagtcccttttgagcaaacatcttggtataacaagaaattcttaaccatattttgtcctgctaactccataacaggggcagtgcaggcacagtcccacaggtgttggccctcttctgagaccctccctctctgcctgcctaaccagcccctacctggttcctctctcactattacattgggcaaagtaatattctgtttatttagcttagacaatttgtaccattttacatataaatgctgcagtgtctaatataaatgtatgtggtggtttcaaattgtgacatgcatgtaatataaatgtatgtcacaattgaaatatatattacatatttttcctaacttttattttgttttgttttgtttgcagagttgtgccttttactggggatttacttcttggattgcctactacattaatcatccactatatacaccaccatgtatgtagggtttcttcttaactaaccgtatactaaaggaccaacctaaaaactctattctaaatgacatacataaaggaataagtaaaaaatgaaacaattcattttaaattgctttcatatcatatttctttaaatgtttatgtaggcctacaagaccaatttgactcatatatttttatttattttgtttctacacgaaccaccaaaaatattagtaggttgtaaacctccaaaaaaacagctaataaaatgaaaaaacaacaattaaagataaaattattgtataattatacaatcatatactaatcagctatcagatattttacaagtaaatgataaacatttaattattcttttaaatataattcaacaaaaaatagggccaatttttctgtgacttatcagtttctatttatgatttgatttactaaaatatcatggctcttgactcagatgaaacatttggttgaatgtacactggatgaaacctaattccttggttcttaatcttcaaggaaaaagtttgccctgatcaaggaatttcatttcttccttcaatgtggacttttctctcttcagctcttactgtagcacataaggcacacaatgtaaagctcaacaattaaatgatttctcatttatttgacaattatttttgtgggctatttctggtgtttacaaagtttaaaataaatggtatattcaaactttatttttaaattttagaaaataacttaaacttcctttatttcttggctgaagttgtaatatagagaattacaatgttcagggtctttgccaaaaccaacaagttcagtctgggaagtgaagagtcattgattttaatgattaaaacttcagctggtcttaatactaacaattaactatgaatattgaaagtgaaaatttcctatatcttctgatttttcaaatattttataagatgtacttattacctttacaacgttagcacatagaagtattgctccagactatgttaataagatacacttctgaaaaatgcttcattgccatattggttacaaaataataatagtagttaattttgttaatatatgtaaaacatttattgaaaactgactatttgttaataactgtaaatatgctatttatttttaattaaaaacattattttgtggctttaatattccccattgaaggctagaaaaatgatgccatgaaaagataatttcactatgctcaagatctttaaatgcataagatacaattaggactcaaattctgtgaaaacatattatagcattttaatacttatgacaagtggaaaatgaatatcttgtctaggaagtccacacttaacatggttgtaatatacatgagatacagctattatgctttagttaaatcatgctaaataataatgtgacttctacaacagtatatgatagaataagctgctttttcctttaatagagaaagcataaattaacttttattaaggcttcctattaggtaaatgctaaatggttggcacattttatctcattgaatcctcatgaaaattatactgtttgtattcccactttacagatgaatatctaaactttagaaaatgtaggcagattttccaaatttactcagcaaataactggaaaataatctatagcatagatacagataacagtaaactgtgcaagaggttagccaatccacagccagtcagttacataaattctgtatagacatcatcatggagatccccttcacaaaaatgagcatatcatctttatcttgagttttgatccaggtagtagagactcctatttcttaaactattagttatatgggcttaggatacctaacacacattgttgacaaataacaggacccagagactctctctaatttgttccatgcttatgccatttattgtttttttctgtaaaatttcactattttctatatttatgctgcaaaaaaacttccctttcatttcttatcactttctaagtctttaatagaatattttcccatttcaaaactttgattataattaatagatttattttaattttagaaattgcttatatattgcatcataaatattcaattctgtactcacaaagcacaaatagcacaaactacattatctttaggtgagataaaataaaccttaaaaatacaatataagcacaaaaaaattcttaaaaacaaaatgaggtgatatttaaaaacacttcctaaattattttaacagtaaaagatataataataattaaagagcaactatgacaaggtaacaaaaaaggaaatagtatatattaragctgttttcagcaaagcaggtataatcttaataaataatcatatttaaggaagatgaaatgaaacacttcaattaaacaaatcagtaattcttttaatttttgttttaatatatcttactttgccacattaaacccatctgcttaagattacaaaacagacaattgatccaatttttatattgttcctcttgaaaattttcattaaattatgcatgcttacaacatagtttccctcattttaccctcaaattagaaaaaaaagttactggacttttggactttacctgtttaatctttaatcacatattctgtactttcactttatataaggtatgctccttcaacatacataattaagtctttaattcaggatttttttcttgcattactgccatgattattattttctctggttttctgttgttgttttttcgtcatagttgacactgctcttctttgctctctatgctaactggtctttttcccactcctttcagaattctctgtggtaacagtgtttgacttttatcacaattttcaccacaatctattctcatcaaatttggctgcataaagttaatagcatctgtatattaatacacaaaagctaacttaattgaaaaacagcatgttgtatacatatttccatcacatattctactagagtttattttccatacttcttgaataatagttaaatacaactaaatgaaatasattatcaaaattgtaaaactgcccaatggcaggaacattttaatatacccaaatcagaatgtatatgttcaaaaatcttaatatataaatgtctactatcaacataatcaaagaataatggcctattaggttatttttacctatctaaatgtgaaacattatacagattataaaatattattaaacattttaataagtgttataatgactaatgtaaatagaaagttttttctcttcgcactacctataactttgtttttttggaaataaatatgaaaaatattagactcttcactcgatacttgtttttatcacatcattattcattttcatttaaaaataagaataaggcatatgtttactgtactctgcctaatgtgctttgaaccctctcttctctatactaatgtgcattcatttttataaatcaaagcttaattgtgtactcagaagaatcctccctgatcctcccagattacaagatatccttttcagttattttattaaatactacatagatctgtatagtagcacttatcaattttaacaaacttccgtttgttatcatgtgattagtacttttctgggtcagactataagttcaattaagattgactttggctttgtgtgtactttctcacaagcgcaaagttcagtgcctgtcatgcgaattcttgataactatagttgaatgagtaaagttacattgaatagtaggtataaataaaagaattatggctgatacagatgcatagcaaccaactgtgatttggcaaaagcagaatgtttaattatatggcaaaattggtacaacattaagagaaaagtaagttacaaaattgttatatcaaatattataaaaatgtacaacatatatgaatatgtcaaaggggaaaataataatattcactggttttctaaggttgatgagattttagtccattttcttttcccttactacttttctctatttcctaaatgttctctgctaatattttttattttactattagatatataaacttcataaaaacaagacttccaattcatgtacatatggtttgtatatatatattctatgaatatatatctatgcaaaatatttatgtaacctttaactaaaatatgcttttaaatttctagctcaagaaaacaaaatttagtaaaagatttatacgtaaagatgttcaaagcagtattatttatcacacataaaattaaagtgaccttttcagccattctatgattaatgttttaagagctagccatgtcttgcattattatgaagattcaattaccgttatgacaatgagtgtttaatactattgagaaatctttaaatatattgttaggtgaaaaacgcacattttaaaataagggataatatttttatgtgtagatgcaaatgtgtttatataaatacaatttacatgctcacatacataaaatgagaagataggaatgcaactgttaataaatatgatgataggtttatcaaataattctatttttattattattgaatattccaacttttccacagtgagcaaccctgcctttagaacattgctttaaatggtgttttctacattactctttatctgccctttggaacttaacctatatttttttttattttaaggtcaggcaagtaatacatcatatatttgttataataaaaatataaaatacttataattctacctgtgacaaaacatcaatgtagaaaacaaatgactataatcagcattttcctttttattgttaaacattaaaaatgagagttattttgtggtgccattatatgcttggccatacttaagtgtgcttttaaaatgggacaaattctaaatctgccttcaaggagtttaataatacaaattaataatatattccatttgtaatttaaatatcattatgttaataacaaaagtacatgtgaawaaaaagtcaacactttagattgcaaaagtatcatcccaaaaggtgaattacatactagayagttctattgattatagaatttatacccaataaatactgcctgaattatgtctatatatttgacaatccaaactatgagtatctgcatgacatattctttttctactctccagcatttggaaacaggcaaatcacagtatctgctatcaattttctggtatgtatcatatatatattttgctattcatgctctaattttggtattattaagaaaaacagactgtatctgaagatttgtcatgtagaaaatatgatatatatttatataatatacataatgatataaaatgaagtaaatcatataactttctataatcaagtctttagctctctaaattttataatcaaaatgttgtagtcatctctaaaggttgattagaattatttgaaatacaataaatatttgaaaaatttatactcactgatgctactgtgtgcacatttaccaacytataaagagcaaaaattttttgcaaatcttacagacaaacaccccaaaaacactttggcataattgttaatttaactaattcaagatgaactcagagttagcctttttaatgaaacctggctctttctaaactgttctcattcaatttctttagattgttatatgtaaataaacatatatgtagataaaattgtgtggaaatcaatctgggtacacaagactcttgattatttctaaaatgcattaattatttcatttgacactttttttaagtgcttataagctctttaactccttgctttcatctgtgttcatgttctcctttcatccctgtcattgataaattagttaactcctatgattcatctacaagttcatatttcttgcaaagtttgtgttcaacaacttatttctaaccattttaatacaggtcataaatcacctgccacactttgtaaggagctctcacatgaccctctcttgcttcctctctctctacatatctttagttaagagtttaggtaagaaygtcctccactktgttggctttgaaaaggagagatctttttttttgtcttttcagcatatagtttggcctagcaagaactcattacttgtttgaatagatagcacagattatttatgtatttggaatttcttcaacaatatgttgaaaatatatcacagccttgtaattttccgattgtgcatactgttcaaggagaggaattctgtgattcacgtgttgtaacagcgttatttaatgttgtatacagcgtactacaacccctgttgtattaagactaatgttctgatattaactactcagtaaatctgagggaagagaagaataaattcatggataaacaaaataataaccacctatttgttagtaatttcagtatgttttagattaatatctgattattagtctactttttctcctccttatgatgttgtccactttttcaaaaaaattgtgggttataatttttttctgtgtaattaagacaactcccttttcatgtaatattattaatttcttcccttttctcaaatataatatggctatgtatgtatttattccttcttttcaaatgtgtatgataatactataaaataaaacttttaataagtcatttcttttatttaaaaaagttatgttactataaatatgttataatatttttcataaaatgttaagaggcataattagacataagcaaaattctaatagcttgcaattatactttttttccccagagacttaaaaattctgctttcttataaagctactggtttttcgtcttcacatatcactttgttaatcaagtatatttcatacagccccaggcaaaaattaataaacccaaagatgctaaattagacaaacactgatagatggtgtaatagactatgtccaatagagatgaagtaggtaaatgtgataactttaattgcacatttaagcacatagcaagcattgtctgtttcaatcacacatttaacaatttgataaactttaaatttatataatctttagatttaaatattttttaaatattgaaagtaatataattaaaacctgtgcttttaattatacatagcataatattaagcataggtgaaaacctttcttaaaagtaaaaaaattgaatgtagttatattccatagaaaaccaaatttagaaataagatagaatgaccactgtgactcttttacacacataaattgtcataagaaataaagaagacctgttagtcctgaaatttcttagtagtgtttactgttaagacatatttaactttcacaaataatatatgatagtaagatattagtgttaggaaactgaatccaatataagacataataacaataaccagttgattgagtttgcatataaacataaagaggtctgctattcattgaaagcataatattctgcaatttaaagtctattcttcaatttataataactgaatatatatgtatgtatgtttgaaagttattataagtactatatgtgcaaatgatttggaaagaatagtcagcatatgtcaagtccaatgcatttgaaattatattctactatgtactgtttattgtaacataaactaacagtagatagtacaatccatattgtacagaagaaacaaaggagaaattaatggatcgatcttatataatatgcaattcaaccagaaaagacttatcttaattgtaaatgctatttttttgctgataaaacgttatattaacaaaacttattcttatttttgacctatgtactcttttaatataagatgaagaaagtattattcatttaaattgattttgttcctgtcgttatgtaaaatcagattatcacctagtaagaagataatagaagaaccatgttgaatagagttgtagttaattctcgattacccatgtcagattaatctattttgtagactgttaatggttattaatttattttcatctccctcttgttttttctactactattctgagttttctaacatattaagcaaaataaattgtaaggaaaacaaaataatttacawtgtatacataatatgttgtaaaatcaggttcctatttggtggaaaattcttccattttggtgaggttttttctatctctattatatccaaagaaatagtctatcacctctcccttggtttaaattctttctaactttcaacacaatttgatcctcagatatgttcgggtatcacaaatctacaggaaaaattaaggagaatcaaatrcaggcaaatttatgaagacatcagaataactttccacacaaattttagatgcaatcttattgtctgatgtaaatattgtgaataaattttataatttagtctctttatatttccatgaccccacctcatcctctgaatccaattccacccaaaagccaacaaataaaaataccaaaatcacaattgtgaaacaaaatatactttacctaaagaaccttcctattttctttatctttttgtacccttaactttatttttactctccagaagcaattaaagtttgccaattctttgcagaatgaggattttaccaaaaaggaactctttttctagcctttcttaatgtcttcaaaaatgaaggaagtggaagaaattgataatagcatataagatatggcttacaaagtaattaaaataactattttccctagttttgcctctgtgtcttcagtgttgtcattagttattcagtcacttaggtgttttaaaattattcctaaaatgcaaatggtcttggagaagaaaaaaaaatatgcttttatcaagtaggtatacctctttttgtaatatttagctgaaaagaacctcgggtacagaagtggtcattgattagtgaagagggcgctgggaacaatgtatcatagcttttaaaacaggagagcaagtccctactatataaaccacagaaaggccaagaaactgcttatgaaatttggcatttatggataagatgcatgaaagaaaaaagggtgccaaagttcagtgctttcattttcagcagtctactgagatttggttatgacaaattttctgatcacttacctaccattgataggtaccaataaaaggatttatacttattgactgaaaacaaagtctagtactctgtgtgttttcatcatttgccattttgctctcatctcaaatttcctgaagcatctgatataaaraataacatacacaggaatcaatttttatacttaaatttttggggatcactacttattaaaaatttattttgcaaactagttgactaattaaagatataaaattaatggcaatattgtgcttcactcatttcattataatttataataattgtctattttgagctacgactaacttactccaaactgcagaaatataagagtaatgatttaaatcaaaatcagcagtgattataaaactatagagatttcacttgttagaatatgtgatatcgaatctaatgtaaaaagaactcctgtgaaaaaatcatgaatgttttcaaacattatttacttcagagttagtgtatgtaaactaactttctttctgaagatattcactttatggtgctatttttatgctatattttcatatttttatgttatacaatattgcatgagagctctataaattaaaaaataattctgatatttccaaggttgtgataatgaaatggaccatcatagtagagatgaaataattttaagccttaagcaaattccaaaatcaaatgatttgaattatttttattgattgataacatctcctatatcacaatttttgcaataaaataattgtttcatgcaaaaaataagttcataaaatatattaaaatattaatacrtatttcacattatgtaataatataaatgcaatatctgaacttttatttagagtcttaccattatttattttgaaaactgaaaatatattggttagtacatgtatttttggttaaacccaaaatttacactaaatgtatttcttttaaagcacaatacatgttatctttatgtctgtataaaagatagaaatgtgtatgaaggagcttcataataaaagtgcagaaagtacaaattgaaaaaaggtttataattttatgaacacagtaatataaattataataagataaaatgtttatgaatgctgaagcattgtgatactggcttatattgtcaaaagcacttaattctatgtggatatgcattatctattaaagtagaaattaaattgtccaagatcagaatagttaataaatttcctaagtgaaactttgtaataatatatttagctacaattgtccttatttttgaaatattgattcaggtaaaataaataaaacagatataattattattattactattattgttgctatagataaaataataataactgaaactaaacaaactgagcatatgttattaccacggttctttgtacattggttcatactacacagatttacaattccagttttagaagatatgtaagcatgctttcttgaagattcatcagacactttttttttgtccgtgaaagcaagtgtttattagagaaacaaacacctttgtaagcaaaccatgagtatattattacaacatgtttcttcgtcggtacctattacggcatattttgatgtctagctataacaggaaaatacaagtatgctttgccaaagacgcatcataacctattttctttcagtgaataaatgtttggcaaaggaaaaagatgaaaagcgttagtgttaggaacattttagcaatgtctacatttcaattaaattaataaaatgactattacttattgctccaatgataaaattataagatattgcacctgccggctgggcgctgtggctcacacctgtaatcccagctctttgcgaggctgaggcaggtggttcacttgaggtcaggagtttgagaacagtctggccaacatggtgaaaccccgtctctactaaaaatacaaaaattagctgggcgtggtggcatgcacctgtaatcccagttactcgggaggctgaggcaggaaaattgcttgagcccgggaggcagaggttgtagtgagccaagatcatgccactgcactccagcctgagtatcagagcaagattccgtctccaaaaaatatatatatatatattttatatatatatatgtagcacctgccaaaaattaataatgatattaacaatatcaatgcatataaaagtgagaacagttacattaaaagataaaacatcattttcattcttatgaaaatattatgagatcacagtataaggattaattatttttattgtggaaaccaaaaggattttactaacacaaaatgacagagcctgactaattgatggctaccaattctatattaggacgtgtgagttttgttctattgatacatcattttcatttctttaaggaagagaatgatcaacttgatgaggcctgtaaaaaattaacaatatttaaatattgtaaaagtggatcattgcaagctgtcctccctcgaccccttgctttagtcattggtaattggtatcattccacaatgacagcgggttactgaccaagacacaatgcttaacagtaaaagatgagcaactttattgctgaaatcccatatattataattcaattgtgtctttcaacctgagagtgagatttaacagggtgtatttttttaaaaaaattgtagagcacggtatgctgcataatacatcacttacaataatatacattaacaaaagtcctttgtaggttattaatttgatactgccctacactgaacattgttaaatatttggaagtactgattaaaaataaaattaataggtcagagaaatgagagtatagagggtcctgaaaaagtaagtgtttttatttactttcttgaccaaagtatttatttaagcaaaagattatttttgtgtgtagacactgattcttcaatatcgtattagttgacaatttattttgtatttatccttatgacgataactctagataatagaatggattattcgttcgttaacattctgctattattcaaatgaatactagtttgaagcaagaagtattcaaattactcaataaagattatatgatataagtacaaataaatatttttaaatttgctttaagccacgcctgcgcataaaaatgtaaggttcatttaaattttttttatttatcaaacatcatcctaaagttcattattacttaaaacactagcacctagtggattttttactaattatggggaaaaagaacattacatattatttaccatcttaactattttagtgtacaccttattagtgttaaatataatcacattgtagagcaaaaagcacctggttactttttatgaaataaatctaggccatcttgttcttgacaacagaagcagttctggcaatgtccctgggttgcttatagttctgtgagtgtgtttagaaaatgtaaacatttttatttgataggttaaactttttgactaaaagtacaattattaaaaatttttaattgtgaatgattaagtcatttaatattcttaatttgttatactataataatgtaggaaaatgatgctgcttcttacatgtagtgttcaagtactatttctttctaaatttatctgggcaatgttttcttagtatttttattacgttactatgtgtttattgtctagaatatcttgaacatctgtgtcacataagggacacacataggtaatacgtagcatctcatgttttattatgtaagataattttaacttttaataatgtaaaatcaaacttcttcatagcatctgccccaaactttgtttattaaatttctttttaaacttactgtatgccaaatgaagacatatttagataaacatcaatccaggagaaatatatgtcatgctgagaaatattccggtgtttcacatttaattggctctgcaattataatcagtaatagaacaatgcattgagttttacagcactgactgagcttcttgatcttactcagcctttacctaaaaggaaattatatcaccagttttatctaattcagttagcatcgcaaactgtattggattcacctgaaggtgtaaaagccagtgcttaaaatggaaattactagttattattgctctttaaaatccttaagaagttgccaaattaatatttaagaatctctaagcatagagatatagttgttttttctccccactcttaccatgtaagcatttcatcagtagatagcaaaatggaaaagctggcttctttaccactttttttctacctttctctctcatattttttgttttagtatgtaattatattttcttctagggacagtttcacctaatgaaaaatttggtgttattataaatctatccaggctctaactaaacctatatgctatttttttcatggctcattatttggttaaacaattgacgttccaatatttagttttgttgtgataaataagcaggaagaagaaaatattttgatgtttgaatgagtatgaaaatattaataatctcaaaacaaatacgtttcatcagaagaattataatttctaaaacttattttttcacaaattttggtaacaacttgctttttaataaatattttataatattttctatttttgtgtttggcactgtgagtgatggaaaacgaatatgacaagctgtctaagttgaaagatgtacaaaagatacgaagactaaacagaaatgtaacaaaccattagtttagtaattatgggttttgtagtgctaacgatttgttagaatgaagtctagagaagtgagattactgtaggataatctgtggaagtttttattgattaaattgataactaaaattatcacaataattttattgagcaaataggctgtgtagggtacttgactttactcaattgtcatgaattctctagagacagaagttaatatttgcatttaggtgaagaaatgaaattccaaatgtgaaattcactaaatctctcatacatagtaaattaaatatgtggcatgtgaatgcaggttcatgccacaaaagcccacacacttatccacatttgcatgtaaaaatttcaacttaaaaagtattacctgaaaattcaaaattccactttgtctttctaatgataacttaagaaaccaaaagccttttcgataattattttgtgtagttatgttggtacaaaatttgtatttgtattgttttctggatctttaaatacagatttaatatatttggtgtatttgtttacattatgtcctgggtgaattaatttattgaagatgattattttaaatagcatttttacctaacagttctagatgatgaaaatggatttaaattttctctttcaatctattttttcctaaaatttagaaagtgttgaaatatataccagttatttattgtgagaaacatccagaaattaaagtccatagaactattattatatatgaaaaatgcatacagaaatggttgaaaagaacaaaatccgatatattttatgagattaataacattaaagrcactgagtttaatgggtgctcaacttttgggatatattacaagttgaatgacttcaaacaataacaattttgaataacatgttctgttatcagtaacatagtatttatatgtcaaatacatagcttatgttaaatcagatgaggtatatatgacagacaaaggaaaggtcttaccctcacaggacacatgttgcaaactgggaacattattagtctcaggcgatggtggtaagcctttgatcttggagggacatatggcctattaacagggacaactagtagagtgcatatgatcaagaggtcatgatgacagagaagcagcaggtttctttgtgtggcagcactgctcacagtaggttttccaaactgagctgaaactagctggaaatcaaacaatcaccatttcrctagaaatatttttactgttaatgaactgagattaatacgaagctatgccaaatatgtcttcagcaagagttgtctctgtatgatctggaagtctccccatagtaacaagtacaaagccgattaacaagacagtttaaacttgattatcaaacagcgtgaaaaatatcttcagaatttccaacttgttgtgactttttattcaatatatgccagcaagaacttctttcattgttataattaaaaaaaatttctctttatgattagaataaaatatatatcttttgaatctttgggattaatgtacaacacagattttatataactctagaatatgtttttttaaaaaataggcagaggtgtatcacactgaaagtgtttaaaatgttttgcagatttgtgaagctgggaatcatttcatcaatgtaatgttgtctcatcccaatcacacaggttagttcttttttctttttcttttctttagagtgaattatgttaacaattatttttataatcttacttcaaaaaatctttaaaaatcaaaatatcaatagttggaaatacatgtgccacattttttcccttttatgtctagtttttccaaatatttgaaccaagtcttattctctagtaatgatttctctaaaatgaagtgtgcatgcacgctatcaccctccccacacacactaaacaacaatatcacttaaatatgtaaataaatgaactaatgaataagaacaaaagcagtacaaaatcacttgatgaatatccaaattactaaactctcaatattgatcccacttgtacaatatttgataaagtcctactatttcaaattacctttagtttttctttttgtaatgatggtaatctttcattgaaaaatacaatggcactgaaatatcaatgcctgggagaacatttcaaagttagtagtatatttaggttggtgcaaaagtaactgtggttttgaactatgaattttaaatcattatagctagtctcatacacatctttattaatcaaaataggaaccattataatcaacacatttttgccaatgaaaagtagtttattcttgtagtataaaaatccatgcttcagaattcaacaaactcttgaaaagcattttctaccccctgctgatcgtggaagcatcttccctgcaaaacgttgtccagatgcttgaagaagtggtagtcagttagtgagaggtcaggcgaatatggtggatgaggcaaaactttgtaatccaattcattcaacttttaaagaattggttgtgtgatgggcagtcagacactgtcatggagaagaattgggtcctttctgttgaccaatgttggctgcagacattgcagttttcaatgcatctcattggtttgctgaacatatttctcaaatatactggttttgctaggattcagaaagctgtggtggatcagactggcagcagaccaccaaacagtgaccatgacctttttttgggagggcaagtttggctttgggaagtgctttggagcttcttctcagtccaaccactgagctggtcatcaccagttatataaaatccactttttgttgcacgttaaattccgagcaagaaatggttcattgttcttacatagaataagaaaagacaacacttcaaaatgacttttatatatatatattttcgatcagcttatgaggaactgacttatcgagctttttcacctctccaatttgcttcaaatgcctgaggactgtagaatggtcgatgttgagttcttcagcaacttctcctgtagttgttaagaggatcagctttgatgattcatctcaatttgtcaatgtcaacttctgatagccggtcactatgctcctcatcttcaaggctctcacaaaacttcttaaaccaccactgcattgtgtgttcattagcrgttcttgggccaaatgtcttgttgatgttgtgagttgtctccactgcttcatgacccattttgtatttcttttcttttttttttttttaagatggagtctcgctcttgtagcccaggctggagtgcagtggtgtgatcttggctcactgcaacttctgcctttaagcggtttcaagcgattctcctgcctcagcctcctgagtagctgggattacaggtgcacaccaccatgcccagctaattttgtatttttagtagagacagggtttcgccatgttggccaggctggtctcaaactcctgacctcaggtgatctgcctgcctcggcctcccaaagtgctgggattacagacatgagccaccgtgcctggcccatggcccattttgaactcaattaagaaaattgctccaatttgctttttgtctaacatcatttccatagactaaaataaacataaaataccagcaagtaataagtcattagcaaaaaacataaagtgagaaatgcccattaaaatgttgtataacataaccacatttatttaataatgtattccattataaaacagcaaatttcaacaatgcaaaaactcagttacttctatactcacctgtatatttgaaaaagtttacagagtctccattatttaaagatatttttggtaaatcagtcatctcatttaggctcaattacatgtagggattcccaactgctaaccctatataatatataattttattgtaaattcaaatagaaatgataaacattcaacatcaacttgaatttcttaacatttccttgccttccacgcttctggcaggctagtgaaacatataaaacattttccagaatagttgttctgtaaaataaaatacatataattacaagggaaaattattttattagaacaatggtgaatatatgaaaaagctataatataagcatatgtttgttattacacattacataatattgtgatgagtactcaactttttgagtattggtgataaattatgtatatgcagatttaaaaagaagtgtactgtgagttaaaaatatctgtgctttatcttggtgaaaaaaaattacatgtaaggccaatgctgttgtagtttgtggtcctcatttgcagtggagtgaagcctatatttcattaagagattgaatgccatttttatctgatccaaattcacagatacattgaattttctttggatgcatgtgaatcacaagtgaaaaatatctgagggtctaaatttttttagtagagaagcgaaacacaatataatctaataaaatgctagcattgccaaagttagaaatatcacaaattttagtcttatctaggtgactagcaatgtaatcaactcaagcttcttcatttattcgaaatatagtgtcatcatttgaaaatgaaaattttaagtcatccagtaattttgaaattgttcatgtaagaaggcccccctcttttaatgttcactctttatcttgctttgtatattgctcttgaggaatcagatgccaacctaattctctctcctttgtcaaatgatggtttttttgcttcgatgtgcaggtgacttttttattataaaagtctatgaattttgagggagtgtctaagggttgatgattcccaaccaatttccccagatcactaggtactcttctagtaggttaatccatgttttttttttttacgttctaaaaaatttcctcaaattacaattttaaaattagttttattacattgtggagtataggggggttacactgtacctatgttccttcttctgtctctagcttctctatcactttctctttgactatctttgtcccttttttggctattctttttatctgcttaatatcctctgttctgttgaatattacattcttaagcaaatgaaaatatatttcatattactgggaaagtttcttccttgtccacaatttcttgagtacaatcaactcttattttgtattatatcttcttgttttttttccatatctattttcagttttgggatttcttaaggatacattctttggtaattgtgtgtgtgtgtgttctgtaaattttgttttgttttccttgtggggggttagtttttgtctgcaaatgaaaacactttctagtttattcacacagaagcatcatgtaaatgctgattgatttacatttattattaaatgtgtgaattgactttgaagaaaaataacatagttttttacagatgaggttactgaaatctctaaaaaacaaagtgtgttctggaaacagaggaggtttttcatcgtgtcttctcatcctctaacatccttgttttccaaattccttgaatcccagaacatgcttccttctttcccttcccttttaagcttccacatgatgccttccctctctgagcaaacttctctgggcatcattttctttcttggaaacaatgtcttccaagatgacaacctctggcctcaactaatttcagataattgtattcaatttctccctattcagggttctgatctataaagtcccagatcttttctcaaagtgaactctcatcttttgattatgaatttttaatagctacatactcaatgcattatttttctttacataaaatctttatcagttcctgtgtcagctctaaactggtgtctcctagtcttgaatttttattccctcactaacatattaattggagtttgttgtaatatctattagatgtgctttaggcatggttatgtctagaagggaaccatttaatattgattgtacaaaatgtcatgagtcatgttctcaggtggcagaaatttgtataaaagaagtttgttaggaattatggaaaagaggcaaggaatgagaaccatgccaaaggggaagttgagctgtgatgtagtcacaagaatggactcagtcaactctattgggtatctgaagctaggataaccctgtagaggtgtcaagagttggaatgactggagacagataagttggatatgagtctacctggggaagaaaaagaccttgtaaggcagttccctttagtgaagaccattttctcagagggtatgacagttgaaagaaagcttcaaatgtacatattgtgcaaactacaaagtatatatattccaattattatttatttatgatctggataaattacctttgtgaacccactttgtctaacagtccttaaaatgtgaaaatgccactttttctagtatatggttccctgaatcaatgaagtccttttagtaaagatcactgaaatcattatcatgtgcatttgttttggtgttacaatatctttcctcccagactattcttccctcagtgagtttagagtcttagaactgattcacgttccaatactgggaaaggaatagtagatctgacattgcaccagctgtctcaagtctcttaactattcatctataatttattttgtttgtctaaatttagcaatagcattgttgggtatccaactatctagcttctagagacattgtgttctactagccaaacataactttctgtgggtcaagcctcctatgaacaggccattcattttggctcatgaacaattaagtactgtaattggaactgccttgattttctagggagtggtgtgaggaagggtcctttaatcccgttcactactagtcatctcagttctaagatgatttcacttacagtaagcctgatacagcaaagagccaatgcgaatcttagtgatgatggtgttcctttcactaccatattccctgtatttttgaaaagtggtgcatcctattggttctcccatggaacatgagaagaaacctgagaacacgaaacgagggtaaaaattccttgcatagaaagaagcactctcttttcaaccttgcgtagactatctgctctaggattcctatttctctaaggcacttagcaccttctttcccagcctgccatggaaattctaacatttcttctttgcttattgtgggccattgctttgttcatgcttccaggtgcatatcattagtgtgtttgtacaatcttagagggatatttactcctatattccaggacagtgctccgaaaacataaacaaatctttattcaattttatactttacccctcttttcaaacaccctcagattccaaccccatgtgtattctcctataatttgttggttcatgctgggtaggttctgcagctcctttggggcattatcttttttgttctctgtcagccccagaacagcctcaggtagtttatattgtgatataaccctagttgtagtggctagaagaaaagttaggggagatcttcaaggggggtattcttgcagtgtagtgccttctgtgttgcttttaaggaaggatgtgctcaactttcatagggaagagtgggccacctctgcaggctcaaggaatttatgaaaacctagatattccaagattttgtggtaaacaaacttgacttaacagatctgcattggattggagttgtacattctttagagtttgactacttttgcagttaagacctggacctgttccttagctttttctgccctcttcgagcctctttgcatactatctaggtggacctctaactttcacaactggcttttaattgccaattagcagtttgttttagatgtgtttgttgagccattcagtcccacttgtaatattagaccayatagaatattgttttcaaccactataacataacaatataccagtagtaaaagatttttacacttggattgctaccctgtaccattagctgtctgtctgaacctaccatcagctatggagtactcattgcaggccttttggtaagtcattcaactctaaaatgccattccaacatctgctttttgngccattcctggtgccaactatgtaagctgggttttctggawtgcaaatgccaggatggagattaatactcaggaggattgttaaggagtagttttctggatagaagaaataaatcatatttaggtaggaaattgagagcgatatagtctcaacaagtctccaatgattgcatgggacattctaaaactgggatgaacaatccatgttcttctgaattgagttaatcaattttcaatattgatcaaataccatagtaaagctaaatcagtgagtgtgaccttgggtgaggttncttccaactatagggagtactgaaagttgaagtttctctgccagtagcactccctgaagaaatggaataaaccttatatgcctaaagaagaatctggtggggcagcattttaatgtaaaaaacctcctgactttaatttaatagaagctctattataataactataggttgagagaacatttatgaagaatgtaagtattaaattagtaactcctaaacttatttaatattacagttaacagcaactgtgtatacttgaaacaatattatctatatacatatatttttctgtgtcataaggcatatccattatttaatctacaaactaggtctggaaaaaatgtagatttgtagacccttgatcattccacacctctaggggctgaacactcataaactacaggctctaaaacagactatttcctgaaacttctgcctctgaaattcagtaactataacttgggtggattcctcaattatcttttttttattaatataggacattacacaaaggtgtctacaaaaattctgtaaaaaatcagtaataacaaaaggcctacatatttatttttatgaacagttgtaaaatctgcacaatacttagcataatttttaactttgatatttcagcaattgttacaattttgaaaacaacacactgacattttattatgacttcagagttataagtaaaagagtttagctgatttgttatctgattaaatcttggtatggagaataaaacagtaattttataattcatatttacttttacaaatgtcacagctccaagttcaacctgaaatcattaaaaatttgttatctaaaatgtttcttaaaaacaaktgaaaggggaaaataattaacaaaaataaagtgacaatatgtgaagtataatgagagatgtaactatcaatcctgactgctgaacagaaacgtggtatctcagaatattaactatactgatattcagtgtaatccttttattagaggtgtgcatacttttctggtataaatgacatctttataaaattccttatgactttcaccaatttaatacagggaattttgaggtatttaataatctcaaacaaatgtatcttctttgatagtaaaggggaatgtgaagaggtgggcaaatgttaaaacacactttataatttcagcatgtagtactatttcaatcattataatgtaaaaataatttatatatatttaagatcttaaagaattgattatccttatgtactctgcagtgttacagcaacatagctgtagacatggtatgaaaatgacagctattttatttgagtcaaaaggttataacatttaaakctgggtctcttctgagtaatttgcaaaataggttrctataaatacgtgatgacatttcatgtggtacacagttattttggggaacttagtattatataataagcatatgatcagatttgcaatgtgtagcatcattgacrttttactttcctttgaaaaaggaaacaatgcctgtttcccaagtccaaattataaccccttcacatggatgtttttcctggtttcatgtcctaactacacctatgaggtatgttatttatgtatgtaaatgcttgaatcctattcatgatatactaaatgcatgtgcttatgtatttacatgtattataaattaatatatacaggaaaaatatagaggtcttatccacagatcatggtataacaaaatagaacatttcaatcacaattttttcaaatattaaacaatgtctttcattttcttataaatatgatcccatttwatgagattgcttatgactttatatgtaaaaattaaattattatttcttgaaaatgtattcctatctataagttttctaatattttaagccttaaaattrcctgttaaagccacaaatgaacaaattactagattccatttatgtatgtgctaatttaagttttaatataacagattggatcatggattagtttcacagtcatgacacaaacactgccaggtaagacctagatatactgataattaatcaaaataaatgcatctttargataaatggtytctgagaaaaagttattatagtactaaagtatagcatgattgtaaaaggatttcatagtttcatactgagtttgatttttagcagtattaaaatatattgaagtacttttgctctttgtctctgtataattgttgcttaatccaagccagggattgtaatccaaatgtatttattaagcaatgaagttttgtttagaagaagttttgataacaacgcatttcgcttgaaacttcttgtgcatgtgcacaggcatgtgtatgtgttttgtcttcaaaggaagagttgggktgtatgagagttcatcttgaatactgagcattttaacacacactaagaagttgaattgcatgatttccatatagtagaagggacatatgtaatgtccattttatccattttgttatattgtacaaaagttttgaatcacaattaatgtggtttattatattatgtgcatgtagaggaatattatatgcatacaggcaactattattgaaaatttttaagtacaaaaataaatccttatttgggaatattttgtggcagtggtatataaaatatgtagattcatttttaatttttaatgtattttctgtgtttactcattcatgcgatattgattggctattgcttgggaatgggtatgaataatgaaaattgataagaaattatgcaacatttgagaaacatcttaaaagctaaacatgctagggatccttttcctaatataacttatttcatagaamtaagaaagaaataataattatttcttttttcttctagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctagagagagccatgattaaaccaaggcactccagcctgggtgacagagtgagactgtctcaaaataaaataaaaataacatattggtgaagatgcggggaaaaaaaaagaactcttagacactgctggtgggaatgtaaactagagcagccatgtggagaacaacatggagtttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaaccgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgyggaaattatagctacattaaaagtgtaacatttttatttagttgtgtacttatttgttaataatacagacattgtatgttatcatactgcaatttacaattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgtatgcacttgcaaagcaaaagtacattggtaatttgggcacattcagagtggaaaaaatttgttctatttttacatctttaaatacctatcttctatgaaagcctatgtgcatgtgtgtgtgtgtatgagtttctatgtgagcatgcatatatacttcacaaagagatgacctatataaatcaaagtacacattatttaaaatatttaaaagaaattttcagtttcttcatttttaaattgtgatttttagatttgttagtctatggagcattttcaattctcagattatacatatgtaataaaatatgttcattaaagctcttagattatatgcatatatgacaatatatacatatacgactatatacacatatacaactatatatatgtgacaatatattgtaaagcaggtctatatacactgggtaggggctgtttattactaacatatgtggccactaaagaaataacaaaaagcccttttaaaagccttataattcccaaagcatactattaaaatttctaaggagaaaacaataacaacaataaaattctcactccctaatatctattcagctaaattgtatgatatcatttaatgatcttaaaaagaaatgtcaatgcagtaaatcatatatacctaatgcagctatatgatcaactacttgtgataaatgtcccttttttgaaagactaagaatagtttctgtttttgtaactcgatcctgacaaatagtaacctaggaagtttgcacattcttgtaggactagaagaaggactttaagtatggggtacctatatgacagacattttttttcccattatactacactcccttatgccagttgctccatcatactttttttgtatcagttattcccttactgttggcagacatacattagttaaaggatatcttaattatgaaatgtgttttttaaatttatttctcatttttatttccaggtggtctcactgcctaagacatcaaaagaaaaagcctgacaaatttacaccatcttgttatcaatattaatgctacaggtataatcctgtagcagccatgtacacatttttagcctttaaaacctaaccttcatttacaggttttaggagttactatacataagtatgtacacatatgcatatgtatatgggtatgtgtgtaaatgtgcacacttacaaactttaatgatactctaaattaatatataagatttatgtaaataataagtttgcattgctggctaaaatattgtgcatttattttaatataaaacaaatctatataatctcacatattcatggttttttgccacatatctaagtaacttaattttagcttatggagtattttgcaggagcagcattcaacactgcatagattagttgtaagtgtctcaattacatttacatatcagtgtgtttggtggggaaagaagatgaaaaataaaacatttgaatataaaattaaaataaataaaatatgacatttatttatgatagatgtcataatttgatcatattcataggaaaaacattaatgaaaaatttaaatgcagaaaaatatatacacacattatacaaattaacaataacattactaccacagttacttattgaagtaatatgctgtcttaaatatgtttcattataccatgttctctcagagttaacactctcatcctataaataaaagatatattctcaaattctaaaattcttgtgtgtgtattttcaacagttgttatttttacgtcaagaaaaatattatgataatattagcaactgttaaattctatgctttgagatgtataggcctcatttctaatttaataaggtatgtatatatttgatattttcataaaagcaatacagggtttggccaagaagttttgccgtctgtgaaaggcatgcatttgatgctattataagccatattaactggagaacatttctaaaatacctccatttcacatgcaaattttatactctatatattgatggatttgtttatgagattgagattcagatgtagcaattggtgagagaggaaacagttacaaggcagcctctactttttagatagttcgcttgtttaagagacaaaacaagttcaactttaattgaaatattgcatatttgcttgcttaattactgttaaaccttaaattaaatattctttataataagcatgtcttcgaacatgaaataaaattaacaagtctgagagtgaaacttttcccattatgagagacattttagtcagcctcatcacaagaagacttttgctttcctcaaaccatcccatatttctttttgacacttgaaagtatgcctctgcttcctgtatttcttttaaacattctggagcttttgttgttttgttgtaactgttgccaaatttataattgttagatgacaaatgtccttaacaagtgtttttcagtaattgtgcctaaagaaatacaattataattgtcatcaaactaatttggtatgcatgcttttacctcccaaaccataaattgtcctcttccttcaggacactgtaaaccttgaattagaatcaaatcaacaatttccattattgtaatgtagaaatcagttcattttttaaacacaggaatcaaagactgcctggcttacatatcctaaacagttttaatatgaaaaaaagatatataaatgtttagaaaaaaaattagtagaattaattaaaatcaattagaatatgtgtattaaaagcaatattaagttgtatccatatgttgttcttttattctttgggttacatgggatataaagggattgacaacctcaacctgtaaatgcttctttaaaaatcatggaattatgaatctgattcccattttcagtcttccctaaggccctttctctattataatttcttagaatgtatttgctcttcttttctataacttttgccgaatatgtcatttattaaaacaaaacaaagcaaacaaaactctaaaaactaaaaatacaccattactggttataagtctttcttcagataaatgcatagttctgtaaattcatgccccatgatatcttcacagattatccattggttttcttggtgtttagtaattcttgtacatatccaaagataggtcagttcagagggtcttaaggaagatgaaactgctgaaataaagactggacccggttgggaaatgaatctcacttaaagcaaagattgataataatctcaagcaaaagtgggaaaatatcataacaggaggtctcttgccaaactatagctttgcacatcccatttggagtttaagactagtacccagtaatttaaatatttaaatttatgagcatagtaagaaatatgagatttgataacctcagagttttctaatactagattttgataacaatatttaaaaaatcaacagttcctttaatttaattattattctagtagttacttttggaaaaattgtttaattctctatcccaaaacaatttgtcaaaaaaaacccagtgtttttaaaatgccacatctttgtctttcccagtattttcataaaaaatagctggagagagaaaaacaaaacaaaacaaagagatgcatcagctgcagctacacatcaattaccgcataactgcttccagtgcctaacccttctacctccagtttctactttttctacctctagttgttacttttaaaatgcattctgggctgggcatggtggctcacccctgtaatcccagcattttgggaggctgaggagggtggatcacctgaggtcaggagttcgagaccagcctgacaaacatggagaaatgccgtctctactaaaaatacaaaattagccaggcatggtggcgcatgcctgtaatcccagctactcaggaggctgaggcgggtggatcacctgaggtcaggagttcgagaccagcctgacaaacatggagaaacgccgtctctactaaaaatacaaaattagccaggcatggtggcacatgcctgtaatcccagctactcaggaggctgaggcaggagaatcatttgaatccgggaggcggaggttgcagtgagccgagatcgtgccattgtactccagcctgggcaacaagagggaaacttggtcttgaaaaaaaaaaaaaaaaaaagaattctgtttgactatatatgtgcatttttagtttttggctaactgtggctcaaaatagactgcagtgcattttgtttgttagcaacactggtggaaaaaaatgttactctctgactcagacacacacacagatcaattttaagcaacattactccttaaatgaagcatacaaaatgaaaatagtctcatttttaaaatgtgtatgttcaattttatttctctcttaaaatactatttccaaaatctaaccctaagaaaatagtaaaattcataataatatttaaatattttatatatgacctttacctttattccagtaattaaacatatttccaagatatttaagttcaattttaaggaactagcattcagtacatgttaaattttagcagttgacaaatgtcaatgataacatttgtgctcataaaaaaaggttcatgaatcaataatgagggtttctattttaatttttattaaaaaatttaaaatcctgaggttgctcctgaatgttagaggtgattataacaattttgctttgtaaatacaattacaggtatttttgcagtttttgcataatgataatttaaaaacttattttaaaggctgcttaaaagttaattttcaccaggtgcataatgaagcctctaattaggcctccttcagaggaggtttgattgtgaaaatacacagcagcatttcctgagataaaagttcctgctaaaatgggatttgggtttttaactttagtttgctaatggttcttgaaatgtgagaaaaaaagtcgttcagaaatatttacaaaacaaatgcataattattgattttattgagaatatagaagacattttcataccatgtgtttgggaaatgaaatcccgtagtctgttgccagaaataaaactattaaaaatataagaaatactctcaataatcccagtacataatttctggtttatcccattgttctgtcagcttgtaaacgagagtcgtttctgtcacaggatactttgggtgtcacttcttgccagccagaaacctgtgtggctggtggtgcctctgcttgagttttgttcgcacctgcagagcttgttgccccaagtcggaccagtagcttgcatttggctcccgctaacagcccggaacccaggcctggtgagagtgagccaagtgtggggctacgaggggtgttaagcgagcaagtgtaggatccagccactgcgcacaacaaggcgctctggctgttgtggtgcagcaggcagctccaggtgcctacacaggtgccagttttgtataaggctgcggctggaccaggcgtacagcaagcagtttctgctgcaggcgctggggtctggatgaggggaatgtggggaacgtggtggcacacaaaaaagttggagacgccagcaactgcagaaccccaaggggggcggggtgctacagctctctcatttccacagccggcatctgaggaatttatcattttaaaattacatttatttatttatttatttatgttagttagttggttaattattatgctgatcatgtctcgtgtttttaaaatgctaactcattgaaatcgtattgttgttcattcttttcattcatatttcccaggaacatagaccaaggcttaggatataaaaggtgccaataaatatttctcaaatgactaagattataatggcttttttagtcctgccaccttgctcccacctagaactccctggttatctcacccctgccatcacttcccatcacatggtgtggccacaagctccggcttggggaatcctgatgaagttgggcccccagaagtgttggcgctcttcactttcactttcacagtccgatgatcgggatggtgtcaccacccacagcttggcaagctggccaggaatgtgttacagccctttgcaggcctgcccacagttcagcaagaaggccaggagagtgttacagctttttcagcctctgccattcggtggggcccaagctcttgtccacatccagaaagaatgaggttacaccaacaactggagggtgagcgtggcagaagacttttacccagtgacagaacagctcttagcagagaagagacccaaagtgggtagctcctacccgctggggggcgctcctgatgtctgtcccagt

SEQ ID NO: 10669 - DNA, 158027 bp, Homo sapiens
  misc_feature (1)...(158027): n = A,T,C or G, or insertion/deletion polymorphism (see Tables 1-2)
gcagaacttgcaggtttgttacataggtatacatgtgccatggtggtttgctgcacccatcaacccatcatctacattgggtatttatcctaatgctatccctgccctagcttaccttcccaccccctgacagttctcggtgtgtgatgttcccctccctgtgtccatgtgttctcattgttcaactcccacttatgagtgagaacatgtggtgtttggttttctgttcctgtgttaattcgctgagaatgatggtttccagcttcatccctgtccctgcaaaggacatgaactcatccttctttatggctgcatagtattccatggtgtatacgtgccacattttctttatccagtctatcattgatgggcatttaggttggttccaagcctttgcaattgtgatattgtgaatagtgctgtaataaacatatgtatgcctgtgtctttagagtagaatgatttataatcctttgcgtatatacccagtaatgggattgctgggtgaaattgtatttccttgaggaattgccacactgtcttccacaatggttgaactaatttacactcctatttctccacatcttctcctgcatttgttgtttcctggctttttaatgatcaccattctaactggcaggagatggtatctcattgtggttttgatttgcatttctctaatgaccagtgatgatgagcattttttcatatgacttttggccacataaatgtcttcttttgagaaggatctgttcatatccttcacccactttttgatgggattgtttgtttttttttttcttgtaaatttgtttaagttccttgtagattctggatattagccctttgtcagatggatagattgcaaaagttttctcccattctgtaggctgcctgttcactctgatgatagtttcttttgctgtggagaagctctttagtttaattagatcccacttgtcaattttggtttttgttgccattgcttttggtgttttagtcatgaagtctttgtccatgcctatgtcctgaatggtgttgcctagattttcttctagggtgtttatggttttaggtcttacatttaattatttaatccatctttagttaatttttgtataaggtgtaaggaagggttccggtttcagttttctgcatatggatagccagttttccgcatatggatagccagttttcccaacaccatttattaaacagggaatcctttccccatttcttgtttttgtcaggtttgtcaaagatcagatggttgtagatgtgtggtgttatttctgaggcctctgttctgttccattcgtctgtatatctgttttggtaccagtaccacaatattttggttactgtagccttgtagtatagtttgaaatcaggtagcgtgatgcctccagctttgttctttttgtttaggattgtcttggcagtacgggctcttttttggttccatataaaatttaaagtagctttttctaattctgtgaagaaagtcagtggtagcttgatggggatagcattgaatctataaattactttgtggagtatggccattttcacgatattgcttcttcctatccatgagcatggaatgttcttccatttgtttgtgtcctctgttatttccctgagcagtggtttgtagttctccttgaagaggtccttcacatcccttgtaagttggattcctgggtattttattctctttgtagcaattgtgaatgggagttcactcatgatttggctctttgtttgtctgttattggtgtacaggaaagcttgttattttttgcacattgattttgtatcctgagactttgctgaagttgcttatcagcttaaggagattttaggctgagatgatggggttttctaaatatacgatcatgtcatctgcaaacagggacaatttgacttcctctcttcctatctgagtaccctttattgctttctctttcctgattgccctggccagaacttcctatactatgttgaatgggagtggtgagagagggcatccttgtcttctgctggttttcaaaggcaatgcttccagcttttgcccattcagtatgatattggctgtgggtttgtcatcaatagatcttattattttgagatacatttcatcagtgcctagtttattgagagtttttagcatgaaggggtgttgaattttatcaaaggtcttttctgcatctattgagatgattactttttttttttttttttttgacaaagtcttgctctctctcacccaggctggagtgcaatggcacaatctcagctcactgcaacctctgcctcccaggttcaagtgatttttccacctcagcctcctgagcagctgggattacaggcacatgctatcatgctcggctaatttttgtacttttgtagagagggggtttcaccatgttggccaggctggtctcaaacccctgacctcaggtgatccacccaccttggcctcccaaagtgctgggattacaggtgtaagccaccacacctggccaattacttttatatattaagctaaatatacattaaagcttttatagtaatcactaaacaatgcaaataaagtgtaatttccaatttaatgcagcagaaaaattgaaatgtgaaaaaaggtgtcaatttaaaacaactcaagaaaggagaaaaactatatgtatacttattgagggatctggccagcagcccgcaatgcaacagggctctctctttgttcccaggcagatcggcaggttgagaaataatagacacacacaagatagtgaaagctggatccaggggggtcactgccttctggtcccatgatgccaacaatgcactggatataccagcatttattattaagtttagtgagggcgggggtaggttagtgagggatttagggtcatttgattatgaggtgagatggtcacatggggatgaagtaattctttaacataacatttgtatgtagaagtacagtacatttgtatgtagaagtacagtatacagagataagaatttacaatatagtgtgtgagtcagtaacttctaacagagccttagaacagaaacacggtatttccataacctatgattagcaagatattaatcagcagtaacaattgcaacaaaagctggttacaaacaatccgtggaaacaggacgtgaagctagacaactggttagaccagaaattctcagaagggagtatgctttaaccctaaagaggcctagaagagctgtggcaagatgagggcgtttatagccctatcttatccatatggacaggcgccccccatgagtccgtttataggctccccacaagggtcgcattccattcccagagctatgaacatctgcttttctgggataggaatcttggtgatgtgaaacctccctgactgcacgtccattcataggctctctgcagggggaagcacatcacgcgctgttggctcgttctggcagtccgacctggcattgtctttacacaatcctgcatgcaattttgtatttacaataatcaggagcatttcatcttttattccatagcaatagtttcagggggtctccctacatataatcaagaaaaaaactggacaaactaagtacaaaatagatgttagaatgagtcctaactttaagaataaatataacaaaaaagtaactatttttagagattaaagaatgtcactaaaagcattaaagatgggttaaataaatgaagagatataacgacgttcatgaacaggaagacttgattttataaagctatccattttcctcaaactgaataaatagctgcaaaacaattccagcaaacctcccaatctatatgtatgtgtatgtgtctaatttgataaactgattctaaaacatataagggctgggcacagtggctcatgcctgtaatcctagcactttgggaggcctaggcaggtggatcacctgaggtcaggagtttgagaccagcctggtcaacatggtgaaaccctgtctctactaaaatacaaaaattagcagggtgtggtggtgggcgcctatagtcctagctactccggaggctgaggcacaagaatcacttgaacctgggaggcggaggttgcagtcagctgagatcgcgccattgcactccagcctgggcaacagaatgagactttgtcttgaaataaataaaataaaataaaataaattatataagaaatagccaagagctaaaaaaaaaaaaaatccgaacattcttgaaaaagaagagcaagataagcaaggtaaaacactcaccaataagatttgagatatatttataaaattaaaggagttaagaaagtattgtactggcccaggaacagtcaagcagataaatggagcagagtaaagaatccaaaaacagatcatgtgaatattgatgcccaacatgtatgacagaggtaacattgcagatcaatagagaaacaagggactactcaataaaactggaaaagtgggtttccacattgcaaaataacataggtcccaaatcacaagacacagaaaaatcaatctggatgatttaaaaacttaaatacgtaagttaaaattttgaagttttttgaagtaaaggggaaatatttattttttttaggtagagatttctttttcttttctgtttttttttttttttttttcgagacaagatctcagctctgtcacctgggttggagtgtgtggcgcaatcatggctcactgaagccttgacctcacaggctcaaggcatcctcctcccacctcagcctcccaactggctgggactacaggcctgcaccacaacacccagctaatttttgtattttttatagagccagtgtctcaatatgttgcccagtctagtctcaaacccctggcctcaagtgatcctcccacctcggcctcccaaagtgctgggattacagctgggagccatcatgccaggcccaagatagggatttcttaatcaagatctcaaaccacaaatcgcttggtgaaacttgataaatttagctatcttaaaaccaagactctttctcaaatggccacataaagacaaaccacaaactgggggaagatacctgcaacataaataatccacaaaagattactatcttgagtatatagataactaaaaataaattataaaaaatcaaacaactcaatagataagtgagcaaaagttgcatatttcactgtagacaaaaacataaccaataaacacaaaaaaagatgctcaacctccttagtaatcagaaaatataaattagtaatcataatgtgacacctttatacccatcaggctggccaaaagaaaaaataataatcttgacaaccccacaataccaagtgttatgaagtggaacacgtaggacttacccactgccagtggaactctaaattgctataactacttagtcaaacaatttagcattatctataaagttaaagatgactgtttcctacaccctagcaaaattctgattgtaggatacgccctagagaaactctcactcacgtgcacaagaagaaatgcacaagaatgtttatagctacgccaatggttattacggagaaaacggaacagcacgaatgttcagtcagctccaggaacatgaataaatcatgttcgttaaattgcatttaatgaaatactatattcagctgtaatatttaatgaatgacagctacattcctgagcatggataaatccctcaaatacagtgttacatgaaaaaaataggttatgggagaatttctacaatatgattcaattatgtaaagattcaaaagcaagcgagactaaagcaactggtcaaataagctttaactgttactgtataatttgtactttgtaatatctggtagtcgcatggttcgttaagcttcaggctaacagaaaattaagcattaactatggtgccaagttaaaaaaaagtctgcgaaatcaaaacccttaaaattcgtctacgaaattttaataaatatccgtgtagaaaatcagaacgactctttcaggccatctttaaaatgtcattggtaaaccatacttgatcctaaattcctgtacttcctcaggccatccgagcatgaaacgctgtcacctacccacatccgctggctgtgacgcttgtcaragtgttctctatyggctgcatgcctagaccaccaaagcgttctgaccggacagtgtcactggagaaggcggcgcgacatgtccagggcgcagatctgggctctggtgtctggtgtcggagggtttggagctctcgttgctgctaccacgtccaatgagtggaaagtgaccacgcgagcctcctcggtgataacagccacttgggtttaccagggtctgtggatgaactgcgcaggtaacgcgttgggttctttccattgccgaccgcattttactatcttcaaagtagcaggtaaatataatggctttgtttggggtggaggtaaaatgtacttttccccccgactgtgctgaagtagctgtctatggctggctgttaactctctgaagactgagtgcttaatcaaagtgccaagatttgcctaggaaggatggggtgtatgagtattggctgaaagaatgacatttatyttatttgacaaaggagatgtaagaataaccttacagggcttttggaatacccagtgtgactccaaagggaagagtggaagtgactggattgttttaaaagtcagtttcaatttgccttgagtcatggaggaatcttgatgggtcagcacccctatgtaggaaatgctctcattgatttaaacttgtctctccctctcttcctctctctctctctctctgtctctctctctctatatatatatacacccacaaacacacacacacacacacacagaggtatctatatgtgtgtgtgtatatatatatgcacacgtgtgtatatatatatgcacacatgtgtgtatatatacattcacatatataacccacacaggtatctatatgaatatatatacatatattcatgcacacacatatgtaacacacatatatatgtaatatgccattgctagattggaactggcaaacgatggcaaattcaaactggcttttaaaacaatccaaccacttccactctttcctttggagtcacactgagcattccaaaaggcctgtaaggtaatccgtatgtctccttacatctactttatcctagattcctgataacraaggaaggaattctattttcagaagggtttccacgttttttttaatgtttgtcacagcctagatataaaacaaaaygaaacaaaaaaccatattgaatgataaaataacagcaagaaaaatttgaaagcggttaagtgaaagaaaatgctgtttactttcccctttggttacctgattttatttatctaagaatacatggggcaagcyttcatcgttgtgcatattagaaactctattacaagtgtacgtatctcaaagagggaacatatattttttaaggacattttcatactccagaatgccttcagggaaacaattgtcatttgctttcctgtcattatgagaattactatctgcctctgctttctgcaaatttgatacatttacaaatctgccacaaattgtgggtttattactttaaaaattgctctttgtttcttggtaaaatatagacttttcacagtcaaatagtaaaactgtaccttggccccagtaaagaaaatgaaataaaattttaactaggaagttactaaagcataatgtgttaggagattttgtgtcaagtatgcacatcattagtctacaatgagtgccaggggataaagagagaatacttaactaaatccaggagatttctaatgacaatcaaaagaaatattcaagcgtggatgcctcacttagtccctgaaataacatggactttcctaagtacccatttgaggactccatgctatgtctctcttcagggtcaatttctaaacttattttgggtatttcaacactgatccttctaatatagaacactgccctagaaacagaggaaaagaagagtgtgtgtggagaccctcttgtcactctgcacctcttacaatcgttctttctccaggggcccctcttggccctttttcaccttaggaatcaggtagaagagatggcatatggtaagtctgtttgtttttaattgggttcattttttatttgttcaattattatatatattttttgagatggggtttctctatgttgccaaggctggtctcgatctcctgagctcaagagagtcacctgtctctgactctcaaaatrctgagattataggcctgagccaccttgcccggcctcatcttaaaaaaaaaaaaaagaaaattgtcttaatatgtttcattctgtatttcttaatgaaacccagttattggggaaaacatgtgttcaactttagcttcaaagtgggttaaagaaccatggtaccttttacatgacttcaacttgctgcttccccaaacacatcatcacagagttaggcattttattatggtccagatatctctcacccttaacactttcttattttttatttattgtttttgagacagaaccttgctttgttgccaaggttggagtgcagtggtacaatctcagttcactgcaacctccacctcccgggttcaagtgatcctcccacctcagcctcccaagtagctgggagtacaagtgcatgccacaacacttggctaatttttaaaggtttctgtagagatcagatctcactatgttacctaggctagtgttgaactcctgggctcaagcaatcctactgccttggcctcttaacgtgctgggattataagcatgagccaccacgcctgccaaaactttatttttaaagttaactttgtttattgattgtaaaaataatttattctatctcctgtataccctgcacataggaggtaatttgaaaatctcacccactgacaatgcttccctaagaacaagtacaattaaattaatataatctctctaccttcttcatcctgagtcaaaatctttataaatgatacactttgctgcagaaatctgttttcaatgtcagaaacactgattcatatttccaaagaaaacggggattcacacatttggatttcctttcccatggagtcattgctggttgcttttcttttattcctatttgaaaacataacaatgagggaatcaggaaagctatctatgccaataatctctccaacatcacaataattataaattgagaaaagaactcagaagtcaatgaagaatgaaaatggttatatcaccttttaaaataataaactatttaagcctatattgtcaatttgagacaaatcttcttagacttaggccagattaaacctcctctaagaaagaaaagcagaaaatctgtctaagctgtctcggttgtattttttttttcttgctgattatataacttcattgctggagtcataccttcccatagctaaccctcttgaatgctccagtgtagccacagctttttagggcttcatttggattaatagtgactacatcccttaaaaatttgatgtgagcaaacacctctttgggtgagcagcatttatagctatagtaaaaaatacagaggccaccttcaactgtcattctgtgaaataaaccgtaggaacacctgcaattcaattcttattggagcctgaaagcttgattaaaatccaaagccaattcactatctttagacactaagtctaccataagctaggtctcgttttgttgtgttttgtttttctgtcatatcwacgttaataggaatgctttcactatgaaagtaaagcatctctcatcgtagggagaaaagcagttctttctgagggggaagactgaatccaagaagcatggctgcagtgagggattgaaggaaatcctgatcaccttgggacaggggctggatctgtcatgttcctgtcgtgcccctggcacatgctgggttccggatatatagctgcaaaatgactgaattaaccaaataatgagtgagactacagatggttcgcgatgagggcaaaattgtattcctggaggaaggatggagtgtgctgaattgaggagcgagtgaggaaatgagcgcaggcaacccaaagggaggtcagtggattatgactcakcagactgagccttgcattctggctcctttatgacttgctgtgagaccttgacttcagcaatgacatcttctgtgcctcatccataaattaagagaacrgatctccaagagttccttcaggtatctttcaacctagagttcaattccagaacttcacaatgcttcgccacctggcagtagaagtttcccaaagaattatagccataaaagtatcctctattataattgttatagttgctcatgggattaaggtcttttcttctgtttttaatttttgttttttaagacagggtctcactctgtcacccaggctggagtgcagtggcacgatcatggctcacttcagccttgacttcctgggcccaagtgatcctcccatctcagcctcctgagtagctgggactataggcacgtgccaccatgcccagctacttttgcttataagtaattataattttgtttataattttatttataaacataattagctggacatggtaaagacagggtcttgtgatgttgcccagggtggtctcaaactcctgggctccagtgatcctccagcctaggcctcccagagtgctgggattacaggcatgggccatcgtgccctgccaaggcctttttttcccccttatctgttatcttgaccagcttcctgtgttcctgactgtttacagtcttctcagcatctgggttgagataggtttaaatgaccttaaatgaccacaagacccaagtcaaagtgccaggatttcagtggaatgaaaccaaacaggcatctggaagctgcagtcaaatgatgctggctgtctgcagcagtgtgagccttctctcctcactttccagatgcttcacctctctccccactcccttatttggccatgccataaaaatgggggtaaagaggccaggcacggtggctcacgcctgtaatcccagcactttgggaggccaaggcaggtggatcacctgaggtcaggagttcaagagcagcctgaccaacttggcgaaatcctgtctctactgaaaatacaaaaattagccaggcgtggtggcgggtccctgtagtccccgctctttgggaggctgaggaaggagaatcacttgaacccaggaagcagaggttgcagtgagccaagatcgagctgcactccagcctgggtgacagagcaagactccatcgcaaaaaaaaaaaaaaaaaaaaaaagcggagggtaaaggaatagcacttgctagagaaagagggttttctgtgggggtttattcacatctagggaacagctgggagccatctgatgtcatcaatttagacttcttgctagttggaatgtatgcctgtgttagtccactcaggctgcaataacaaaataccataaactgggtaattcaccaacatcagaaacttatttctcatagttctggaggctgtgaagtcctaaatcgagacactggcagattcagtgcgtggtgagggcccatagacggcaccttctcactgcatcctcacatggtggaaggggcaaggcagctctctgaggcctcttttttatgttattattwtttttttttttgagactgagtcttgttctattgcccaggttggagtgcagtagtgcaatctcaacctctgcctcccaggttaagcgattctcctgcttctgcctcccaagtagcggggactacaggcacccaccagcacacccagctaatttctgtatttttaatagagacagagttttgctgggttgtccaggttggtctcaaaatcctgtcctcaagtgatctgcctgcctcagcctcccaaaatgctgggattacacgcatgagccaccatgcccagcctctggggcctcttttataacagcactaatcctattcatgagggctctgccttcctgacctaatcacctcccaaagggctccacctactaataccattattttgggggttatgatttccacatataaatttaggggcacacaaagagtcacaacatagcagtgccttagtccgtgattaaataataatagtaaataaataccaaacaacaataatgaataaatgaaaacaaattaccatgtcaatgagggaaaattagtaagttagatgcctccaaaatattaacccttttttttttttgagacaaagtctcgctctgttgcccaggctggagtgcagtggcgtgatcccaactcaccacaacctccgcctcccaggttcaagcgattctcctgcctcagcctcccaagtagctgagactacaggctcgcgccaccatgcctggctaatttttgtatttttagtagaggtgcggtttcactatgttggccaggctggtctcaaactcctgacctcgtgatccacccacctcagcttcccaaagtgctgggattacaggcgtgagccaccatgcctggccaatattaatacttttaacagatagctgcacccttggataacacttacctttccattctctaagatcctgatgctgctttctgaaactaagtttcattaaataaacttaaggttaaatttaatttcagattagtttttatgctatgtcccaaatgcatataaaattatttaaaagtatacagagactgggagtagtggctcatgcttatagtcccagcacttggggaggctgaagcaggagggtcacttgagccaaggagttcaagaccagcctgggcaacacagggagaccttgtccctacaaaaaaatttaaaaatagccaagcatggcagcacatgcctgtagttccaactacttgggaggctgaggtgagaggattgcttcaactggggagattgagactgcagtgagctgatattgcacagctgcattccagcctgggtgaagtccaagaagcattcgacatgttcctgttccaacaaacagaggcataatattatatgtgtactgacacagtcataacccaaggtaggtgaattggactttcgcagtagaatctagacaggttgagccactgtataattgtctctgtatcaatatggttggaagaaggcacaatgctgaaaagtgccctagccttacagtggtgaagatggcgctggagcggtcagaatgacctcaattgccatagcagcggacgactggactggggatcctaaagcagtgtgctgcaggctgttctttcatggaagcatcagaaactttttaagacatcctgtcttcatccatagttcctcttttaggggccaggaccttatctcatttatcctggtctcccccgtacctactgctgtgtctggcttagaaggcactcaacgaagttgtgtggattgaataaacggaaggagaaattgttcattgagttaaattctgacatttgtattgcagagggaatctcttctcatgtcaccaagttctagaaaagggagaaagtcctagggaagtgtttagaacaagtaaaagagccatggatttgtttttgtggtcttttctttcctttttgagacagggtcttgctctgtctcccaggctggggtgcagtggcgtgatcacagcttgacctcctgggtttaagcaatcctcccatctcatcgtcctgagtagctgggactacaggtgcatgccaaccatccggctaattttcatctctttgtggagacgggaatctcactgtgttgcccaagtttatctcaaactcctggcttcaagcaatcctgtctcagcctcccaaagtgctgggattataagcatgagccaccacacctggcctgccatgaatattttttatgatggtatctaaaaagcacaaacatttagagtattgcttcttgaaatgtgatccaccagccagcagcatctatatctcctgggagcttgcttgaaatgcagaatctcaggccccactacagacctattgaatcagaatctgcaattttataagctctccaggtgtcttctatgcacattaaatgtttgagaaatctttgcctggagtttggccttaggaatgtgatggacccaacatttactaaagggtcttaatccctctgagcttcagtgttctttcctgttaaatggtgattaaagaagacacatatggccaggcatggtggctcatgcctgtaatcctagcactttgggagacaagccaggtggatcgcttgagcgcagaagtttgagaccagcctgggcaacatggtgaaaccccgtctctacaaaaagtacaaaaattaggtggccatgatggtgggcacctatagtcccagctactcaggaggctgaggtggaaggatcacctgagccagggaggtcaaggctgcagtgagctgtgattgagccatttcactccagcttgggtgacagagtgagaccctgtctcaaaaaagcaaaaaacaacaaataacacaggcaaagtgtcttatgtagtaccagacacaaggctctccataaagagtggcgattatgtccatgaatacctctttcagtgccttgaaaggtcacatctctgctgtaggaaggtggctattactctgctctacccatttgtttccaaccaggactgcagtagctgcctcttagaatgcaaagcctgatagaagcatgcctttgctcctttgctgcgtgtcttgtcatatttttcatgatgtaaaggatattgtgctcatgatgtgaaggatattggactatagtttgcacttaggatttgctattttgtataaggcaagaccaccttgcatttcgatgtcagttactcaytaaagatgtggatctattccttgagtcaatcacacgttctaatagcttggaatggggagaaaaggccccctttgggctccacaggggaaggcagggctcctacaagctcagggtgtgtttggtatgccgggcagccaaaaagagcaaatgtttacttgagtattcttagttctgagggcagggaaaaactttgggacagacagtttaatatatgggtttgaatcatagctccacatagagctaacgatgcaaactcgagcacattacttaacttctcatagactcaatcttctcatttgcaaatggaggtaataatacgaatcaactcatagggttgttgtcagggttaaatgaaatgataatgtaaaacgctttacatcatgagcagctgtcacaatcataagttagccgtcatgttattcattgatgactttaaycatgtagcataaggtcactggtttttaaatgaatgtatacagtgtgttttacgaagtgctttcacatacattgtcatagttctccagaagactgatactctaaagtctccattttatatataaagcagctgaggttcactggggaccatatttctaacttcctatgggcttctgcaaatctttttggggaaatggccagcatttggtrctagcycccaaatttgtgtttaagtcccagcttggccatgttttgtggaccttaggtgaatccctggcatttgcccttgtttccctttcttagctgtaggataacgatgataatgatgttgttgacaatgatgatgtctagttacatgcttcaaaagctggtggggaaggtcaaggaaaagaatcttattgtatgacgtagactaacctgtgtttaaaatgaactggggmtttgttttaatcgggtgtggtaagatgcacagacatggaaataactgtcaggaaagaagttttatactcgtcgatcccgagaagcgggagacatggcatggcacgcgagaccacgcagggaagaaccacggtcattcaggagctgggtgggaaaccatgttcctgagtccttgtgatttttgtgggaaggaataagccaggctgggaaaactaagcaggtttaggattggctcattttaatactttcagcaggctttggagtgtaggagccccaagttgtctggttgccaccctggggtgattagggcagggaaatatctgcttaatgkgtaaacacttgggaaaggaggtagttgggggtgtggtctttgggctggttggtttgcttatgaaagatgtgcttgtggggggtcatttgctatctgtaataactggctagccctcgggttggaggagcagtttcccccaagtcagcaaggccccaagtgccagagcatggagaatacagaaaacaagaaaacagagttaatacagcatagatgccagagcccttggtggtgtttggactgtgggacagcaaggcatggattttgctgtcccctactcctttaagacttcatacttatctgattttctcctggtgaacatgtagtgtagaaaaggttcaggtttatctctcacaaggttcatagctcctctccctgctcattgcccatctggctgtctccaccgcacagctttcctcgcgcctcacagactaaattgcatcctaaaggagatgtagtgaggaacatcttctgagcaaatggtgtgctgggcttagtcatttaaaaccttcctgcccttgtgcatgtttaggtaatgtacattatagaaagcgccactgctcctaaatgaacttgggataattggcttgaattgcagaaggcagcaggtctacaattaagcttttgccagatttttgtgtgcattgcagraaaaattgattaccaaaggttaataatttggcaaatcattcagcagattcctggtgcagaatataggctctgaggactcagggaggaacaggacaggggcagttcttcagatacatgctgttgggagtaaagcaaccatttggcaattagcccagaatgctaaatgttattggacggttaagttcagggggacactgacttctcaaagagctgaggcttgaactgtcttgaaagatgggcgaagtttcacaagaagtttgccaaggaaaggagggcattttaggctaagggactcatccaacccaaaaattattaactgcatgtttctgagaagaatgcctgacatttgagctccctcatctattttttgtttttgtttagttttgttttcattgttttttgtttgttttgttttgttgttggtggtggtgtttttacagagtctcactctgtcacacaggctggagtgcagtggtgctatctcggctcactaccacctgctcctccagggttcaagtgattctcgtgcctcagcacagatrtgcatcaccattcctggctaatttttgtatttttagtagagacagcgttttaccatgttggccaggctggtctcgaactcctgacctcaggtgatccacctgcctcrgcctcccaaagtgctgggattacaggcaggagccgccacgcctggcctgagcactcccatctgttaaatggaaatgttatctacttcagaggatgatggtgacgactgaatgcatgaatttgcatacagcatctagagcaatgcctgggacatacaagaaagacctaaaaagcaggaggaaggcaagtgcatgcaggaacaggaagcacataattggaatggctgacacctaagatgtgcacagagcgggggagaatatctggctgcagacgtcgataacaaaagctcccaaagggacctttaagccctacaaagggatccagactttgtctggaagaagctgaaagctattgaaacattttaagcagagaatacccatggggcttacacttaacaaagaccctgcagtattttgtgttagaatctgagcaaagagcatagcagcaggaatacaaagaaagatattttgaggcagaattgttgagtcttggtgacttatgaggaatgagaggggtcaaggatgtctccaaggatttctgccaggaaacttgatgggcagtgggatagagaaagctggtcccaacgtaacctctagttccttctcctagtatggtgttttccaatacgtaccaagatctcagtcagtcagtttcttaacttaatggggtttggccttgaaacaccaattgtagagagtgagacagattagtttgaccgagtttaatttttttttagctgtgctctttagatgtctaatacaagaggaaaatgtgacagctacaaagattaatgcaattgtaggtgacattagcggcacaggaataacaaagttagatgggtaatagtccccaactactttgtagtcaaattgcatagttctagtcttgcacaccgtatattttaagggacatgaacataaaccaattcattgattctagaggagggtgactaggaggatgagaggttttgaaatcacttcacatggccatttgtttcacctggaagaaatggaaaaaaaatatatagggcacagagtgggagaagatattgggtagatgttactagagagtccggtttaggatcacttggaagaagtcatttctatcagagttgctccgcaatgggacaggctgtctcacagagacctggctagaagttcccagaggaggtcgagggggttctgctaagaggctgtagaaccccttcctgcactggctgggaagatagatgaggcagtctctcaagcagtttccagtatgagaggtctgagattctgtgcacatgtgcaaataaacacaaatatttaaaaatctatgtctttgatttgcatattgacttcaatagttttgaacaactgccaagctctgtgctagataacttggaatacggcaataaaaatacctcatctctgcccttagatgttcatagcctagaagggatcatgaattgaagcagtaaatgttatatatgttatgttaatgacattctatttaaacctatatgttaatcaatgttagaattaatataagaaggttggacgcagtggctcacgcctgtaatcccaacactttgggaggccaaggcgggaggatcacctgaggtcaggagtctgagactagcctggccaacatggcaaaactccacctctactaaaaatacaaaaattagctgggtgtggwrgcaggcacctgtaattccagctatttgggaggctgaggcaggagaatcgcttgaacccaggaggtagaggttgcagtgaaccgagattgtgccactgcactccagcctgggcaacagagtgagactctgtctcaaaaaaaaaaagaattaatataattaatataagaaacacatagctctccatctctaattgatatctggaagggtcctaagaagcccacagtgtatgccatctaaccttttctgggagaacggactactacttctaaatccaggcacagagccgagtgatggcgggggcagggggatacaagagaacgagtcctgcctttaactaaatttccttgggttgatatttctagtttatacgcaccaaatatagtccatgcataaaaacgacccgccatcctactgggaggctgattttctccagaacacagaatgtggacatttgtgaggtgggcaggggaaaatggaagacaattttcttcttatcttactacggccatatgttctcctttatttccaccggcaagycttgagccagtcatatgaggggattttagcctgctctggaggactcctacaaacgtccccactaaactgattctactgcagtggccgaggtccttccttgacgcggcgcctggttctgtgtttgtgccactttgctcagccttccagctcctggtggtcagctgctgcccactctcctgtttaaacctggaccgcagacctctcacttttttcctcgcggctgatgtctggttccaggtggtagatctgtcttacgacggtcccataccctaamtccagcatgcctggtggctcagttctgacccagtgcctgtcctaaacattatgttctggacgctattgatctgcctgatccccagggcctctcctttgcctccctgcttcagctccttcaccaggacttgctttctctcaccccacaccttgggaagaactgtcaaagcatggctcctagctgtgagaatttgggggaaaacgasaagggggagtgcacatgcgtgtgtgtgtgtgtgtgtgtgtgtgtgtgtgtatccattttttcatctggaaaaatatgcatgttatcctagtggctccctctattccagcttcaagtctggggtgtccgtgacagcaggtgtggagcccgagaaagagtgtcctccccaggagtcttcccctcccacctgcagcatcaaagctgccctgcgggggtgcagctatgccgcctctcccttgccaggctctttctgcctctgcttcctgtgcctgcggcgagaggtgggggtgatctgccattgcacaggtgctaagctacccagcttttgctccagttccatccaggattatgaaataaacttaaactagactgcccacaccacacaggcacacacatgcacacgcatacaccaggcaggttctacagctaactactcatacacacaatctcttatcacgcagacacctcaacacactacacacacacacagaaaaatacacactcaccatacagtcagcacatacacatcacacatacatgtgggcaacacacacatacacaaacatagccagccatttgccatgcaatcatacacacaggcacacacagatgtgcattcaccatacaggcaggcaccccacacacatatacacccattgacccaaatacaacaatgcaagctccacacataactacctacatacacatacaccatgcaccttgcagacacctcatacatgtcacacgcatagtcatcggagggaaagaaagacttagagaccaagattttcacagacagtgaggaatgtgacccccctggacagaaagagctggggatggctgcttacccacaccatgctcagaagtcattcatattggggcaggggtcagcacagaaaagttagctcctgcctccccagatgcctctcataggcctatgggggcacctagaagtgacgttccatcacatcatcatctttgtccactaagccatagtattttattttattttattttattttattttattttgaggcagattctctctctctctcgcccagtttggagttcagtggcacgatctcggctcactgcagcctccacctcccaggttcaagtgattctcggtcctcagcctcccaagtagctgggattataggcgcatgccaccacgcccagctatttttgtatttttactacagatggggtttcaccatgctggccaggcttgtcctgaactcctgacctcaagtaacctgcctccctcggcttcccaaagtgctgagattataggcatgaaccaccgtgccccgttccactaagccatactctaaatcaccttacttccttccaggtctcccagcttggagtctggcaaattgtaaatactccataatgatccatttccctcctccattccttccagatcacagacctcaaagcctgatgtcctgttggaatcccaggactgctgctactagctttactaccgacctagtgacttaaactctgtctgtgtttcagttttttatttttattttttttcgaaacagaatctcgctctgttgcccaggctggagtgcagtggcgcaacctcggctcactgcaaacttcatctcccaggttcaagtgattcttctgcctcagcctcccgagtagctrgaattacaggcatgcaccaccacacccagctaattttgtatttttagtagagatggggtttcaccatgttggccagactggtctcgaactcctgacctcaagtgatcctcccacctcagcctcctaaagtgctgggattacaggcataagccactgtgccctgccactcagttttctttttttgttgttttattttttagagacagggtcctgctctggcatctaggctggcgtgcagtggtgtgatcatagctcactgtaacattgaactcctgggctctaggaatcctcctactttagcctctgagtagctgggactataggtgcacaccaccatgctagctaatttttaaattttttttttttttttytttttgaggcagaatcttgctctgtctcccaggctggagtgcagtggcacaacctcsgctcactgcaagctccgcctcccgggttcacgccattcccctgcctcagcctcccgagtagctgggactacaggcgcccgccaccacgcccggctgattttttgtatttttagtagagacggggtttcaccgtgttagccaggatggtctcaatcccctgaccttgtgatccgcctgctcggcctcccaaagtgctgggattacaggcgtgagccaccacgcccggccttaaaatttttttgtagagacagggttctccctatgttgcccaggtaggtcttgaactcctggcctgaagcaattctcccaccttggccttccaaagtgctgggattacaggcatgagctactgcacctggccttgtgtgtcagttttcttatctgtaaaatgaagataataacagaatcttccttatatgaaagttaatatatgagttagcttttgttgtttgctccaactcacaattctggcttttcaagactgctttgaaaccagactttgttgtgtttgtgttagctaatctcccagtttggcatcacctaaaaaccttctgcacattccctggaggtctctgtgagaatcctgcagggattaagagcccttccctctttttctcgtgttgctctgagatgtctgaatccagtagggtggcagcacatttctctcttcctctcttttcccacagcgctgatcccaggctttcgccaagcttcctccttttgaattccatgttctttgccatgtgtcttcctcacagtccgctctgattttcctgctactccattcagctggtcacccaggttagacatccgcagcacataaggcccatctgctgcttcttcagactgcacgcccagccaatgcaaagtcctgtcaaatctgatgctcacccctcccattctccctggagggagctttgctctgtctctggctcaggttatcgtctacctgggctcagcatctaggctctccctgctgagtttagattgtgatcaaatagtaaaaagaaacatattcactgttctacttgctcgaatcaaggctacagatgaaacccccaaaggcagagcttcctccagttcctgggctctgttcagctgcgttgagagcatttactctgtgcatgcaccactgtaactatcacctcacttggttcccagagtgacctcttgtgctaggagctttacccatgcccgttttgcaggtgaggtaactacacagagcttggagaagggccataacttgctcaktgtcatggctaaggtagtggccatggcaggatgcaaatgtgagactgtataattcttgagtcctaaagtcctatcacttatccatcaaggactctcagaaatggccaatccccggcaggaagaatgcatcaaaacagtcctgactgtccttttcagtcctcctgcttcaatcgaactggactttgagattaacttctcccttctctgtgcttctgctcatgccatttggggcacacaccttctttcatcactccgcatctctctcttccttcaaactccacctccaatgccatttgttattcaaagcctttttaatcttctagctagaagggacttttgtcttcataggtctccctggcacttggtacttctgttttgtttttagagatatggtctcgctctgtcacccaggctagggtacagtggcacagtcatagctcacagcagcctccaactcctgggctcaagctatcctcctgcctcggcctccctagtagctgggactacaggtgcaagcctccatgcacagctggtacttcttttcttgtggctttgctactctgccttgcattgtggttacttgtgcacttgccctttgccaccactgcattataagccttatgaagacagggatccaacaacttctttctatcccttgcctggaagagcaccctgcataaaatccaggctgtattcatgtatgttgagttactgcagaaccatttgttgagttgaatgagtgagagcaaggagcagaccacagggcatggagactttccaggttcaccttccttggtgccgttagcaagtctattggaatggttatcagcccaacttcaaccttcttgtccaaagcacagtgtgatagatgttgcaaagcatcctggcacacttttcaaaagagaaagtatttaatacacatctcttgctcttagcggctcaccctggttctcaacaggagccccttttatctctaaggttyaaacaccatctctttaatgatctattctggaattttcctatcatttkctaccaagctatcaatgctattatcaaagctaccaattgttatcaatggcaatttccgaaacatacccttttgaaatttgggacattttcttaacccctaattttctcgctgctcacgttttccttcattctatgatcatgtctggtcctttcatatagatattcacatgaaaaatctcaggcacccttcaaaatgttccctttgggtagtaagaaacagccctccctgtattggaaaggtactgctgagaaaaatcataatttattattatttttatttttaaaaaggctctgattatttgaacagattccttccctgaggactcaccctctgagtgattctgggctgagtccctctctcgattattaatgaatttgagatatggatgtggttgttggtcttgcccataaattatccagtcatgcatgaccacagtcagcagaaaaagaactttccagctcctcagctgctggattcagaaaagtgactgggtcgtgtggacatttctatgagggctccagtttctgaatgttatgagcaacttagtaaaagtgcaaggtaaacataaagtaccattcactgagagcagactaaattatgagccataaccttctcgagatagcctggtaccatttgggttatctcttttataaaacgtgctgagggtgattggtttggaaatagttgttctttcatgtatcttactttattttcctttgactcaaatggttaagatgagaagtggaaataattttctaacaataaattatttcctatctgaattatttttcctgtcaggactttctgttacttcctctgactccaaccatacacacactccccaactcaaacattgcaaatattgtgtttcttaaaatacttgtaattaccttttattattaacttcaatgtacaggtcttgccttcctatttataaactttgattcttcccttaatcagcatgcaatggtttttggttttgttttgttttgtttttaagttttatttttgtaaaagttattgtctgtactataccaacctatgggaacaaatgctattatctttacatttatgtcccaattcacatgaaatctaggcagaaactccaaacttttccaggagtcccctccctaaacatctcttccctatcaatatttgtaattatctcctcttctcctacctgctcttgtctgtcgggagaacccactatcttgtcagcaggactgggctgggctctcattccaccaacaacctcacccaccagtctcaaactccattagccttacctctaaataaacaagcacagaggctgggctggtggctcaagcctgtaatcccagcactttgggaggctgaggcaggtggatcacctgaagtcaggagttccagaccagcctggccaacatggagaaaccccatctctactaaaaatacaaaaacttagcgggttatggtggcacatgcctgtaaacccagttactagggaggctcaggcaggagactcacttgaacccaggaagtggagattgcagtgagctaagattgcaccactgcacttcagcctgggcagcagagtgagatccatctcaaaaagaaaaagaaaaaaaaaaaagagcaagcacagagattaaaaactacgtgttttatgctaacactgcttctaggaaaggtccataggcatggctgtcccagtaacatttctgtgtatgagctcttcccacttgagattctagtgcctcgctgggcacggtggcttacacctgtaatcccagcactctgggaggccaaggcgggcggatcacctgaggttgggagttcgggatctagtgccaacattgctcatcaatctcattcccctatgctggcttctgacagccctgaatctaccttctctctttcttaccctccaagggtcccaagcgtggtaacaatttcaatttatcttcggacaagtgtttgccagaagatctacccgcaaccaggttgaccaagtcaggataatttgagtgcaggtgtccactgggccagggctgcacttctccccagccattgaaagaaggccaggccaggaaaggtggctcacacctgtaatcccagcactttgggaggctgaggcgggtggatcacctgaggtcaggagttcaagactagcctagccaatgtggtgaaatcccatctctgctaaaaaatacaaaaagtagccaggtgtagtagtgcatgcctgtaatctcagctacttgggaggctgaggcagaagaatcacttgaacctgggaggtggaggttgcagtgagattgccccactgcactccagcctgggtgagcaagactgtctcaaaattgaaagagagagagagaggaaggaagggaaggaaggaaggaaaggaaggaaaagcaagcctgatgctgagacagaaccactggtgcaggctcccctcccctctctccccaccctgctgtggggttgtggattgcagggcgggaagcaaagtgtcctttttctatactccagccttgtcacagaagattagtggagaggcagtagaggggatgaggtgtgagtgtggaaggatgaagggaggggtgtgggatccttgtcagggtcctgggccctttcagaaaacttcttgactcctatgaaaattcatgaatctgaggatatactgagggcaaagatgctgtcccactttataggcagcttctggtttttaaatgcaaatgaatattttgggggaggtgtggtgcctatttccacccctttacaatcaagtttgagtcacaagcctgcaagtccagtcaaaacaacatcttggctgggcgtggtggctcatgcctacaatcccagcactttgggaggccaagggaggaggatcacttgaggccacaagttggagaccagcctgggcaacgtagtgagacctcagcattttaaaactagctgggtgtggtggagtacaactgtaatcccagctactctggagactgaggtgggaggactgcttaagcccaggggttagaggctgcagtgagccatgatcgcaccactgggattacaggcgagccaccatgcccagtcaaggattattttctatagcctctaatagaaaaaaaaaaaaaaactattttaaaattctcttcctgcagcctattggccagtggccacaggattctgtttagccaatatatacatatcctgtccagtggtgcaaagtacaaaaaagtgattttgttaggcttttcccacagagggtgtttaatgtcttcttaaaggtgtaagggaattgttcatggtttatttctttgtgaagtttttgattgaattaaaacaccaatataaattggacttaaactgtctaatggcaaattttctataataaacaaaattctaaaatcctagagaacagaaactgtggcttatagttctgcctccactgcacagtacttacttagcttcgtgcatggtaaaaataagggttctgtaagttcatttgttgggtgaatggatttatttattcatgaataaattctttattcatgaaagaacttatttattcactcattacatttcttcctttgtttgcattttacctttcattttgtttattctttggactcaataacacttttcatatcattttcaataagagagttgaataactgtatattgacctgaattgaaaagagaaatggaaacagaaaatctttagcaaattgaactaaaaatctcccagtgagttacaaattaatccagtgaaatgttccggatgttttggatgagggaattctatttcatacaggtcacactcccttaccaacctcaggcctggctgaaggaagattcttctaatccaaaacatcctgcaattttaatttaattatgaaacagcatgttgtgctagmtaagttagacttcaagatgacttagcagaaatcccctggtttgataataaatacagatgccatccagtgcaataaaaatgactgcatcaggccagaggcaggtacaaaaaagctgaaagaggcttttatttattgtgatgccagaggcaataaaattgtgtatcatttggggtgaaacttttaatttcatatcttgtaggtattaaactacacttgctatctgcacatccaagtaaatcgtctcccatctttactccctgtctttactttcacaaaaatcttaattctgggttctgccaacgctgctttcttacctattccttgtctgttccttgtctccacaaatctcccaacccctttcccatatctactctcctattccaccccacttttctctaaggaactccaggaagcagaggtgaaacccctgtccaagaatattcaaatatgtatttattccttcatgcaacaaaaatcagcctagcatggtgactcactcttgtaatctcagcactttgagaggctgaggcaggaggattgcttaaggccaggagttcaagaccagcttgggcaacataataagacgcctgtctccacaaaaaattaaaaaaaaaattagctggtcatgatggagcacagcttagtctcagttacttaagaggttgagatgggaggattgcttgagcctaggaattcaaggctgcagtgaactgtcatcatgccactacactccagcttgtgctacagagggagaccctgcacaaaacgaaacaaaacaaaatgaaacaaaaacaaaatgaaaacattcattaggcatctcctatgcataaggcattttgctttgtttgtaaagacagatcacaaaaaagcaagttattttgtctattctccaagggagatttaaatttgcaggcaggattgaagcagaatgagaaataggaaaaagatggagctgatatgtacaaatatgtaagacagatggagtcyctgccaggctgtaaatagcataggtcctaaaccaaactcatcatgttcctctgcaaaagcacttcctcccacagccttcctgttgcgtctcggtcccgcaagtgttcctgtgatccagaagcattttattgcacccatcttctggtcacctctgttgttgtgtatgcatttgcttgtttctttagcaggactatgtcttaaccctggcatatggaggcagatccaattcctagtccatccacatctctggagattattccagttttcagcattaataagttactaaaaaaaaattgttgagttaaattatgttcttaccattgcacaagcttacaaaatctgcttcagatcaaacagccatcttctacattgcagagtttgtttcgtatgcaaatggatcctctttcgttgagaagccaggtgtgtagaaactcagggaggaccaaagcaaggtgctggggctctgtgttctgtgcagtcttgggaactgacagagcagttgtggttatctgtttgaccttgtacttggtgaatcacatactgatgtagggggattccctgttgctaccactatttgttccattctctagtttcctactcgagtttcagatactctgcaactagaaatgaccttagttcttcccagttatcagatattattttctgaccctcagtttcgctggggatgccactagcctggcatatgaatggttttcaaataagaatctcttccaaacagaagaggcagcctgggtatatagtgatggtttctgccctttttctagggtgtactctcttgaagaccctctaggaagccaaaactgcactgggcatatctgcagcaatctctgtcatctcattagggtatgttgaaaataagtcaacctgtgagttagctattgtcagaaaattgctatgtaaccaacaaccacagatcctcatggtcaacaacaataatgaacattcatttcttgtacctgtgaagttcagctaatctaggctggactttgctgatctcaactggactcaacttatgcacctggggtctaatgggggttggctgaccttagatgaggttggctggggtgayttggttctgctctacctgtctacctcctagaacagtaggcttgcctgagcatatacttttcatggcaaaaacacagcaaaacaagctcaattacatgagtggttgtgtagacctctgattgtatcatgtctrtgacatcccattggtcaaagcaagtcatatggccaaacacagagtcaagaggtagagawatagcctccgtgtttttgttgttcttgttgttttgttttttgagacaaagtgttgctctgtgacccaggctggagtgcagtggtgatcatggctgtattagttcattttcacattgctataaggaaatacttgagactgggtaatttataaaggaaagaggtttaatcaactcatgcttctgcatggctggaaaggcctcaggaaacttacagtcatggtggaaggtgaaggggaagcaagccaccttcttcacaggcagcaggaaggagaagtgatgagtgaagggggaagaacctcttataaaactatcagatcttgtgaaaactcactattaccagaagagcatgggggaaactgctcccatgattcaattacctccacctggtctctcccttgacacacagggattatggggattatggggatcacaattcaagatgagattttgggtggggacacagccaaaccacatcattctgccccagcccctccmaaatctcatgtcctcacatttcaaaacataatcatgcctttccaattgtcccccaaattcttaactcattccagtattaacccaaaagtccaaatccaaagtctcatctgaaacaagtcaagtaccttccacctatgagcctgtaaaatcaaaagcaagttagttacttctgagatgcaatgggagtacagcactgggtaaatacacctgttacaaatgggagaaattggccaaaacaaaggggctacagaccccatgcaagtccaaattcagtggggcagtcattaaatcttagagctccaaaatatctcctttgacgccatgtcctacatccaggtcacactgatgcaagaggtggtctcccatggccttggacagctcygttcctgtggcattgcagggtacaaccccactcctggctgctttcacaggctggcgttgagtgtctgcaacttttccaggtgcatggtgtaagccgtcagtagatctaccattatggggtctggaggacagtggccctcttctcacagctccactaggctatgccctagtagggactctgtgtgggggctctgaccccacctttcccttccacactaccctaccagaggttctccatgagggctccacccctgccacaaacttcttcctggacatctgggcatttccatacatcctytgaaatctaggcagaggttctcaaacctcaattattaacttctgtgcacctgaaggcccaacacaatgtgtaaactgccaaggcttgggacttgcaccctctgaaacaatggtctgmgctgtacattggcccattttagccatggctaggatgcagggcaccaagtcctgagactggacaaagtagcaagaccctggatctggcccatgaaaccagtttttcctcctaggcctccaggcctgtgatggaaggggcagccatgaagacctctgacatgccctggagacatcttctccattgtcttggtgactaacatttggttcctcattacttatgcaaatttttccagcctgcttgaatttctccccagaaaatggggttttcttttatattgcattgtcaggctgcaaattttctaaactttatgctctgcttcccatttaaatataagttacaattccaaatcatctctttgtgaatgcatacaactgaatgctttcaagagcacccaagttacctcttgaacactttgcttcttagaaatttcttctgccagataccctaaatcatctctctcaagttcaaatttccacagatctctagggcaggggcaaagtgcttccagtctctttgctaaagcacagcaagagtcacctttattccagttcccaaaaagatcctcatctccatctgagaccacctcagcctggacttcattgtcaatatcactatcagtattttggtcaaagtcattcaacaagtctctagaaactttcaaacttttccacatcttcctgtcttcttttgaaccttccaaactcttccaacctctgcctgttacccagttccaaagttgcttccacatttacaggtatctttatagcagcaacatactctctgtggtaccaattgactgtattagtccattctcacattgctataaggaaatacctgagactgggtaatttataaagggaagatgtttaattgactcatggttcctgtggctgggaaggcctcagsaaacttacaatcatggtagaaggcgaaaaagccaccttcttcacatggcaaaaaggaaagagccccttataaaaccattagatctcatgaaaactcactcaatgccacaagaacagcgtggggaaaaccacccccatgattcaattatctctacctgatctttgccgtgacatgtgaagattttacgaggattatggggattacaattcaagatgagatattgggtgaggacacagccaaaccatatcaatggctcactgcagcctcaacctcctgggttcaagcaatcctcccacctsagcctctctcctctggagtagctgtgattacaggcacataccaccgcactcagctaaaattttaatttttagctgggtgcggtggctcacacctgtaatctcagcattttgggaggcygaggccggcggattgcctgaggtcaggggttcaaaaccagtctggccaacatggtgaaaccccatctctactaaaaatacaaaaaagttagctggatgtgggtggtgcacacctgtaatcccagctactccagaggctgaggcaggggaattgcttgaatcagggaggtggaggttgcagtgagccgagatcagctcactgcactccagcctgggtgacacagcgagactctgtctcaaaagaagaaaaaattattttttagagacacagtctccctatgttgcccaggcyggtctcaaactccaaagcaatcctcccacctcagcctcctaaagtgctgggattacagatgtgagccaccatgcccagccttgcattctgtgttcttaaataatagtgtgaccttgagtgragctcagctagaacactctagtacttctactccaccccattctattgctctttgatttctatccctcataatggagtcattcaggagaggaaagaacagatacttcttgaggcctttatttatgctaaaagtcactttacctttttcctttgcctttgattcctgttcactcctgtcctcaagttatttgactttttttgttctatggtggtgtctccagcatcctactttagagaaagaagttattggtctttcccctgtcctataccagaccccattttcattagcatgactgttttcctgacctcgtcatgatttgtgaatcccagagttcccttggagaactgaattattccaggaaaacaactttgagataaaacaacttcagcttcctcaaccaaattcctgatgacagttctgctttataaatcaaagctaccacttgatcccacaagtgcaaatgctttacctgtgcacttctgtgagacacagaacagcagaacttgttcttaatgaaacacttgatcatgcacagtggctcatgcctgtaatcctaatactttgggaggccaatgcaggaagatcacttgaggctaggagttcaagaccaacctgggcaacatagcaagaccccatgtctacaaaaagtaaaaaaaaaaaattagccaagcacaatggtgccatctgtagttccagctcctcaggaggctgaggtgggaagatcacttgagcccaggaggtgaaagctgcagtgagttatgacagtgccattgcactccagcctgggtggcagagtgagaccctgtctcaaaaataaaaataaacactttacatgcagtagtacttaaaccctattgaagaattttgttgggtaaagcctgtaaaatccagctgtaatacctcactgagtcctgcattaattaatcataattaataataaataactcatgagttaacgatggtcatttgtatttgtatgaattatgattttacctttttaaacattgcctttcaatactacattgctaaatcacattcagattataatctttatagccacttttacttattttgttcattctgcctgtaaggaaagttatttaaatttattaaaaccaatattgacttcatgtcatcattctgtaaacatttttcagaagtaaataactttcataaggacaaagacttgggtatcaaaggaagccaagaggcccagaataaacatgtgggcaggacctagggtgggcacagccctatcacacggttccctttacaagggtggttgggagtctctcagatgctggaagtgaggaaaaaggagtcagggcctggggaccacttggcagaggagttagtttttaggccagaacacacaaacctgtttgaggcattaagtatttggagaagaagacaaaaaacagaaatggtagccaagttccacctcattctaaataacagctgagttttaggtagaaaaaaggaaaggaagaatttataaagggaactggaagcaaccagaaatggggaaaatataaacgactcaaaagatactgtgatgctataattccactactaacagtccagtttctgcaaggttcttatctgattggaagaagaaaaacaatctacgggctcagggatacaaaagagtaatgcctaatttatgccttgttcccctaatcagtggctgtaagctgcttgccaaggactgaggccttcagagcctttgtgtttgctatgttggtgcttctgaaatgtttctcatgtaaatccttgtcgacagggcaagccctctaaccagggacccacatctctctataataatatccttaaggttttctctccattgttttgcccataagagcatttgagtttgactcttaactatcaatatctaactatctacctatctatcatctatctatctatacacatatatatgtatgtatatatatttctgtatatatacatatagttgagtcaaaagtgcaaatgcttaatatatatatatatatatatatatatatatatatatatatatttgccttttttttttttttttttttgagacagagtctccctcctttacccagactggagttaagtagcatgatcatggctcactgtagcctgggcctcctgggctcaggtgatcctcccacctgagccttttgagtggctgggtctacaggcatgtgccaccacatctggctaatttttgtattttttgtagagatgggttttcgccatgctgctcaggctggtcttgaactcctggaatcaagcaatactcccacttcaggctcccaaagtgctggaattacaggcatgagccactgagcctggccttaactatactttaaagcaggttttgaaactacttacacaggtttagccatgtgacactatttacagcagtcagtcagaactgaaggaagttcactctctgcctccacatggacaacatcatctcttggcagtgacccartacacaggctaaggacttgcctctttttgtctttggacaaaaagagttgtccaaaccctctkttttggacaactcagctagggctatcatttctttgtgccatttatgggtttatctgaaatacacagctgctgaaattgtctgaattaaatttcactctgtgatcaaacttttctttcattttcaaggttattggagcaagtttattcattacacaaggacattagtcatttttaacttggtattatgaagctgtctaatctaacatttatgtatacaactggcaagcctaatagtcccaagacagacccatgattttttttaaatatatatatatatatttattatattttaagttctagggtacatgtgcacaacgtgcaggtttgttacatatgtatacatgtgccatgctggtgtgctgcacccattaactcgtcatttacattaggtttatctcctaatgctatccctcccgccttcccccaccccacaacaggccccggtgtgtgatgctccccttccttgtccaagtgttctcattgttcaattcccacctatgagtgagaacatgcggtgtttggttttttgtccttgcgatagtttgctgagaatgatggtttccagcttcatccatgtccctaaaaaggacatgaactcatcattttttatagctgcatagtattccatggtgtatatgtgccacactttcttaatccagtctatgattgttggacatttgggttggttccaagtctttgctattgtgagtagtgccgcaataaacatacatgtgcatgtgtctttatagcagcatgattgatattcctttggtgtatacccagtaatgggatggctggagacccgtgatttttayggtcttggatgttgttcatgatgacaagggtgtacatgtcccagacgccatgctgcartgctgcacatttcaaagatactgtgtttttgcttttttttttgagacagggcctcactctgtcacccaggctagagtgcagtggcgtgatcttggctcagtgcaacctctgcctcccaggctcaagtgatcctcccgcctcagcctcccaagtagctggaattacaggtgtgcagcacatggctaatttttgtattttttgtagagatgatgtttcaccatgttgcccaggctggtctcaaactcctgacctcaagtcatccgcctaccttggcctcccaaagtgctagggtaacaggttgtattagtccattttcacactgctgataaaggcatacctgagactgggaagaaaataratttaatggactcacagttctacgtgactggggaggcctcacaatcatggcagaaggcaaaagacacttttgccttttggtggcagaaagagagaatgaggyagaagcgaaagtagaagccccttattaaaccatcagatcttgtgagacctattcacaaccattaaaacagtatggggaaaaccgcccccatgattcaattatctcccactgggtccctcccacaacacgtgggaattatggcagtacaattcaacttgagatttgggtggggacacagagccaaaccatatcacaggtgtaccatgccccgctgatactgtgttttaaaaccctcacttatggtagtagaattattatcttaactttagagatgaaacaataagcaaaatgctgagactttaaggttaagtaatttgcttacaatcacacagccaggaaagttaagtttaagtctagagtacttgccctaaaactccaagccattcactacaaaaatactcactggccacctggcaggtgaataaccatgccagcggcaaaggagaaatacayacacttcctatcatttaagagttttcattctacactcctcttagatcttggataagtcattcatgctggcattgtttatgataaaagtagatttacaaagattttctccactagattcaaaaagatatcttttcctgtggcaatctctgagatccattcaccttcgatactcagagtctttcttcgctactgtcatctcattatgtttagagatcctctagaataggtgctgtttatctgggagttaatgaacttggattttgtcaaatgtattttctgtgtctactgagatgattgtgtgattttctgtttattctatcaatataatgtattccattaattgattttctaatattaaaccaacctggaatccctgagataaatcccatttagtcatggtgtatgtttatgtttatttatttattttactattttaaaaatatttttatgttatatatattttaccactatttatttaytttactattaaaaatagtggtaaaatatatataacataaaatttgccatttgaaccattttcaagtgtawaattctttttatatgtgtctggattcggtttgctattactttattgaggattttactattcactaaaatgtggatattagtctgtagttttctttttctttcttttttttgatgttgttgtctgcttttggtgttggggtaatattggtctcataaaatggattgagaagtgtttcctctcttctattttttggaagcgcttgtctgatgtgttgggtagagcttgatgatgataggctttgactgttaaagtgaggctgcctggctttataacaaggcagtgagaacccattggagcttgaaccagagaatgtgcatttcagtaataattttgaaataataatttaacaaatcactacatgtaaatatatatgacaaagtaaatgggaaccctcctcatgagataaaggagaactgaaatcatatagtttaggaagcaaatgaaaaaaaaatcatacagcttaggaggcaagtggaaatatatctgtaatagacaagaaaggaataacttgtcattgatgccttaaaaatataagtttaacgtcaaggtaggcaaaaaaaataaagcatttacttgtaaaaattttagtatagaaataatgtacaaaagtagagaaaatagtataataatcccccatattctgatcttgtattcttcaacaattatcaacacatgaccagttttgtttcctctataccccctctacttttttttttttttttttgagacagagtctcgctctgtctcccaggctggagtgcagtggcatgatctcggctcactgcaagctccatctccttggttcatgccattctcctgcctcagcctcccgagtagctaggactacaggcgcctgccaccatgcccggttttttttttgtatttttagcagagatggggtttcaccatgttagccaggatggttttgatctcctgacttcatgatctgcccacctcagcctcccaaagtgctgggattacaggtgtgagccaccgcgcccagccaccccctctacttttaacccatactcctactcttgatgaattattttgaagcagattccagatactgaaattattttattcataaatattccagtatatatctctaaaatttaaggacttttaaaagcatagccctgtaaatgtcattgcatccaaaaaaaatcaacaatatttccataacatcatcaagtatccaggaaatgttccaaatatccctgatagtctcatactttttttaaaacttggtttgttcaaataggaatccaaactaaggctcttccattgcatttggtgaatatgccttttaaatatcttttaatctataaattacccctccctctattgttttttttggggggggcaatttatttgttgatgagtaatactttctgttggcctataaaatgtcctatactctgctttttgttgattttatccctgtggaggtgtggcttagccaagtttctccagagaaacagaatcaatagaagaaagagagagaaagaaggatttattacaaagaattgggtcacataattatggaggcaaacaggtcccaagatctgcagccaaccacctggagccccaagagagtgtaatctgaaaaactgagaaacagcagagctgatggtgtggttcagtccacaggccagcaggctcaaaactcaggaagagctgatgtttcagttctggttcaaagacaggaaaaacgttgatgctccctctggaaggctgtcagatgggaagaattctctcttagttagggtgggtcaacctttttgttctattcaggccttcaactgtaggatgaggtctacaatgatccaaaaagggaggaatctgctttacttagtctaccaatttaaatattaatctcatctaaaaacgccctcacagaaacatccagaataatgtctgaccaaatatctgggcacaccatggcccagtcaagttgacacacaaaatttactatcctagagtgtatttcctataagtttgtagttagtagttaggtcctgattagattctggattcttcctgtttttgtttgtttgtttgtttgtttgtttgttttggtaattgtcttacctctggccaataggctctggttcctaagtctttttggcatgcttttaccgtctttgacagtttctttgctggctgatatgacaagatgttccaaacttatccctgatgttgaatcgaccatttctccaaagaaccctgttcactttaaccagaaatggtatttagagtgcattaggccaggccagatatgtggctcatgcctttaatcccaacactttgggaggctgaggtgggcagattgcttgaggtcacgagtttgaggccagcctggctaacatggtgaaaccccatctctactaaaaatacaaaaattagccaggtatggtggcrtacacttgtaatcccagctacttgggaggttgaggtgggaggatcatttgaaccccagaggtggaggtttcagtgagccaagatcacrccactgcactccaccctgggtgacagagtgagaccctgtctcaaaaaaaaaaatgaagaaagaaaacggcctgggtgctaaggacacacttagctactcttagtcaaggtatctaggccttttcaacagacagagctaagaatagtgtattttaccataaaacacatcatgtgttctyrttaatatttccaattcaaacttaggatagaaggtttttatttaacttctttgatttgatatttatatttttcttgcactgaaaaccttagctcctaatgaaataatgtaatttatttttctactaaatacattatgatttcataataatcataccttactatcagaaaatatcatatcagagaaaaaattattctaaaaagagaattatggaaaaccacttcagatttctttacagttttttggttttgttttctgtttcttttttttttttttcttcctctggcatttaccccactaggattatgtggtctcatgactgtagtttaaaaatagaatcattaaaaaagtctagattcagctgacatccaggtattttagccaactatgaaggcagaaatgatgtgccatggagagattatgatctgagtgatgtagccaactattaacctaagtttctgcgaattcaggggatgtggacagctatattccatatttaacttcaccttctatatttagtaggagcacattgttgctactgatcagttattcaatgggatgagagttaaattcactcatgaagcttttgtctttaggaggaaaatgtaaagttttagagccacagagggttacagtggtactgaaccttgaaggccacctggtttaatcaccgtagtctacagaggaggaaactaagatccagcagtgtctagcaacttacctaagatctcaccactagttagtagcagggatagaactggaaaataatctgctgtctcctttccattgatctgtgctgtkcccttgctctccttgtgtaaatgctgaagcggatcatcatgagcccaggatgagcaagggaggcccgttctgaaagttcaatctcaagactgaacacactcaaaaaatgcttatgagacatttggtgggctatttggtaaatattgagtaattggctctaagtatataacaagacaggctttattgtctttttaattttttacttgcccaggtgataaattgaatatgtatctggtatgatctgaaagctggagacactatgtcaaacatttaagacaatcttctcaccgtattctatttttaaaacaatacaacagtacttgaaaataatttctaaagtctcgattataaatgttgtctgtgttcatgtatctcattcaataaaccaccactacatacaatgtactgggctacatggactttttcaacaactagaaccctgcaaatatggaactaggctgccccataagttagtgaagtggagaactgacaactagtggattagtgaattcttaccagaaatatgcacagggaattcctacagaggtcaaaggatgggacttgatgacatctggtgtccttgtcctttctaatcctaagattagattgtttttgttttgttgttttgttttagagagtcttgctatgttaactaggctggacttgaaccttgaactcctgggctcaaaggacctcccacctcagccttccaagcagctggaaccataggtgcgcaccatcatggctggctggatgagagacctgtattctataatttgtgtgatgcccctattaaagtagcttgtttggggagcgagtagtaaccatttacacaaagagatacaacatgttcttctctcccctttttcttctaagtcaaagttcagtctctatttacagccaacccccgaaggctcaacatatcagagaataaggcatagtgagcccttagggaaagtctccatggaactctcatcttagggacccctcttcacgaatgaaaagacatgctttgcgggaatcacagcaacttcctgctggccgtgcacgtcctgcctatttctgttctcttctctccagctgtcttccatttcaatcacacacttgtctctgttactgataccccctcccactccgggtttattagtagctacgttctcagcccaacggtgaaagagaagcaagtggacaattttgggacctggaaagttattcatccacagccgacgtgctggttcacgttaacgccagccaacaaatgcatgagcccctactgcgggcccggctctgagataggtgctggggaaagtgaaggagacacagttcctgctcttccaggctagagggggaaaggagacgagaaaggagaggttacaggaaagcccgagagcatgagcacggaaaagggtaaagtcctagcctcacagaggattagaagccactctgagccaaatgatttcactgtgacctgaaggaaaaggggaggagaatttccaggcaggggaaagacagatccaaaggtccagaacaacgggagttcagggaattcaaggaactgaaagagtaaggcatgttggagtgactgtctcgagatgactcaagcgaggaaggcaggagttagaccaccagtggaggggcttgtcacagaactccaagaagtgctcaccagaacttcagctctgacttatggatatatatgtgtgtgtgtgtgtatatatataacatacacacacatgtatatatacacacacacatatacacacacacacacacacacacatatatatatatatttttttttttttttttgagatggagtcttgctctgtcgcccaggctggagggcagtggtgtgatcttcgctcactgcaacctccacctccagggttcaagtgattctcctgcctcagcctcctaaatagctgggattacagtcgctcaccaccacacctggctaattttgtatttttagtaaagacagggtttcaccatgttggccaggctggcctcgaactcctgacatcaggtgatccaccctcattggcctcccaaagtgttgggattacaggcatgagccactgcacctaaccttttttttctcttttaaacagagacagagtctcactcttgtcaccagsctggagtgcaggggcgccatcacagctcactgcagcctcagcctctggggctcaatcatcatggctcactgcagcctcagtcttcccgcctcagcctcccaagtagctgggactacaaggcgcatgccaccacactcagctatttttttttttttttttttttttggtagagatagagtctgctttattgcccaggctggtctcgaactcctgcagtcaagcgatcctccagcctcagcctctcaaagtgttgggactacaggtgtcagccactgtgcccagcctatggatatattcttcagtgctgaagaaattatttcccagcctgttaaatggcttctcagttttgctttgagtaatcaaaaaccactatttgctgagcacactctagaagcagatatggtagtactaggccatgggagaaaatccagtgatagcaagcagccctcccactacagagctcataaaatgaggttctytctttttcaaactccagatactgataacaaatacattcaaaaaccaacagacaaaaaataaaaggctaaaagaaactcatcatcaactcctttagaccaaattttaaaatatagtgmgataggccagacacagtggctcacatctgtaattccagcactttgggaggccgaggtgggtagatcacttgaggtcaggagtttgagaccagtgtgtccaacatggctctacttaaaatacaaaattagccgggtgtggtagtgtgtgcctgtaatcccaggtacttgggaagctaaggcaggagaattgcttaaacccaggaggcagaggttgcagtgagccaagatcacaccactgcactccagcctgggcaacagagcgagactccgtctcaaaaaaaaaaaaaaaaatagagtgggatacttgtcactacaggtaaaacagaaactctaaggcaaaagggagctgattcccgtagcaaaatgtttttaatttgagagtgtgggatgagaaacccggttctatgaccacagagttccacttggatgtcccaaccatggctcctagaatcaggtgctctctgtcctggtgcagtggctcacacctgtaatccccgcactttgggaggctgaggcaggatgattgtttgagcccaggaggtcaagagcagcctgggcaacacagggagacttgtcagtacaaataatttaaaaattagttgggtgtggtggcatgcacctgtggtcccagctactcaacaggctgaggtagaaggattgtttaagcccaggagtttgaggctgcagtgagctacgatcgtaccacagcacttcaagctgggtgacagagtgaaaacctatctcaaaaaaaaaaaaaaaaaaaaggagagagagagagaatcaagggtctctctttgggcattgggttcctccctagaacttccgtgtgtattactaacaacacaattgagagcactaggaaaaatagctaatgcatgctgagcttaagacctaggtgatgggttaatagatgcaacaaaccaccatggcacacatttacctgtgtaacaaacctacacatcctgcacatgtaccccagaactaaaaattaaaattaaaaaagaaataacatggtctaacaagggctgaggaagagatgcgcctcgggtgcctcaggcagcctgcatgccaagtgatgaggatggggggccagggaacagctccgccctcggccgctcaccaccccaggatccttcagtctaggctgagtagtaatagcaaatcccattcacatcatatttcattaggctctcacgtgccttattcagctgacctctaatgagagcatgcatgagaatcacccagaagggctacgggaaccgagggctgaggaccgggtgccgtccccagagctctgactcggcaggtcagggcgggactgagaattgcatttctcacaggttcctgggccctgctatgctgctggttcagggaccacatctggagaatcaccggtgaactcatttcacagaaaaccttcaaaggccagctctgccgccaggctgttaagcttcggagggaacaaacccctgccctgaaggggctcgcccacagtgaaggaaacagaaataaaaaataaagtattagaatgtaatgcaatagaacagcggtccccaacctttttggcaccagggaccggtttcgtggaagacagtttttccacggacgggggtcgcagggtagtttcaggatgattcaaatgcattatatttattgtgcaggttatttgtattatgattacattgcaatatataatgaaataattatacaactcaccataacgtagaatcagtgggagccctgagcttgttttactgaaactagacggtcccatctgggggtgatgggagacagtgacagatcatcaggcattagattctgataaggagsagggaacccagatccctcgtatgtgcagtttgcaatagggttcgtgctcctatgagaatctaatgcccagctgatctgacaggaggcggagctcaggtggtgatgtgagccatggggagcagctgcagatacaratgaagcttcactcacctgcctgccactcacctcctgctgtrcggcctagttcctaacaggccacagactggtaccagcccatggcccaggggttggggacccctgcaataaaacaaagtctcaaatggaggttagaggaggctgctatgagcacagagyggagaaataggcccacctcagtcagggaagataagaamaggttagccacggcttctagcagggaagagagtaagagaacaaatccaagaagaagctgtgtattcagaaacagcagggaggcctgcaagggcaatggccctgtctcagtgaaactggggaggaaacccatatgtagaaacggatggggagaagagaatggaaaaggcaagtagagattgataagtgctccaaggaggagagagacctggtaagatctgccttttgggaagctcattccagggggtagggtggaggaagatgggggtggggcaggcgtggagccaggctggaggaggctgttctgtgctgcaggtgccagagggaggcttgagcccagaagaggcggtgggtggagggcctgagcctaatgggatctcagggatctgccagtatacgtctcacatcttggtggagaggagggttcaaaacttgcaggtctcttgtgttttggcttcacagacagagtgaattggctcctctctgctaaggagtcaaggacacacatgctggtgccacacagaggaggaaacctataagccaggaagtaggagcacacacccagtgctgtcccacaactcggatcagaggatcagacggcagcagctccctgccagggattaagagcccacccctgccccctgctgcctgctcccttgcactctacatatttgtagggatggggtcaggggacatccctgtgattatggaagctccctggttgggagaaataaccttggttcaaaaggggagcacctggtccccagagactgtaaccagcccggcctcctggggacctgggcagatctgctgagcctgatctccgctaagttcaagagaggggagatgaggctctgcaaccaccatcagatgccccagccaattctcggagacagagagagccaggagttttgccagcccacctcagctgtgctgactgagcactggccaccagtgggcttctctgctgctccccaagggagggaagtggccagcagggtttgaaagagtttcagtgctgtttgccccaatggcctctgggcccctggtgagggtgactggcttggagctccaggaaggtggcaagggctccattcccacctcatcctccagctgcctttctctgggtggcgtctcagtgaagccagcctggggtctatcctcatgtgctctcatgatcccaagcccacctgcatgggtcragggtccctgcatctctctckctctctctgtctctctctgtccctctctctccctctttccctctctctctctctctccctcaccctctctccctgtcgggacttgagcaccatggctctgctgtgatgagcaccatggctctgctgtgatgtgacttatgattgatgctgcccctgagcgtgctgggtggtcttctatgcttgtcacaaatctctgccatctaattccacccccatcgcccagattgcttccttccgtgtgccactccccttctgggcayttgtggtgataggacatatgaggggaggagctggtttgggaggcgcaaaggcatgataaactcgattttgaatgtgtcaaatatgacttacaggcaggttgacaggatagagatggattgtcggcatttggttagacgtgtgtggagctcaagaggggagcctgagctggtgtcttagtctgttcaggctgctataacaaaatgccttagatcgggtaactcatagacaacagaaatgtatttcccacggttctggagggtgggaagtaagtccaaggtcaaggtgctgatggatttggtgtccggtgagggctgctttctgattcacaggtgagtcttctctctgtgtcctcacgtggtggcagaagtgaggcagctctccggagccttctgtataagggcactaatcccattaatgggggctccaccctcaagatctaatcacctcccgaaggccccacctcccaaygccatcaccttgggcatttggatttcaacgtgtgaattttggagggacacagatattcagaccatagcagctgtgggtraagattcaaagactcagaaacagatgggacctcccaggcagtgtgtgaagggcaaggctggaaccctgaacaccagtgacaagtaggagatggagagagaaaggaggatgctaccatgtggatgaaaaggggctttaacacatattgctcaggtggcctcactatgaaataacaggacagatgaagtcactgagtctcgggggcaccttcacaatctctcacagctgttagtggcagagccaggtctccaagttcagaatttttctccctacatttgttcacttattcattcaacagtcactgattgtgctcttttctgtgtgtgtacagggtcttgtgttcataccatgagcagcatagcagggacccaagcaagactgggaggagaggcgggatgcagacaagttgggaaccagccacgcctctcctcctagcaggggagttgctctaataggttttaattttattcagctttggtgaggccaatagatcagatgatgactctcactgaagagagagtttcttactctcagatctaagagaagtgggcacgccacgccatgcagggacacccggggcagcacgagggctggtcaagaggcagagggagaagagaacgtggccagagcccttattatggtttccacaggaargagtgggcaaggcagggttagctagctcaggactggctagtttaaatcatttcagcaggctctggggcatacaggctgttcctatttgtcagatacctggtcctgggtgattagggcagggggatagtggcctggagtgtgagagccagataagggaattggttgggatgcgagctctgggttggttttcatttgaaaagcatatcmcccggaggactccttccagggggagggggacagtgagggagacatattattgggttgcacagagcaaggtgtgtcctgcagatgcacgcggggcagatgttaaagcatcaggtttacagaaaggagaaacatggttaatacagaagcagaaaaggaatgcaaaacagagaacaactgcaaaggtgcacatgcggaaacacaggttgatgtcctgccaacyctactstggatggtctgtggaccagcagcacctgggacttagagaggcagcgtctcaacccctcaccccagactgaacgaatctgaatctgcaacaccctcaggtaacccatatgtatcttaagccatgataagtactggcatcagctgcagacaggcccgtggacagatggaggaggaggaggaaaacgtgtggttcgttagggaggcttcttggaggagtcctctaacaatgaaagccagctttcatgtgaaaagaaatgagatcttttgcctaaaacagtggttctcaaaattggctgcaaattggaatcacctgttgtgttttaaaaagctctggaggccaggcacagtggctcatgcctataattccagcactttgggaggctgaggctggcagatcacttgagtcagaagttcaagaccagcctggccaacatggcaaaacaccatatcaamtaaaatagaaaaaaaaaatagctggacatggtggtgcatgcctgtagtcccagctacttgggaggctgaggcatgagaatcgcttgagcccagggagctgaggttgcagtgagccaagatcgcaccactgcactccagcctggacaacagagtgagactctgtctcaaaaataaataagcaagtaaataaataaatataaaaagcactgatccctgcttccaaacactggagattcagatttaattgagataaggccaggatgtagagcgtttacagaactccccaggtgatttaaacatacagccatgttagagaaccactggcctttgccatacggaagatataatgtgctgtaccaggaccagagaacagagaaacagaggaatcagatggtttgagagcaagaccaggagtgtgcaggtctgyccggtgggtggggtgaacagggagggtgcgcctaggatccttctcccctcccatccccatttggcttcctgggccacgttcctcagcgcttcgttggttcttacccggatgcttgtattctgcttccccctagtggtgacttgcagtatggcacagctgtcgctggcggtttcattaaggttccgcgttcatcactaacttgtgacagtgagttacagcctgtggtctcgacaggtgggatcatcctaagaatcatgtcctgtgagcatcttcgccatgtgacttcaggagttgctccctcacaaggagcctcagggagttataggtcactggccaagcactgccctggcacagggctgcaactgcagcctaagtggcttcctgtgcgtaaggtttaaggaactttcattttattagccagtggttaagtgcctgtgagmgcaatcatcagcaggtgcagtggtagaagataacaagcttcctaataaatagtggccaccggccgggtgcagtggctcatgcctgtaatcccagcactttgggaggccgaggcaggcagatcacgaggtcaggagttcaagaacagcctggtcaacatggtgaaaccgtatctctactaaaaatataaaaattagccgggtgtggtggcgggtgcctgtaatcccaactacttgggaggctgaggcagggaaaattgcttgaacctgggaggcagaggttgcagtgacctgagatcacaccactgcactccagtctgggtgacagagcaagactccatctcggggggaaaaaaagtggccaccacttaaatctttgtagcaagaatgggttttacttaattatcacatttcattccaatgacaagcctgaaggtattaggattgtcaaatatttttattgcaaatatgcattactaaggctattttttaaaaaatacttcgctatataaagtcatattcttctctgagatggacatttagcaaaaataaagtcacagacttaacattatagtcatgaataaatgttttaaaattatgagggagaaagaacattaactagagaaaatgttgctacatcactttcaaaataagcacatattttaaacagacatggtttgcagaagaggattctcatcttacagataagaaaacaaacctggagaccttaaggaacttgatcaaggtcacatagccagtgacagatgcagggtttgaacccacattggctggacagcactgtctgtatgtacagctcctcccacatcccctgcaagagtccaggggttctcacctgctcaagggtttgcaacagagacttcacttgaatccctgattgagtctctggttcctccaagctcccctagttcctctttgtattagtccatcttcacactgctaataaagacatacccaagactggggaatttataaaggaaggaggtttaatggactcacagttccacatggctagggaggcctcacaatcatggtggaaggcgaaggaggaacgtcacatcctacatggtggcagggaagagaaaacttgtgcgggggagctccttcttatagaaccatcagatcttgtgagactcacgatcacaaaaacagcatgggaatgacccgcccccatgattcaattacctcccaccgggtccctcccacgacacaygggaattgtaggagctataattcaaaatgagatttgagtggggtcacagccaaaccatatctctcttctttccagtttcacattgactcagacacttccttcggtagagcagtctctgaaggccctgtattagrggagaatgcccttgcccaatcctggcagaaaacctctctccacagctcacacccagagctgggctcaggccagatgaggaagagagataatgagagaaataggaagcgtctgaagctggcagccattgtggtcccctgagctggctggttccttttcttctcccctgaagctcctgcccactgggagccagctcctgtccaccctaccccagtttcaagagttcctaaaactctggtgtgaaccagaaccactgggaaacttrttagaatgcagatcccttggctccaccctcaaaaattctgattcaggataatcaaaaacgggacccaggaatttgcattttaagcaaacaacccacgtgaattctgctgcatggggtcctcagaacacacrttgagaaatattcaatagacacgctattcacattcaagagtaccaatgaaggcccataagctatgttgaaatacttagaagttatctatcaagtgaataaactgtcaaatatatatacataactacatggcaggctagaattcctrggctctatagcccaagccagaaggtaatgggacagcaagagctaacccccagctgccatccttcccctttgtcttcccactttatgccatgaggaacttgcttcttgagcaagaggacacaccatccataaattcaagcacaggcactctccgtccaccctgtaacagctgcatcttgaccacctattgggctagaatggaccccagagaggaagctggcattgaccctggaggcagaaaattcccaggcactcagagcatggcctagatggggaagagtttccaggaggacgcatgcccttgaccttgcagactcataattttaaaacatttatgactaactataatgttaaatctgtgactcagtgcrgaccttgcctgcactgaggggargggcagcagaggatggccrgggcagaaccctctaagctgacatttctccaacattcatgggaatagaaatttcctgggatctgaatcagtaggtctagggcagggaccaagattctgcgtttctaacagcctcccaggtaaagctggtgaggctggtcttcagaccacagaatgaagcagcaaagctgtaaagcaggggtcagtaccaggtagtaaacttttagtctctgagggccatgtggtttctgtggcaattattcaactctgctgttgggcatgagaacagccacagatgatatttaagagaatgagcatggctgtgttccaggaaaacttcatttgtgaacactgaaatttgaatttcagataatcttcctatgttgcaaaatattcttcttttgggttctttccattatttaaaaatgtaaaaactcgatcaggcacagtagctcacgcctgtaatcccagcattttgggargccgaagtgagtggatcacctgagatcaggagttggagaccagcctgagcaacatggcaaaaccccatctctactaaaaatacaaaattagctgggtgtggtggtgcatgtctgtaatcccagtaacttgggaggctgaggcaggaggatyacttgaacccaggaggcggaggttgcaatgagcaaagatcgcaccactacactccagcctgggcgacagagtgagactctgmctcaaaaaagtaaaaactcaatcataacgtaacttaattgtacatgtaaaaataamagagtataattggattgtttgtaacactaaggataaatgcttgaggggatggataccccatgttacatgatgtgcttatttcacatygcatgcctgtatcaaaacgtcccatgtaccccataaatatatayacctactatgtacccacaacaattacaaatttaaaaatttacaaaagatttttaaaatgtaaaaaacattttttacataggctatacagaaacaggtctggatggggaggttagatttggcccaaagtctgtagtttgttgactccttctctaatatatatggcccaagtcaggcaccgtgcacagctgggtctaagagctgtgctgatctacaaagcccacatgaagctgctgtggcagaaagggtctagagcctcactgagtcatgtcttttggggatagatgggtcttctaggtgcccatcaaatcacaccttctcgggctgccttcagtgcacacctatgagaccaatcttgctgatccagggcaggaagtctagtccagatccaccctgctgtgttacccaggagctcagattcagtctcagaaccatctggattgttttattctcatgatgtacttaatcctgattgaagtataaatgaataaactggctgggcgcggtggctcacgcctgtaatcccagcactttgggaggctgaggtgggtggatcacctgaggtcaggagtttgagaccaccctggccaacatggtgaaacccccatctctactaaaaatacaaaaaattagctkggcrtggtggcgtgtgcctgtaatcccagctactccrgaggctaagacaggagaatctcttgaacccaggaggcagaggttgcaatgagccaagatcgtgccactgtactccagcctgggcaacaagagcgaaactccatttcaaaaataaataaatacataaataagcccattaracatcacgaatttaatgtgaggccaacattcttactggtgagaaatgattctccatckttcttgggagaaagtgacgctgcccgtcctcaggcctgggagctgctgaggaggggagagtgaggaggttggtttatgtaaaaggtgtggcactgccactctgtgcagattcctggaggattcacctgactacttattgatttttcaytgaacagctttctcctcgttcagactgtgggctctctgagaagatggggaaacattatttgggagatttacccttagggtgaaaattatctaagcttatttctcaatttccctctcctcccctcatttctcatctctaattttttttctttcttttttattaaaattttttgtagagacatggtctcactatgttgcccaggctggtcttcaactactgagctcaagcaatcctcctgcyttggcctcccaaagtgctaggattataggcatgacccactgtgcccggcctcttaattttttaagcatcacaggttgtatccccagaaaccagactctaaagaggcatttcatgaaggcgctgcctgtgggagggaccacacctgtggaaggtaggggacagaagcaggagtgggcagagcagtgacgttgagctacaacccaaggctgacagtctcagcaaacctcaccaagagctctggagttaggtggacttttagaaacatgccaagcatggctgagctggccaagcccttatgctccaccatccattggtcactcgatatgascttccccaggcaygagtgtgctatggtctgaatatttgtgtccctccraaactcgtatgttaaaatgctaacccccaaggtgatggtattgggatgtggggcctttgggaggtrattaggtcacaaggatggagccctcgggatgggattagtgcccttatagaagacaccccagagaggtccctcccttatcccttccaccacatgaggatacagtaagaagacattgtctatcagttaggaagccaaccctcaccaggcatcaaatttgctggtgccttgactttggccttcccagcctctagaattgtgagaaatacatttctgttgtttttgaactacttagtctctggtaggatagcagcccaaaaggacaaagatagggcatgtccttgggtgaggcagctctctgcagctcagtcactttctgagagggctaagagctacaggctgactgcagcagcacttctagcagctggggcctgatgtccttcactgtcctttctgggcagcatatcacagtatccactgcacaccactcggctatcattctgttcagatacttcttgactggtctttctacttctaatttgttccatgtagaatctatcctaaacactacttccctaatctttcttaaaggaaaatattggtaaaatatttcatagtctgtcattatgaataattttatatgtcattcccctgaaaagaggtgttacaaggtcaagttttttcagttatgcaggaaatgtaagtgtgtaaagaagcaggatgaggccaggtgtggtggctcacgcctgtaatcccagcacattgggaggccaaggtgggcagatcacttgaggtcaggagttcaagaccrgcctggccaacatggygaaaccccgtctctactaaaaatacaaaaaaaaaaaaaaaaamcccacaaaaattagccaggtgtggtggcaagcacctgtagtyccagctactcgggaggctgaggcacaagaatcgcttggacccaggaggtggaggttggaatgagccaagattgtgccactgcactccagcctgggtaacaaagtgagaccctgtctcaaaaaaaaaaaaaaaaaaaaaaaaaaaaaagaagcagagtgcaatacaacatggtatgatggggtcttatttagtttgatttagtttgcctccacttcaccccactggtgagggagggattccgccctagagttgagaggatggttgaatgtacaacatccaagcctagacagatgagrtgggcagcaggtaattagtcacatatgctcatggcccagggaaggacgacactgccccacagagagccacgtgggggttgcagytgggaacagagtgaaccaccaggagctgtgggaggcaggctttgtagtaacaagagggcgaggtgcccctggttcctgtaagaggatgtgtttggtttgcttggataattctacaggctgacggggacctgaagcctagcactgcgcctggtccctttgataaggagggttgcttggctagaggactttatccaccaggagcagagtgggaggagaacttgcagttaatccatttgagcctctgtaccctgattttaccagcctccatggtcaaggcagcacttagttttgaatcttaatttcaggccttacaccacaggtctatgagtcattggagctgaatttcctatccaaaggyattcaaaattattttcaaatctgatctggccaaacagaattctaccattcatcactgctggttttcaagcccgggcccactccagattccctagaatggcacatcagggcattcctaatcaggcctaatccatatctcctttctcatcatccctgctaaatttcagcctgagtttacacacattcactggacaacttgtgtttttggcatactcagctgtatgtttttcctcactctatttcctccagataaggactagaaattctagccrtgctttgaggccaactcaaatgtaacctcctctggggtgactttcctgggcattgcaggataagtgcctggatgrccttgataacccagctcttcccccatttttcacttgtagttctcagaataaygctagaatgtgctggaaacaacattctgagataaggaaaagctgtccagaayatgccagattctgtttctgttcctcttaggacaagatgtcctccaatgctgtggtccagtgatcccagtttccccccagggtataaaacccagagtggagtgctttcagagtgcctcagctacagtgcattgtggggcatgtgcagacaagactccatccattctgagtagcttcctgagccttgcagaatcagctcgcaatggatgctaggcttctgttgtgccttgctgcctatctgtgatgaataaagttgctttgcctaacttgttctgtgagtgttctgtctccctcaactcctgcaagtggtagaaattgcagcccaagatgcaataggcgcattttgggaggccgatgtgggtggatcacttgaggtcaggagtttgagaccagcctggccaacatggcaaaactccatctctactaaaaatacaaaaattagccaggcatggtggcatgcgcctgtagtcccagctactctggaggctgaggcaggagaatcacttgaacctgggaggtggaggttacagtgagccaagatcgcaccactgcactccagcctgggcaacacagtgagacccccatctcaaaaaaaaaaaaaaaaaagatgcaattggcagaagtatctggactcctcttcctggtggttggttggcatagtgatgatctttgctatcctccatgtagtaggatctcccctggaattggtaaccagagtacagtgaacctgcctcacaggcatctcaaacagaatgaaaggtgccttgctttttattcctaaagatttttctttttccatcctggccatatgattcagtagccacattttagcctctcagttgtgcatgtgcctccacctggccacgttgtgagctctttggggaggcagaactacactctccctttaccgcctcagtgttcaacatggtgcctgatacttgggtgctcaatcaatgagttgcacatggaaaatttaaagaaataaggtttttggtggagaaaagaggtgaaaagtcatggccaaaatgaagtggagattttgctgttgtcgctgtgctatcgtctttgtgttgtgtttcgcacggatttgaactgtccgtgtccagcctgttgctctttagcatgattctaacctacacctatgggtgttctctgcatctatctcctgattaagcacatgctattctcacaggcaatttgttctggcagcctatgatgtcatttctaggagaacactcttgtccagtctctgctatcctagcatcctcttgctcagaactgaagtttcccaagaagactatctcctgtttgcaggacttacttttctatttttcccttagagggttacctatgaagagaactttacactgatataaagtcatcacaaaatcatttttgaatattcagtacaaataatgctgaagactggctaaagagtatgttatcactgctctaagctttgcatttgggttcatctgtggaagcatagtaattcttgaaatttcctctgcacttctcttagtttatctctttctgtcatgtagaagttattcatgttcacattttatcttccctcctagaccaggagtttcattaggaaaaaaagaaatttttcattatagagaatttgaaacacatacaaaaataacagagaagagtataaactctcacatacttcatgaactcatggacaatcttgtcacatctgtactcccattccctatggttctaagtttttctaattttttaatttttgagatgagatctcactctgttgcccagggtggagtgcagtggcgtgatcatggttcactgcagccttgacctcccagattcaaatgaccctcccacctcagcttcccgagtatctaggactacaggtgcacaccaccatgcctggctaattttaaaaaatttttttgtagagacagggtctcacaatgttgctcaagctggtctcgaacccctgggctcaagtgatcctcctgtctcagcctcccaaagtgctaggattacaggcatgagccactgagcctggcctaatttttttttcttttctctttttttgagatggagtctcgctctgtcacccaggctggagtgcagtggcgtgatctcgactcaccacaacctccacctcccgggttcaagcaattctctacctcagcctcccaaggagctgggattaccagcgcctgccaccatgtctggctaatttttgtatttttagtagagacagggttttaccgtcttagccaggctggtctcaaactcttgacctgggtgacagagtgagaccccatctcaaaaaaaaaaaaaaaagaaagatgcaattggtggaagtatccacccacctcggcctcccaatgtaatagaattacaggtgtgaaccaccatgcctggcctcaaattttttttttaacaattttttaacaattttttttccataagttattggggtacaggtggtatttggttacatgagtaaattctttagtggtgatttgtgagattttggtgcatccatcacccgagcagtatacactgcaccatatttgtagtcttttatccctygccaccctcccactcttccccccaagtccccaaagtccaytgtatcattcttatgcctttgcatcctcatagcttagctcccacatatcagtgagaacatatgatgtttggttttcygttcctgagttmcttcacttagaataatagtctccagtcttatccaggtcactgcaaacactgataattcatttctttttaggtctgcgtagtattccatcatatatatatatgtgccactatatatataccacaatctcttcatccacttgttgattgataggcatttgggttggttccaggattttgcaattgtaaattgtgctgctgtaaacatgcatatgcaagtatctttttggtgtaatgatgtaatgacttcttttcytctgggtagatacccagtagtgggattgctggatcaaatcatagttctactttttgttcttttttttttttttttttgaaacggagtttctctcgtcacccaggctagagtgcaatggcatgatctctgctcactgcaacctccggctcctgggttcaagtaattctcctgcctcagcctcccgagaagctgggattcaaggcactcaccaccacgccaggctagttttactttttagtagaaatggggtttcaccatgttggccaggcttgtcttgaactcctgaccacaggtgatccacctgccttggcctcccaaagtgctgggattacagatgtaagccaccacgcccgaccctacttttagttctttaaggactctctacactgttttccatagtggctgtttatactgttttccactgtggctagtttacattcccaccagcaatgcagaagggttccctgttcactgcacccatgccaacgtctactggttttttttttattttttgataatggccattcttgcagaagtgaggtggtatcgcattgtggttttgatttgcatttccctgatcattggtgatgttgagcattctttcatatgtttgttggccatttatatatcttcttttgagagctgtctgttcatgtccttgggccactttttgatgggattttttttcttactcatttgagcttgttgtatattctggatattagtcctttgtcagatgtatagattgtgaacattttctcccactctgtggttgtctgtttactgtgctgactgttccttttaccatgcaaaagttctttagtttaattaggtcctagctatttatctttgtttttattgcatttgtttttgggttcttggtcatgaaatccttgcctaagccaatgtctagaaaggtttttccaatgttatcttctacaatatttatagtttcaggtcttaggtttaagtccttaatccatctttagttgatttttgtttaaggtgagagatgaggatccagtttcattttcctacatgtggctagccaattatcccaacaccatttattgaaaatgatgtcctttcccccagtttatgattttgtttgctttgttgaagatcagttggctgtaagtatttgggtttatttctgggttctctattctgttccattggtctgtgtgcctatttttataccagtaccatgctgttttggtgactatggctttatagtatagtttgaaatcaggtagtgtgatgcctctggatttgttctttttgcttagtcctggtttggctatgtgggctctgttttggttccacatgaattttagaattgttttttccaactctgtgaagaacgatggtggtattttgatggggattgcattgaatttgtagattgcttttggcagtatggtcattttcacaatattaattctacccatccatgagcatgggatgtgtttccatttgtttgtgtcatctatgacttctttcagcagtgttttgtagttttccttgaagaggcctttcgactctgtatcccaggggttttgataggctgtgtcattattgtcattcagttcaaagaatttttaaatttccatcttgattttgtttttgacccagtgctcattcaggagcagattacttaatttccatgtatttgcatggttttgaaggttccttttggagttgaattccagttttattccactatggcctgacagagtgcttgatataatttcaattttctaaatctattgaggctcattttgtggcctatcacatggtctatcttggagaaagttccatgctctgttgaatagaatgcagttgttggatgaaatgttctgtatatatctgttaagtccatttgttccaaggtatagtttaaatcctttgtttctttattgactttctgtcttgatgacctgtctagtgctgttagcrgagtattgaagtcctccactgctattgtgttgctgtytatctcatttcttaggtctaatagtaattgttttataaattttggagctccagtgttaggtgcatatatgtttaggattgtgatagcttcctgttgaacaaggtctttttaccattaatgtccctctttgtctcttctaactgctattgctttaaagtttgttttgtctaatataagaataactacccctgctcgcttttggtgtccattgcatgaaatgcctttttccacccctttactttaagtttatgtgaatccttatgtgttaggtgagtcttctgaaggcaacagagagttggttggyragttcttatccattctgtggttcttcttttaaatggagcatttagaccatttatattcaatattgtattgaaatgtgaggtcttcctcctcaggaacattgattattcttaggtttggtcatttaacataatcccagacttcttggaggctttgttcatattttattattcttttttctwkgtctttgttggattgtgttaatttgaagaccttgtcttcaagctctgaatttctttcttctgcttgttcaattctattgctgagactttccaaagcacctgacatttctaaaagtatgtccaaaatttcctgaatttttaaattatttttttctgtaagctatctatttccttgaatatttctccctttacttcttgtatcattttctggatacttttgcattgggcttctcctttctctggtccctccctgattagcttaataactaacctcctgaattctttttcaggtaaatccgggatttcttcttggtttggatccattgctggtgaactagtgtgattttttggggatactgaacagccttgttttgtcatattaccagggttgattgtctggctccttctcacttggataggctctgtcagagggaaggtctagggctgaaggctgttgttcagattcttttgtcccatggggtgttcccttgatgtagtacwcccccctttttcctgtggatgtggcttcctgtgagccaaactgcagtgattattgtctcttttctgggtctagccacccagtgagtctagccagctccaggctggtactggaggttgtctgcacagagtcctgtgatgtgaaccgtctgtgggtctctcagccatggataccagcacctgttccagtggaggtggaggagggtataatgkactccrtgagggtccttaacttcggtggtttaatgctctatttttgtgctggttggcctcctgccaggaggtggtgctttccagaaagcatcagctgtagtcatgtggaaagggactggtggtgggtggggccctagaactcccaagattaaatgccctttgtctttccctaccagggcgggtagggaaggaccataaggtgggggcggggctgggtgtgtctgagctcagactctccttgggcaggtcttgcttcagctgctgtgggggatgggggtgggattcctaggtcactggaattgtgtacctaggaggattatggctgcctctgttgagtcatacaggttgtcagggaagttggggaargctggcaatcacaggcctcacccagctcccacagaaaccgaagggtcggcctcactcccaccgtgcctcccccaacagcctcgagtctgtttcctggtggagggtgagatgggcttgaaaacttgcccaaggctttttcccttccagctgtggaagaaaagggcttcagttcttccccctgcatgtgaagtctgcacaccagattcatgctctccccyaggttctggtcaggaggcttcttgcccctttcaaattgttataaagttcagctagagaattccttctccctatggagttttacccccttctcctctggccaccctcctgatggatccctgtggtgtcaggcaggaatgggctgcttggggacccaacgagctcccaggacctttctgctgcttcctctacccttgtattttgctcggctcagctctctaacttgactcagcttgaggtaaagttggaaacttctcccaaaaacagaccttccgcttccccagtggtgatgtgtgtttggaagaggagggtccccctttcccacttccgcagttggggcactcacagtatttggggtgtctcctgtgtcctgcaggggcagtccgcttccttcagagggtctgcggctcctctcaggattgctggtttgttcttgcagttgatctgkagggttattcyccagctgagggtaagggtcagtggaccctgcaactctgcagttycacctctgccacccctgccgctaccgccaagccagtgacctcaggtaccttccctgccccacccacccagacgggtgccccttccttgccagcccaggtgcacccacctggccctaattttttttttattgtgctaaaaaatacatgttataactttgcattttaatcatgtttaagtatacagttcagtggtattaaagacatccgcattgttatgcaaccatcaccaccacccatctccagaaaagagttcttacaaaactaaaactctggacccattagatggtaactccccacttcccctcccccagtctctggtaatcatcattctactttttgtctctgtgaatctgacactctagataccctatatatttgcctacccccacttttttttttttttttttgagacacagtctcactctgtcacctaggctggagtacaatggcatgatcttggctccactgcaacctccaccttccgggttcaagagattctcctgtctcagtctcccgagtagctggaattacaggcacatgccaccacgcccagctaatttttgtattttttgtagagatggggtttcatcatgttggccaggctggtctcaaacttctggcctcaagtattcagcccgcctcagcttcccaaagtgctgggattacaggtgtgaggcaccatgcccggccatatttgtccttttgtgtctggcttatttcacttagcacgttttcaaggttcatccacgttgtgcatgtatcaaaattgctaatactattttaaatcatgttacacatatcattttcgctcattcataaatatcttactatgtgtctctaaaagataaagacgttttaacataaccacaataccaatgtcacacctaaaaataaacaattaaaaaataataggaaataaaaaaggtagtaattccttactaccatcaaatacccttccagtgttcaaattttgaattgcctcataaaagatagattctccaccgttcttgagtacagaattcctgtttaatttgtcctgacaaccttcctctccccatagtagctgtcttgcacacaaaagatgctgtcatactacatttcaccaataggtggcacgaataatcatgacatttgctaaatccagttggtatttacacaagaggaaacatcatttgcagaaagttggcaattataggtaaatatacaaacacagaaattgaaaatagcctgtttgctctatgtaacacgcataaaacctgaatacatcccaattctaagggataattattgatatcattcaaactttctatttgttttaaggagaacatggaaaacgtatttcttggtgttgacgtttatctctacaatgtcaacatttttagtgttaaataattgaggccagttatgtttatttattcttccgcttaataaaagaaaaagtaaatagaatctacttgtacaattgattgctgtgttaaatgcccgttacaaatgtattgtctgaattgtattaagtgtacttatctctgaataaaacagttgctttcccaaacttcctctagcgtgttctgaagaacagagaatcttaggatggtagatacggacagggcctttaagaccacctagtctggccccatcatctgacagatgaacagacatgaaacctcatcgtaagatcacacaacaccttgatggcttttgtgtaatttgttatctttctgccagcaatctcaccttctcccctccacccctactcttaaaaaactaactgcttggtaaaattaatatttcattttaaggatgcaaaacccaaattgtgcaattaatcctccctttcttgtcctttcaatwtaattaattaattaattaattaatttttttttttagatggagtctctctctgttgcccaggctggagtgcagtggtgcaatctcagctcactgcaacctccacctcctgagttcaagcgatkcttctgcctcaacctcctgagtagctgggaccacaggaacatgccacaacctctggctaatttttgtatttttttgtagtgacggggtttcatcatgttggccaggctggtctcgaagtcctgacctcaagtgatctgtccgtcttggcttcccaaagtgctgggattacaggcgtgagccaccgtgccctgcccctttgcatatatttagcaaatatttattgggtattaccaggactaaacaagatcttgttcccttggtcaactgagccttttatttgagtccatgtcttgtaatttcctagaaagaaatgaagctcggccaggcgcggtggctcaagcctgtaatcccagcactttgggaggccgaggtgggtggatcatgaggtcaggagatcgaggccatcctggctaacacagtgaaaccccgtctctactaaaaatataaaaatttagccgggcatagtggcgcgcgcctgtaatcccagctacttgggaggctgaggcaggagaatggtgtgaacccgggaggcggagcttgcagtgagccgagattgcgccactgcactctagcctgggcgacagagccagactccacctcaaaaaaaaaaaaaaagaaaagaaagaaagaaagaaagaaatgaagctaactttaggaaatcagcctgtaaggaatttctaatgggcagtaaatatgacgcttttcagcccagataacataataattctgagtcattttttatcctatcctcctatattcaaattaacatttaatactggactgttctttctgttcttaaaatcagctcctccagccaggacaggccctaaactctgctcttgaaagtaggttctcaccaratttatcccaagaacaacttccttttatcttccccagatgttccggaatatytgggctcttttccctgaaatggcacttcccacatgttggatacggccctttgccctttctcaggctgtgtctgcattcttctctcctcttttcaactaccaaaccctcgcctatacaactttatggcttcattgggcagttcatcccacctggtaaataagcacacattcacgtctgacgcatatgcttcacttccagtagtaccttccagtgtgttctttgagatattcataagtggggagatattccatagtcaaaaagtttgagaagcaattgtttaaacaaatttaaatagcttcctttactgcaggacttttcagagtctttgatttcaataggcatcrttggtcctttaagataggaagatagtactgtatggggcattttcaaaattgatttgattaaaaagcactaccccttgtcttactgtgctcaggctgcgattacaaaataccatagactgggtggcttaaacagcagacatttacttctcatggctctggaggctgggaagttcacggtcaagggccrgcagattgagttcctggagagggcactcctcctggcctgcagatggctgccatctcactgtgtgctcatgttctggagagtgacccagcccttgtctcttyctcttcttgtaagggcactaatcccaccacgggggccccaccctcatgacctcatgtaaacctaattatttcctgaagactccacctcaaatgccatcacattgrgggttacagcttcaacatatggatctgagggggacccargcctccagtacatgacactccttttgttttcctcattgcaccatctgctactgggttctgtggaatgcacatagggacacacaaactccagtgcaggctctgggtctgaaaacagacaacctgaactcaatcccagctccaccactccctagctgtgggacttgggtaagtttctcaatctccccaggcctgttttccagctggaaaacgaggataatagtacctacctcatagagttgttgtgaagacgaaatgcttctatacagggcaatacggggccacacaaaggaagcactaaaaaaaaaatgtcagctataatcatgaaatgtcagtatcaataattaactataattaaacaatctattatatcggttattaataaacatattatagtgaatgaaacttattatgtggcaatatttaatttattttgaggctgaatattgaattctatgaaaggatcatggtcaagcttctattttaggctcttagaggacaatatagcattgaaagaaaatcacaagagaagccatggcaagcatgagccaggaatcagaagcagtgtggctgggcttaaggaagaaggggccactgagctcagtgccaggactctgtgccaaccgccacagccctgacaggaagcagagctgttactctgcaaaggacagaccagccacacaaagagggaggcaggcctgcccatcctcccggctttgtgcagatagatttggactcgtggtagtgtcatctttgaatgtgcattgcagtttcacawccatacctacctcaccaaataatcctagaatagtgaacttcaacacaaatgtcccctgcaatttcaggggcttaagtggtccctttatgtaacaggcaaaggattagggccagctgggaaaatccaagtgtttaaaacctgttcagcacttttgcagccaaagagtaagttgccaaacattttyctctcaaaagaaaacaggccactgaatactagaaaggggaattctggaaggaaagaaaaaatcaaagaagagaagagaagtgaagggacatcttgggaaaagtaaaatgatgttgaacttaaaggtttaggacattgagaaggtaaacttgaacatttttctttaaaataaaaacacaacaaaaagagaaacaatacaagatgattttaaaaagcaaaccaaggggaaattttyacagtctattaatttctagatgtaataaaattaaaacacagattcttgcttaacagatcccaggagcattcagagttatggatcaggttcttcctgagagggaatctgaaggtcagtgtgtgacctgaggaaagcacctccttggagctgccaggcagccctcatctcccagcatgactatcctgccttctcactactgtttcattgaatcctccagggatccacaacgccaaactccagatcctcattcctttagatccttctccagcagcatcacagtaggaaacattccaaagagaatttcagtttccagtacaactacacacacaagatgtctatgggcaaaatattttatgggtgatatactcttttttcttttttctttttttgagacagggattgctctgttgcccaggctggagtgcagtggtgccatcacggctcagtgcagcctcaacctcctgggctcaggtaatcctcccacctcagcctcccgagtagctgggactacaggcacaagccaccacgcctggctgatttttgtatttttagtagagatggggtttcaccatgtttgccaggctggtctcaaactcctggccttaagtgatccacccatctcagcctctgaaaatgctgggattacaagcatgagccatcgtgcccrgcctattcctctcctttataatttttaaattgtgataaaattaaaatatgcacaacataaactttaccacattgaccatttttgagtgtatagctcaatagtgttaastacgttcacattgttgcacaagcaatttccagaacttttttatcttgcaaaactgaaactctgtacccattaaagaactcatttctgcctctgccactgccgggcaaccaccgttctattttctgtctctatgaatttgatgactcttgatacctcgtataagtggaatcgcacagaatttgtccttttgtgactggcttttcacttggcataatgtcttcaattttcatccatgttgtagcatgagtcagagcttccttgcttttcaagactgaataacattccatcgtatggatagrccacatcttgtttatccattaatccgtccatgccaggaatacgttttaagaagtccatgaaaatgcttggagttgtgtttaaaagagttttataagtcatgattggcagcaattattaagcacccttttctgattagccagcattgaaaagagacaggactggccaggcgcagtggcttacatctgtaatcccagcactttgaaaggctgaggcaggtgaatcacctgaggtcaggagttctagaccaccctagccaacatggtgaaaccccgtctctactaaaattacaaaaattagctaggcatggtggcaagcgcttgtaatcgcagctacttgggaggctgaggccggagaatcacttgaacccgggaggcagagtttgcagtgagccgagatcacgccactgcactccagcctgggcgacaagagtgaaactccatctcaaaaaaaagaaaagaaaatagacaggactaagtgatttggatctgcatgctgacaggcagatagacaggcaccggggcagactgagcgatccagacctgaccagccctgctgccagtggaggtggaaggttcccaggaaggcctgagagtctgggagggaaactgcctaagggggtgataaatggaatcagcagcrgagccccaacactgacccaggcactgacaaagcaagcctgacacgttgggaagggatttagcactagaaaaaagttcctttataccaagggtatccgatcttttggcttctctgggccacattggaagaattgtcttgggccacacataaaatacatgaacactaatgatacctgatgagcacaaagaaaaaaaataccacaagaaaatttcataatgttttaaggaagtttacaaatttgtgttgagcctcattcaaagccatccttggcccacaggcagcccataggccatgggttggacaagcttgctctatgttaaatgttcccacccacctaccaattcatgtagtctgcaaatacttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtctaaataagaatgggaagttagggaaagcatctctgggaagtacctatttagcctgaggcctcaatgcctcaaaggagttagtcgccatgcaatgatccaggaaggagagtgcgcctggcagagggaacagcaaatgccaagagtgagcctcaaatgggagacaactcactacatttgaggccagtgttggagtagagtgagggtggagtgggaggatgggagaggccagtttatgcacagcttgtagctgagtacagaaggatgtttcaggaatgtgtggaggaaggtaagggaggaggtctctggcaagtggaggaaggatgcacagaaagaagcaatgcttgttgaggaacaagaagcaattgctgtgagtagggtctggcatgagtgatgatcagtgaatgacaaagttggagaggtgggttggggcaagcctttgagacaccaataagaagctaatgaagggatttcaactttatccagctaaccaccagaaaccattaaaagtttttaattagagaagtgacctcattttcgttttaaaaataaacttgttgctgggatggatttgaatggaagggtgacacaattctcctgggaaacaaagaaaattgaactgagcaaaaggagtggaagaagcagagagggcgcggcatgtaagggataccatcgagggcagatcattttggtctttttaaaaaaattttttttaattcttaattttctttttttttcttttttacagagtmttactctgtcacccaggctggagtgyagtggcrtgatctcagccactgcaacctccacctcctgggtttaagcgattctcctgcctcggccttccaagtacctgggattacaagttcatgccaccacgcctcgctaatttttgtatttttagtagagacagggattcaccatgtggatcaggctgttcttgaactcctgacctcaactgatccacccgacttggcctcctgaagtgctgggattacaggcgtgagccaccacatccagcccattttttttgtttttagagatagagatctcactctgtctctcaggctggagtacagtggtgcggtcgtagctcactgcagctttgacctcctgggcacaagagaccttcctgcctcagcctcccaagtagctgggactacaggtgtgtgccaccatgcccagcttttcttggtcttgttgtaaactgacctttttatcattatgaaatgactctaatcatttctagtaattcttcttgtcttgatgtcttcattgtctgaagtcaatacagctaccccagccttcttgtgattggtgtttgcatgggtatctttttccatatttcactttgaacttgtctgtttctttatattgcaagtgcattctttataaacagcttataattgggtcttgcctattttatcttttaaaaaaatctagtctaataatctctgcctttatttgaaatgtttggtggtccatttacatttaatgtaatcactgatatagttgggttcaagtctacatcctgctggtggggggtttctatttgttccagctgctttttgttcttcttttctatcttctctgtttattgaataattgttaatatttcattctatctcctttattgatcttttagctatacttcttggcattttaaaatagttgttctagggattacaatttacacccttaacttatcagggtctactttgaattcatagcatctaatataagaattttacaatagttgtgttccatttataaccaccccagcccccacacccaatcctttaagctatagtattttacttccgcacatgttaaaagggatagattcacttggaagcttgttagattttaaaggtgagaaaaagaagtttagctgaactccaagcttcctgacttgggcatatagtctacaattcatctagaaaagaaatcaccagtctgggagtacaaatgagatcataattgcagtaacacttcgaatcttaatttttttgtcctcccacctgcttaattataggaagtctggccttacttgtgatttctcacctctcaaatgtctgagcagcctcagggagtggttgtacaaacctgtgaatcagcctagtcactccttctctagaaagttttccccacttcaactgttgccaggacgtttatggtgaggaacagcttgggagcatgttttttcttgttgttgtgttttgttttgttctgtgtgtttgttttttgagacagagtcccactctctcacccaagctagagtgcagtggcatgatctcagctcactgtaacctccacctcccaggttcatgcgattctcctgccttagcctcccgactagctgggattgcaggagcccgccaccacacctggctaatttttgtattttttagtacagacagggtctcaccatgttggccaggctggtcttgaacacctgacctcaagtgatccgcccgcctcagcctcccaaagtgctgggactacaggcatgagccactttgcccaaccggcagcawgttttaagtgagggggatgtgcactctcccgatgcattatgctcactcagtaaaaaggtcttcagcaaagatgtcctgtttctggagcatctatctcttctgatggacacatttgtatggatgaatgaaagggatrggagtaaaacttaaagtctcaacaggttcccagtggccacccaagcatactgttctaactgttggttggctctatcttgtggtagggttaaatttgctcaaatgcttcctgtgtaggtgaagagaaatggattcacagatggagtctgtcttgggcctgtattttggatatttgcccattggagatatttaatatatagctaaatattttgatctcaagacagaagccagaggtgaatatgtagattttcatagaggtgataatattaataaaagccacaagagtgaatgtgtttaccaaaggagaaaatgtaaagaaaaaaacattagagggtcaaacactaaaccatggaaagtggctaatattgagggttaaaaagtattgataaaaatacaggtacaatattcaaaagaatgcatttttatataaaaccaaagggaaggatgttatatcaagagctgtccataggttcctcaaaaaattaaaaataaaactaccgtatgatctagaaattccgcttctggttaaatactcaaaagaatggaaagcaagatctcaaagagatatttgtacacccatgtttatagcagcactgtttataaaaactgaaacatggaagaaacccaagtgtccgtgggtggatgaatggataaacaaaatgtcctatatacttacaatggaatattattcagccttaaaagggatgaaagttctgacccaagctacagcatacatgaatcttaaggatgtaatactaaatgaaataagtcagtcacaaagaaacaaatgctgtataattctacttatataaggcacttagtcaaaattatagtggcacaaagtagaatggtggctgctagggagaagggggagggagaaatggcgggctgttgttaatggtacagagtttcagttctgcaagttgaaaagagttctggggactggttgcacaaatgtgaatatacttaacactactgaactgtacacttcaaaatggttacaataataaattttatgttacctgtattttatcagaattttaaacattgaaatgaaaaggagtagtcatggatactacatggaattacaggaaaatgcacaccttaaaatatttcctggatttggtcattgaaaagagtttgaagtagagattgtcgataaagccagccaagcaagcaaatatcatcactgaagaagtatgacaattgaaccagaaagaggactacagtgaggtgaatagtgtaagttacagaagactatatatgggcatatttatggacaggaaaacaggaatattctcttctgtctgcctacattttttacttctgcaagaaacattaagtcctctgcaagaaacattaatcacatttactaaaatatgagatgacatttacatattccttaattttttattttattttattttatttttttgagacagagtctcactctgtcacccaggtggagtgcagtggcctgatctcagctcactacaacctccacctcccaggttcaagccattctcctgcctcagcctcctgagtagctggaattacaagcatgtgccaccacgcccagctaatttttatatttttagtagagacagggtttcaccacgttggtcaggctggtctagaactcctgacctcaggtgatctgcctgcctcagcctcccaaagtgctgggattacaagcatgagccaccacgcctggcaattttaaaatattttttaatatttttatttttcctttttatagggatatgatctcactatgttgcccgggatggtctcaaactcctgagctcaagtgatccccccacctcagcctcccaaagtgctgggattacaggcataagccatcacactggccagctttgcatatttttaaaaagcattcattttgattatctgcgtaagtcactgttgattattacactggaaattctcactaatttcaagaagtagaaggagacgtcagattaaaggtggtgaaatttaccttgagctttaaccctgctcttcccccaactcaagaacgtttaactattgaaggtggcagggaattagggtaatagccaaaattcacaaatggatcaaaggaatattttttgccagtagagaaactttggtgttttcaaaggcaaatacatctttctgtattcattcttaattcccatgaaaaggtgtgttccttgggataattctaacactatgttgagactgcaagtccatgtgataggatggtatcaggttctgagcgtccacagggagaaaacaaggaatttcctaactaaaaatataaaatcagatctggttctctctctctggaaatttagcagaacccactcatttttaaaggcaggtattgttgcagccccattgtttacccattgctcaaatgcagagagccacattccagggatgtcttacaatgggcacatggggacttgaagtcgttggctgactcactttcttcagtgcacagctctgagctctcattcgtataaggactatggtctttggaagttgattttggtttcagcccaggccaagtccctttgtgccttatctgaagggtatttttggctccagggtggttgttggcagacagtgaagcaaatacaactcaaagctctcatctctgtcgaatcactgccataacaggtaaaatgaactaaggaggcagtgggcaaagcagatgtttacaaagtgagggctaatgcttgaataaacataaaatagacacatttgtaatttggcttgtgccaagacccttccctttctttttttttttttttttttttttgagacggagtctcgctctgtcgtccaggctggagtgcaatggtgcaatctcggctcactgcaacctctgcctcccaggttccagtgattctcttgcctcagcctcccaagtatctgggattacaggtgcctgccaccacgcccagctagttgagatggggtttcaccaggttggccaggctggtcttgaactcctgacctctggtgatccacctgcctcgacctcccaaagtgctgggattacaggcgtgagccattgcgcctggctcctttctgtcttcaaaggagaactaattaatccttgatagggtagggttagggaattcaacctcactgcttaatgccccaccttaggaatgtctgcagctgctgatgctagtgtgtgtgtgtgcctgtgtgtgtgtgtcacatgggatggactggtggagagatgttctcatcagccctgtctacacgagagccctgccaaacagctgaaatttaatttccatcccttcccatgagtcccttctgctacagcagccttctctttccaaacagacactgaactatgatggagttttcttaaggacagtcaggcagatctcaaaagaacagccagtcagtgcaggaagaacaaatgtgtaattccgcccttgaagacgcaggcatccaaaaggaaaggtatctccatggatgtttatctctccttctgatctttttcatgccctctactgcctctcttctcaagagactcccctctgcctccctctgggagaagttctgccacctcagacccacctggtgtctgcaaaccccagagattcaagcctcaggccctcactgatggtggcccttctctgctcaaggtggacccgttcctgtcagtcaggacaacagttggtgaaccaagtatggtttggtctctccatcaacactgtctgatttctttactattttatccaacttggtgagagttgtagtctagggtccatcagccttctgagaagactaaaattctctttctcctcaaaaggaaggggagggaagaggagggttgccaccccacaaactcctaaaagtgacctaccttcttttgcccagttcagcactcacaccgatgcatgggggaggggtttgggggcagtaaagctcccaaaatagagtttctcagcaggccacgaggaattggggccgggctgaacatagaaccctgggtatttagatccttgttttctcactgtggtccttggatgataccatcctgtcacatggacttacaaagtctcaacatagtgttaaaattatcccaatcagcacaacttttcatggaaattaagaataaatatagaaagatatacttgcctttgaaaacatccaagtttctcctttgagaaaaaaatattcctttgatcgatttgtgaattttggctattatcctaatttcctaccatcttcaacagataaacatttttgagttgggggaagagtagggttaaggctcgggtaaattctaccagctttattctgatgtctccttctacatctataaagartatggtataatgagaagcatgtggtcttgtgaagtaataaaccagggtttgaatcccacatcacccactaagaaggcatgacttcatgtatgttatttgaacctctgagtttcaactcctttgttggtaattattttttgtttttattctgaaggacataaacctatttcctagagtgattataaagacgatgtggggtcaggtgcggtgtttcactcctatgtaatcccagcaccttgggaggctgagtcaggaggatcacttaagcccaggagttcaagacgcccctgggcaacatagtgacacctgcaaaaaaaaaaatttttttttttttgagacagagttctgctcttgttgcccagcctggagtgcaatggtgcaatcttggttaaccacaacctctgcctcctgggttcaagcgattctcctgcctcagcctcctgagtagctgggattacaggcatgcaccaccacgcctggctaattttgtacttttagtaaagatgaggtttctccatgttggttagagtggtcttgaactcccaacctcaagtgatccacctgcctcggcytcccaaagtgctgggattacaggtgtgagccaccaagcctggccaaaaaactttttttaaatagccagatgtggtgtcgtatgccggtggtcccagctactagggaggctgaggtgaaaggatcacttgagcccaggaggtggaggctgcagtgagccatgattgtaccactgcactccagcctgggtgacagagcatgaccctgtcttaaaaataaataaataaaataaataaaaaataaagatgacataaaattatgtatgtaaagcatctggcacaccctgaactaacatatattcattagcttcctctcccacaccctatccttctatgccattcattgcattccctaaaactacctaatataaggtcaccattaacattcttgtggccaggtccagcagcctcttcctgactcctcttctctgcattagtgttgataaggccacctgtctaagaatgtttcatctttgtctttcatgctcttacattttagagtcacagaatacggccaagtacatattactccctgctttgcattattttctgtatcatatgtacccctgtattctcaagctaactatcccagctacagggaaaatcaagtccaggacaaaccattgtccaaayatacatcaagcatcaattaagtgctagtaaaaagggacacaaggtcaaagaggacatggttcttgccatgaggtaaggaaggcggacaaccgcccaactgtatgaccagaactgggattgaaatggatacagtcaccatagaagcagagaggagtgaggggaagagggagcgatatctggatcattctggacatcatgggagacttccttttcgaggtgattgttaactgaatcctgaaggatgagtaggaattaggtaagtaatgaagtagttggaggagccgggtagtctggtgggttccaggctgaagcacaaagagctggtggctatggaggattcatgagcaatgggactgaggaactagatgagcgttktttcataaggccttgtgggttgacaagaagagtctgaactttatctgaaaattctagaaaactttgaggaaacccctgttggtttgacatgatcagctgtgtgctttatccatgtgagtctaatatggggcagagactggaggatggtgaggctgaagatgtccactgcctagatgattaggcagtttttgtggaactcaaggaaaaagggatgagaacttgatgtaaggcagtaacagaagcagttgggaacagatactaaagatattaagctgactggtcagacatgggagatgaaagagatagagaaactagagatgactcccaagtttctgttttggataactacttagacaataactaaggtttgtaatgtaggagaaaaggcaagttttggaataagagactgtgaatatggtattggactgctaggtctgtttacaatggcaagtgtatgaagaccagcccctccctgtggccataaagatggacctatgcactttaacaggaaattggctgggggtcaggtctgacatcgaggaaaattgagcataatgagatcacccctgaaattccttaattcagaggtgagtggcagcwgtacctgcaggcagtgcgaaaattcattaaagaattgttttggatctgctccagtgaacagaaacaagtgactgggtgacatagcaaagcaacaataattttagcttcataaaaatgttaggtgtcagaccgaatataagcagatttttaacatcttaagtcagcactcatatagtaagagcactaagcaactctgcttttccctacggtgattccagtcccctctggactcatctctttcccatgaattcctaggtgactcactcgctcttcttgatggtcattggtggtttcctgccaccatcgtctttgtctctacctccgactccttacttgtttcttctgccccactcccagagatctcctttctcttcctctcacacagctgccacaatagcaccctgactgtaaaatgcacagcttccaggtgtgctggtaaacatttaaaaggtggtgggtaggataggcatggggagctgatttgtagcatttgtcattttctgtggtgtaaatactcccaacttggctgattctaaactaccaaaactaccaatgtgttgtcattcacttccccarattgcaacgggaaagctctcttgagcttttgcaagcaagttccagcacaccacagcttctgagactgagatgagtcacatttaatgtggtggtgttccttccctttccccagagggacaccctggaatgatagcgagagtctggcytccagtgaagaacacttgacaagggagaaaatctggacatttctgcctttgagttttgcttaggccaatcttgcaattctccctcaatccacgtggtcaccatcttcccacctaaagagcactcacctcctttgagaagcctgtgcttgtcctgacccctctgagcacactttaaagtttatgaattcattccttcctttgccatttccagaaggtctttgtattttgcacaaggactctagytctttgtgctggcatcaattaragactgtttgttttctgttttcccgggttaatggtaaatgttttaagggtaaagatcttatctttacatagcattgatttttgaacatttgattacttgcttatttattaagcctttgctcatttgccttaccataatcttttctataccttcatgtttgaattgtttttatggcttaagtatatacatataatatgtatacataattatataaaatatgtatattctcttttatacactatgaaaacaattcttggaagcacataaaatgtctttgcacaataaagaaatattttaatattgataattcataaattatattgctaggaaattaagtgaaaatttgttggagtgagtctccaatgaaccagtaagtctccaataaaccagytggaaacttactccattactgactaccttgctatgtgagacaagttattcaggcctcagtcctccaagtataaaacaaaggtactaagaaaatgttcagggtgttggaaacgctctgtcagccaaamaaatgtaaagctcctgaaatctaatataaaagtactctatgaatatgatgtatttgtcaggcataagaattttctagaaaataaaacatttcatgacagggatcattktttaaagctcaagaattcttggaacatctacagaattrggatttgacaaccagtttttcaagaacttggtccaattttttcatacatctgaaagtcagtcaactgtaagaactcaaaatagcaaggagtaaagtgagatactgtaaatacagattagtatcatttatccaagccattgtgggattttctttaggtgaaaaagcaaaacctatgatagaatggcagagaacaaaaaaggaaagagaaaaaaaccctaaatccttgttctgttagtaaacaaacataggtttgaaagtcctaaaacaaggaagactttcaaacctatgtttgtttattaacagaacaagtgttgagaaacttgagtgatgtgaaggaaactggtttcatacaaaagtgtttctttgtgaaagagttttctgcagtaggcagaggtgagagaaagaagaggagaggaagcttctcctttggtgtttcagacctaggccaatgataaaagtaggaaaagtcatcttagacaaagattctctctcctttttttttttggtttttgtttgtttgtgttctgtttgtatatctgtttttgatgttaatatgagcaatgtgtttgaccaacaaggctaagaccaatgatagaactaggaaaagtcatcttaggcaaagattctctctcctttttttttttttttttttttggtttttgtttgtttgtgttctgtttgtatatcttttttttctgactttttttctctttttattattattattattgtactttaagttttagggtacatgtgcacaatgtgcaggttagttacatttgtatacatgtgccatgttggtgtgctgcacccattaactcatcatttaacattaggtatatctcctaatgctatcccccccctctccccccaccccacaacagtccccagagtttttgatgttaatatgagcaatgtgtttgaccaacaaggctaagaccaatgatataactaggaaaagtcatctcagacaaagatcgtctctcctttttttttggtttttgtttgtttgtgttctgtttgtatatctgtttttgatgttaatatgagcaatgtgtttgaccaacaaggctaagaccaatgatagatctaggaaaagtcatctcagacaaagatcgtctctcctttttttttggtttttgtttgtttgtgttctgtttgtatatctgtttttgatgttaatatgagcaatgtgtttgaccaacaaggctaggaccaatgatataactaagaaaagtcatcttagataaagattctctctccttttttgttgtttttggtttgtttgttttgggtttgtgtatctgttttcgatgtaaatgtgagcaatgtgttttgccaacaagtctaggaagggagagattggagaatagggggatagcgagtgttttaacttcccttgagggagatgatttcacccaaggactgtatcttagtttgtgccacacaggatgctgtcctgggaatttcccaggggcccagagcagtatcagctgcagccctgtgccatgtcccccagtcacctggtactgtctcctctctgccacctccaccacgctggccatgctttcaatcaggctagagcactgcacttgtgtgtccaggcttacaaccctataggcttccttaggaaaatagactgaacctgattagggaaaaatcagcttttcacccacagaaagtgccaggttttgacttttgttttcaccaatacctggcacacagtaagagttttattttatttttatttatttattttgagacagggtctctctctgttgcccgggctggagtccagtggcacaatcttgactcactgcagcctcaacctgctgggcacaagtgatcctcccacctcagcctcctgagtagctgggaccacaggagcatgccaccacacccagctaatttttaagttttttgtggagcacagagtcttactatattgctgcccaggttggtcttgatctcctgggcttaagcgatcctcccacttccgcctcacaaagtgctaggattacaggcatgagccaacatgcccagtccaataaatgttttattagcttgaatttggaactttcctaccattgtagaatggcccttagaatccatagtcaagagcattatttattatttactatttacatatcccctgtctggcaggcactgtgctgggcaggaggcactgtgatgaagaagaaattttatagtttacataacaaggggcagaatgtgttctatgctaaagataaacttattttccaattaacataatgactaaaaatcatctcactagaggggtttaaactataaattccttccatgtcatattgtatgacacccctctaacaaacgcttccagccctttcttctttcacacccttcttgctcaacatcctctctccttcttggcttctaggtgttaaaagcagtaaaatagagctttttccctgaaataaaaaattatttttttaaacttagagaaactgagaaaatgaaaaggctgtaaaagggaagactcatgtatacagaatgagctcttatcattcattcatagatacatattggatatattctacattgataagcattggactagggttgagatagaccttttctcatggaattttcattgtaatctctgtctataaaatctgtgtctatagagataaacacaaaaacaagtgtagaaacacatatataatctgacagcttttcatgggtgccttaaaggaaataagcagtgctatatgatagacaatcatgcagtgaagagctggagccagcttgcatcagctctcaataactgattgttatgcttcagaactcttccagcctattaccaggcatggtggctcatgcctataatcccagcaatttaggaggccaagacgggaggatggcttaagctcaggaattcaagaccagcctgggcaacacagagaaacctcatctttacaaaaaattaaaaaattagccaggcatggtggtgcatgcctgtaatcccagctacttctggaggctgacgcaggaggatggcttgagcctgggaggtggaggttacagtgagctgtgattacaccactgcactccagcctgggtgacagaggaagaccctgtctcagaaaagaaaaaaggaaagagaaaaaaccttccagcctattgacttcagactgatagctagaaattagctgtggtaggagaatttacaccacagaaataagcaaacgttaacaatcagggattcccccacctaccccacccaccccaccctcaggagccagttgctaaatgtttaccagcaaacaaccaataatggtgggtagaggaattgggctaccttttatgtagagggtgggtgataccctttctatggagataatatttaaacagaccccaaggtttgagaagagaggagtaaaagtgtttcagacaaaaggatccctaagtgcaaagtcattaaggcaggtagcctcaagggtcttctagcacttgtcagcaggtgagagtagccgatgatggggatgaaagccagatgaggtctggatcagggaacatggggctttgtgggtcaaggtcatgcatttaggtgtttagttaagagaaatggaaagccctttaaggggttgaagcaggtaggggtgtgtgtgacatgatttgctttataagttaagaggctcactctggttaccaagtaggagatgaattttaaggtgacaagggcaagcatggaagccattgcagtatctcagttgtgagatgatgtcccgcagacttgcatggagatggcgctgaagatggtaaagaggagacagatttgagatacactatggaaggtgaacttgcaggagacttggctgcaacttgcaatcattattmgatggggtcttgctatgttgaccaacctggagtacagtgactattcacagacttgatcatagcacactatagccttgaactgctgggctcaagcaatcctcctatcttagcctcctgaggagctgggactagaggcactcaacccactgcacctggctaattacgtttgttgttgttgttgttgttgttgttgttttttgagacagagtctcattctctcacccacgatggagtgcagtggtacgatctcagctcactgcaacctccacttcctgggttcaagcgattctcatgcctcagactcctgagcagctgaaattacatgcgtgcaccaccatgcccggctaattttttgtatttttagtagagacggggttttgccatgttggccaggctggtcttgaattcctgacctcaaatgatctgcctgcgttggccttaattactattatttttaagacagaaagatgttacactcaagaacagaatggactgccttttgtggcatgaatgtaagtctttcctacaggtccttccccactgtatgaagtgaggctctgagtcaggggccctaaccaagagaaactgtggtcactgaaaagtcttggattcacctcagagctcaccttctctctgtgccatcatacagctaactacctcttgattagatgcatgggggaggcggctgacatagttccagcttggtttgcttgatgatggcttgtagaacgcgagcccagaggaaggcgcttgactggtttgggaacagagagtttctttctagtcctctgctgaccttctgcctacttggctccaaactgacaggcaggtrgatcacttgaggtcagcagtttgagaccagcctggccaacatggtgaaaccccatctctactaaaaatacaaaaatgagctgggcgtgatggagcatgcctgtaatcccagctactcaggaggctgaggcaggagaattgawygaaccccrgaggcggaggttgcagtgagctgagattataccactgcactccagcctgggtgattgagcaagactctgtctccaagaaaaaaagaaaaaaaaaaaagatctcctttataatttcaaaattacatgtgctaaaatatttaagtaaataattgctatgaatacaaatgtatacaaatgaaatagtaggaaggaactccagcttcayagtaatagaatatttctcatctgtatcggttgrccagtagcccagaagtttgtacagtatcatgacattacatcctacaccttcaggcagattaaatagtattataaaatataagaaacagcattgaagtccaactctttgagaattttgaagctcatagcttgaggcagaatggatccacagagaccragcagcatattatggtttgtattgactggaggatttggattcagactaaaagacaacttcaaatgaatggctgtgttttgagagcacattgctttgtgaatgctttcaagctttttctattttaacttcctctgaaatccaagaggataatgtttttaccaaaaatatttacaaggaaatgggaaatttaaatgatccccaaaggaaaccaatttttaaaaacccttaaaghcctattattaggcaaacaaagattatacagagatccttctcctgctgcaagtctcaaggacttcttcrgggcagcagtgaaacctgtcaggcagctatggaaaaggctttggatctctgygtgtgcacagaagggcacggaggggaatctcatcttcttaagatcttcatcyttaatataagtttctgaattctttgctctataaaccaaaaatttaatcagaatgtgtgtgggaggggagagtgtctcctacatccaggcgtatgagatgatctgaaaaccatgggcaatatttacccatacagaccattgtgatgaagccattctctaagttaatagattctctccttccttccttccttccttccttccttccttccttccttccttccttcctccctccctctctcccttttttctttctctctccctttttcattctttctctttccttccctgtcctcctccctccygccctccctctcttcctttctctytctttctctcccttcctcccttctttccttctttccatctctttctgttttttcattcttaaatttttctctttcctaacttccttccctctctcctttcttctttcttcctgacttccatggccatttactgagcccttgcttaggagctggcgatacagacaaataagtcggggcagccattgcccttggggagctcttcccacagacaaacaatgggagtgtgttggggtagacaccccccgmacctagggatccggtggtgggagaagggtgcaatccargaaggaaagttgatgtttgaattraatattaaaagctaaacaaaagcttagttccaaagggaactaagacactgtagtcccaaacaatgaaactggcttgagtcaaggatatggatacacttcmtattcttcagaaaattgtcaatgatgattgtatcttgacatcacactttaaaacatgcagggagaatttcctgacaagattctgaagtatagacactctgtcttaccaattgagagactgaggtcgggcgcggtggctcatgcctctaatcccagcactttgggaggctgaggcgggtggatcacctgaggtcaggagtttgagaccagcctggtcaacatggtgaaaccccatctactaaaaatgcaaaaattagccrggcgtggtggcrggtgcctgtaatcccagctactcaggagggtaaggcaggagaatcacttgaacccaggaggcagaggttgcagtgagctgagatygcgccattgcactccagctggacaacaagagcaaaactccmcctcaaaaaaaaaaaaaaaaaaaaagagagattgagcatatgtttgataatcaaygaacagtccattttaaaagttagacaggacatattcctgaagccagcctttcagggttcaaattctttttcttccattttatagtgattaagaagtctgggacaagcaacttaacatttcttggctttgattttctcacctgaaaaatggtgataattacattacctgccatagggttgtgaggttagaatgagtgaatgcgtgtaaagtgattagaagcatgcctagcacatagttagcactcagtgtttagtcgytattcttttttattatcatgtcctcacagagaatctttataggcagggccaagatgttactcaaactgttttgggtccacttcaagaaacctagaaaaaytgatgatctaagtcacaaagttctgttatagatcatatccacaattatttacatgagaacatttgcaaaacctggatttaccaactgcagtcattaagaaaaaaaatctatacataaaaatgtctgattttaggccaggtgtggtggttcacgcctgtaatcccagcactttgggaggtggaggaaggtggattgcttgaggtcaggagttcaagacgagcctggccaacatggtgaaaccccatctctactaaaaatacaaaaattagctgggcatggtggtggcgcatgcctgtaattccagctattcaggaggttgagacacaaaaattgcttgaacctgggaaacggaggttgcagtgagccaagattgcaccaytgcactccagcctgagtgacagaaygagactgtctcaaaaaaaaawaaataaataaatataaaagaagtctaattttagaaagttcaacttcctgatractgctctaagacagagtggttgcaacatggaccctaggtaactcaatgatgtgatcagcgctatagaatattggctgatgttggtcacaaaagtattttggtttagagtgtgatcttgtgtcatctttctgacaataattaaataactgaatcaattgttgaggcctccatgagtatgtgacaggtatcggtagagccatgtgaccttgagtaaattgcttaatctctctgcacctcagtgtcctgtaggagagctgttctggggtatcaaagagcacaacayacatcaggtatttagtgtagtgtcaggcacatcatacaagttcattagagcttrgtgtattagttaagaattgaatttacttgcagatatagaaaacacaggtaacagtggcttaaagatctgggctttttctgtcaccaaacaagaagtgtgaaggttggtgaccctgagctsgaccagagacctaaacaagcagatggatgcaaggtctctgtgactctctgggcctttctctcatgtctggtmacaaaagggctgccgcygccattgcatccatgcttgctgctttaggcaggaacatacaaatctgaggtctgttcattttaacagaaaattggaaagaattggtatggaagtgttagctacagttagctagaagttatacagcagttgatcaacctagatcttcataatagccctggaggtaggaatgggaggtattatttctattttacagatgtagaaacmttggccagagaggtgaagaaattttcacaatgccatacaagtagtcagtaagtggcagacacaaatttctaactcagtccttgttcaagctattagttcctaactcttaacagtrcaccaagctgccacagggcaagtctttgctgtagactcaaggatgagtttyaagacaacaaataaaagcattaatggaagtcagtatcattaaatctaaatttaaataatgtgctctaacatactgggagcatctctgggtctaggtaaagaggaaagggagaggaaagcttaacaacataagaagtaaatgagattcagacatgaaaatcatccatggaaatcayccaygaaaatcagatatgaaaagcgtatgaaaatctaaagtgcaaagaaagagttgctcatgcaatcaaaactttctgtttttctttacaatgtttggggaatatagtgtgtgtgtgtgcacgtgcgtacgcgtgcatgtgtgtgtgtttgttcagatgaacatgcgtatgcctgtgctctagtgagtgcattcacacscatgataatagaccccaccatattaaccctaaccctaaacctaatcagaactaataccagattaatctttctaggttattaataaaggctcttggtctacgtagattgattttaagcaaaacttccatattaaaataggtttctttttcatatacatatacatttgatatgatttaagacattctgcatagagatctcaaatatttattttaaattttatttctagttattcactatttttagatggaaaaaagttcccatttatttatttatttatttagagatggagtttcactcttgttgcccaggctggagtgcaatggcacagtcttggctcactgcaacctctgcctcctgggttcaagcaatcctcctgcctcagcctccccagtrgctgggattacaggtgccggcttccatgccctgctaattttgtatttttattagagatgggatttcaccatgttggtcaggctggtctcaaactcctgacctccggtgatccacccgcctcagcctcctaaagtgctggaattacaggcatgagttacagcgcctggacaagttcatgttttaaattgtttggatgagggcrggcgtggtggctcacacctgtaatcccagcacattgaaaggcagaggcaggtggatcatgaggtcaggagaccaagaccatcctcgccaacatagtgaaccccatctttactaaaaatacaaaaattagctgggcgtagtggcatgcgcctgtagtcccagctagttaggaggctgaggcaggagaatcgcggagactgcagtgagccgagatcacaccaatgcactccagcctgggcgacagagcgagactcctcaaaaaaaaaaaacagcaaaattgttggatgcatatacatagaaattcaattaatttttatatgttggctttggatttagcaaacttgctaaactctcatattaatactaataatttttctgtagattctcttggattttgtatacatacaatcatataaaatttgtgagtgacaataatttcatttcttccttcccagttcttataccatttgtttctttttcttgcctacaacactggctaggccacagtacaatttgaaaagaagtgacaatagtatgcatccttgttttgttcctgatttcaaaagaaaaactttcaatgttttatcaataagtataaggtttgctttggggatgtgtatctactttcatcagattcatagagttcctctctattccttttttgataagatttttataaatcatgagtgggagtcaaattttattcaatgcttttttgacatctattgggatggtcatattatttctctcttttaatctgttactgtgatgaattacattggttgattttctaatattaaaccaaactctgcgatgtcaaataaaaccagcctgataattatgttatcctttttatatattactggaataagtttgctaacacttcatttataattttgcatctatattcatgaatgacaattacacactgtaattttcctttcttttataatgtgtttattaggattttgtatcaaaatataccagcttcatattctcaggaagaatttgtataagattgatgttatttcttctttaaatatttggtagttcttaccagtaaacccatctggacctagaggttttgttttttgtttttaatggaaaagatttaaattgcctctctcagttatgaattgttataggactatttcatttttctatttcttcttgtgttcattttggtatgttgtaatttggtgaagagatttgttcatttttttctaaatttttatatttattgaccttaagtaattcatgaatcttgtttctttctttaatgactgcaggatctacactgatgcctcctttttctttcatgataccatttgtttgtgctgcttcttttctttttctttttttactcagtctcaccagaagtttgtctaatgtcttcaaagaaacaacttttagctttcttgatgttctctgtttcctgtttcatgaaggcttgctttactatttctttggttttaatttgctattctttttctgtttrtttgagatcatgcttgggtgatgaattctcattcttcttttttaaaatacattttatggttataactttcctctaaatactgcttcacttgcattccacaagttttaatgtcttgtatttctattatcattcagtataaaatttattctaaattttataatttcttttttgacaactgatttttataacttttcaaatatgtaggatttctattacatttttcttataaatgtctagcttgattttattgcagtcagaaaacatactctgattccaactcattgaaatttattgagatttgtttgtgacctagcttacaaagtaaatgttccatggatgcttgattcaaaatgtgattcttgggtgatgtatagccatccagaaggtaragattgctggtagtgtttctcaagccttatatatctttactgattttttagattgtacactaaaaccccccattatggttgtagatttatctatctcctgtagtacttatgtcaatttcactttattttttgaggcaattttattaagtatatactaatttagaatttttatatattactaatgaattgggtttttttacatcattaaaagtgactctctttaactgtgtgatgatgytttttgccctaagtagtttgtctaatattaatagacatcagtcttattttaggtagcattcacattatatatctttttcattttttatctatcaacttttctttatcttcatgtttttgttttgtctcttgggttttgttttttattttttattcagcctgaaaatctttgactttagttctttgcccttaggaacatttagttcatttacatctaatatatttatgataataatttgtatttaagtttactatgttttcaccctctttttgtcccatacattttatactccttttccactcctttctttccgtcttttgtattaatttgcttattattctatctttttttgttaatttataatttatactcttttactagtctcttagttgttcccctagagtacaactgacttattgattctaatgctatatggtattatcactctcactctgaaccaaaataaaatctcagaacactttaatttcatttactctcagcttgacctatatrcaattcttgtaattttaattctatatgtattttaaaccacataaggaattgttactgttgcttaatgttattatcatccgtttaagtttactcacacatttgctattttcattgtccttcctgcctcttcaattttacttgtgggattattttcttttacctgaaaagatcaggtaaatatttgccgtttatttcctttgwtgtagatctactgatagccaattatctcaacgttcatttgtctgcaaatwttttttcattttatatgcgttcttcttttttagagatagggtctcactacatggcccagactgttttcagactcatggccttaagtgattctcctgcctcagcctcctgagtagctgagattacaggagcaagccaccaatgccyggcttatttacatttttgaaagatatgttacggcatgatttmttgactttggcacgctttatatttttggccagataactgttgttggggctgtcttgtgcattgtaggacattwagcagtttccttgacctctacacatgagatgaccgtatcacttccyttctcagttgtgtcaactaacagtatctcctggggagcaaaattaccttggttgggaacaactggtctactgaatatagaattctaatttcatttaacatatttaagatataatttcattgtcctctggctttcactattaccattgaaaagtaagctatatgtccwacrtttggtcttaggtactttgactggctttttttttttttttgagacagagtctcactctgctttgactggcttttaacatttttatctctgattttggtattctgtagcatcacaatgatggctatagttgtgaatttttctttatttrgtttggaatttgttgggcttcttgagtctatgaatgaggcctttcacacgttttgaaaagcagccattaactctgtttttctatttaattattttgagatatacgtcacataaaatttaccactttaaagtgttattagtcagtggcttttagtatattactatgttgtgcaaccaacatcatggaattgtgtaatatgtggtctttgcgtccgggttctttcaactaatataatgctttcaaaagtcattcatgttgtagcatgtaatttcattcccttttckgttaaatgatattccattgtatggaaataccacatgttgtttatccattcttcagtttatagaaatttaggttatttccacstttgggctattgtgaataatactgctaagaacattcatatacaagtttttgtgtgaacatacattttcaattaccttggatatataccaagaagataataattgctgagtcatatagtaattctaggtttaactttttgagaacctgccagactcttttccrcagcggctgcatcattttacattttcaccagcaatgtatgagggttctaatttctccaagctctcaccaacatttgttattttgtactcttttattttttattttatttatttatttttatttttttttttgagacagagtttcactcttgttgcccaggctggagtgcaatggcgagatctcggctcaacacaacctccaccccccgggttcaagcaattctcctgcctcggcctcctgagtagctgggattacaggcatgtgccacaacgccctgctaattttgtatttttagtagagacggggtttctccatgttggtcaggctggtctcgaactcccgacctcaggtgattgcccgcctcggcctcccaaagtgctgggattacaggcatgagccaccactcctggcctatttgtactcttttaaattaaagctatcttagtrtgtttgaaatggtaactcattattattttgatttgcattttcctaatgactaatgatgttgaacatcttttcatatgtttattggctatttacatatcttctttggagaaatgtctattcaagtcctttgtccattactaaattgggttatttgggtttttattattgagttgtaagagttcttgatatattctggacactagatccttatcatatttgcaaatatctttttcccattctgtgggttgtctactaaccccaaatgacatgtaagtgagtaacaaataaatcttcattgttttttctttttgtttttgtgagacagagtcttgctctatcgcccaggctggagtacagtggcgtaatcgtggctcactgcaacctccacctcctggttcaagctgttttcatgccttagcctccaaagtagctgggattacaggcgtgcaccaccgcgcccagctgatttttgtatttttagtagagaccaggttttgccatattggccaagctggccttgaactcctggcctcaagtgatccacccacctcagcctcccagagtgctgggattacagggatgagctaccatgcccagcccaactttcactgttgtaagccaccgagattctagggctgttattgactgcagaataaccttattaaaattgactaaacaacttgcatctagctttgtgcrcctgtactttcccatgcagtgaggatttctcctcactgattctgggtctataaatcctcttatttggatgttggatctcctggatcgttcttctatattccttgtctttctcttctactttctaagtctcaatgttttcgcacttctctctggaagatattgttaactttgtcttctaaaccttccattgtgtttttatctcaactatggtttttttaatttccgagagagtgtttgtgtgcattctccgaatgttctttagctgtkcttatctcatggatgcaatattttcttttatttctgtgaaaatattaattataattgttagattttttttctccccatctaacgttttctccatgttagttgttacaagttactttgtttgttcatttgacttccctgttggaaatttcttcaactgtctgccagtcagttcttcagcatgggaatttaagaattcattagaagctctgagactgtagacggacttgtccactgagaagctcacagtggacatttgtaatgagccattttactagggaaacttcaatgtcagtayctttaagttgttccttatgaaactgtccattctctagagatggatctcacagtcagtctcttgtatacggagtttaggcctggctgccaatgttttgtgttttgagaaccaaatgtagaaaaatggcaagaagggaccagcctggacaacatggtgaaactccgtctctattaaaaatacaaaaattagacaggcatgatggtgggcacctggaatcacagctactcgggaggctgaggcaggagaatcacttgaaccgggaggtggaggttgcagtgaaccaatgttgcgtcactgcactccagcctgggcaataagagtgaaattccatctcaaataaatwaataaataaataaataaataaataaataaataaacatggcgagaaggaaaggagagctgtcttagcatttagtgtaaaatttttagttaatcacactgttttaataatgaaactcccttcttcatttggaacaggtgtcccctagttcaacaaccaaaatttcatccaccccagagagtatacttccagctttctgttcaggtgaggagggaggatttgcccccattgaacagagctgagtatgaaatatgagtgtcaaacttctaattggactttcaacaaatcctcctgttttagacccatttttgccaccttcttccaaagcttccaggggcctgctaattgtggcagttctgcaatataatttgggttgtttcttggttttccttattgccaatttaggaccaaacctctcagttctgttaggcagcttactgttcatgaatgctattttcaactttcataaaaggaatgttatgttcttgtttgcttcctctttattcttgatggttttcaacaataatttttaagaaattcatttactgtctttttaataaaatttcatgaggaaacaaatacaaatgtgtgtgtctcccatccttaaccagaagtccaccttcttctctctttaaaattctgatawagaaaaaacaaaaacaggccaggcacagtggctcacgcctgtaatcccagcactttgggagactgaggcgggtggatcacctgaggtcaggagttcaagaccagcctgggaaacatggtggaacctcaagtctacaaaaaaaaaaaatacaaaaattagctgggcatgatggtgggtgcctgtaatcccagctactcaggaggctgaggyrggagaatcacttgaatcagggagctggaggctgcagtgagctgagattgcaccattgcactccagcctaagcaacagagcaaggctcagtctcgaaaacaacaacaacaaaaataaataaataaacaaaatwaaaaaactctgtggcgagtgtatatcatcttatggtgaaatattctatgcatccaaaggcagagtgtgtcagctatagccattcattctaacaggagtgtgacatttgtagggaaaagttttttgctattcgactgctatcattgaattggatgtatgctgaaccattgaccactaggatttgtggcaacctggagatttcctgattctaggatctgtgctgtgatctgacagcatgttttctggctacatcaagtagttgtttctaggctttgttcaaatctttttcctttccctgtgtgactggctgtatctgtctctataatgccascatatacaagttgatatggtttggctgtgtcctcacccaattctcatcttgaattgtggctcccataatgcccacgtgttgtgggagggacacagtgggagataattgaatcataggggtggcttcccctatactgttcttgtggtagtgaataagtctcatgagatttgatggttttataaggggtttcccctttcacttggttctcattctctcttgcctgcctccatgtatgatgtgccttttgccttccaccatgaatgagaggcctccccagccatgtggaactgagaatccattaaacctctttttctttataaattacccagtctcgagtatgtctttatcagcagtgtgaaaacggactaatgcataagtgaatcataccttttggtgtcaaatatttcttgcttttcccatatagtacagcaaagaaggatatcagctagaggaagcaaagaactggatggatgatccaaccatctgccaaaagataaattcaaataaggtatcagcaacaagtaagatcaaacagaaataaacaagatgattccttctcctgaaagactgatagccatattgagtaaagctaaggaaagggagaatgtcatgtgtggagctcatggcagcagaaaaaagtacagacaccacggcaaagccactgaaggagatctgactgcattaatgagccattttattaaatgggtagttggcaagamaaaaagtttattcaataagttggcaacaccaagttaaagagagaagttaagtaggtcattaagacaccacagtcactaatatttagagcttgaacatagtatgaattggttgtctacagagagttagaaaaggtgccaagacacataactgrgtgatggccaatcaagggtgttttgtttctttctgaaacaaagctgggaacaatgtttttcttgttgttgttgttgttgtttttaatgtagaactggtggggtcagtaagatattgctgcccatgtctagtattttttttttaatttttgtcttaatatcatatggaggcatgctgttacctataaatttacctataatttctaaatttaaaaggaatcctcaaaataatcagaagaaaattcaacagatactattgagatctctttttgctctgttgatccatttatttcttcaatcagtaagttagtggtgctttcttttcctttgattggcaggtgtttcatcagatcttctgggatacttctakttaggagtaagatttctaactaattaaagtgaataaacacatttttttcaaaataatgtaccstgttacatagaaaacagggcttgaaaggaattgttaagaaccattcgccttattaatatgttatttttttggtgctgccaagggcattgggaacttcagtcctttgcagtagaattcttagcttctaggtgagcgtgcctctaggctggaataatttagtcacctggctttcctgtaactcttattatttttggcttcatgaggtagtattcatacagaagtggtccttttccattccccaaaagtcttttgtaggacactgataatctcttttctttccctacttgtctacatgaagtgtgcaaaaatctctggtcatatccaggatttttatacaaataagtrggttacagttaatattccagtttygcttttttttcccaaataatttagggtttaakattgttatttcttgggttatcaggacatagctctcccttgaaactagcttattagatgtgaasagttggtactgctttttaataattctggtgaggaaaacattgtaaattatcctagagtcaaatgtgatataattattatagaaggtcactttcactatttaaaacattgagttgattatatttaaatcaaaaaagatattaaaggtgaataaatttcacatattaaaacctcaaaccacatgcatataatgctttttagtgcccacaaacaccaacyagaaagtgtgtgattaggttcactttttcaagcacctttatttgtttcctcytgattcacctaatcactttgacaggggggaaatggggagggggagcagcttcaaaaagtttccacagtggaccatgagttatttaaatccatctcacagaatccatttcccatgcactgaaagccctgtgacatttccagaactgctgtttactttgggatgtgagagatgttaaaattctttgtgtttaaaccacaacatttgtgagtggcatgagacgaagactcatggcaggttgtaagcggttgggcaacccctaccggaaggaaacaggctattgaattactggactcaagagcaggcaaatccatctggggtggcaagcccaggaaaggctgccaagaaggacttagaaccactcttcgyccttccctgcctgagtatactcatcgaaaggaccctgtgtgtctatcttcattagggcaaagagatcaaatcccaaatttcataaaggagaatgttaatgctatggttacaagcttttacacaaagaaaaatacctgctacatagacactcaaggaaaacatcttgtgtttatcaactaccttgtgcttatattttttattgttttatccatatgttttcctaaagtatggccctgaaattcactgatctttacaataccttattataataggaacagtcaaagaattattttctttctttacaaataaaaaataaaacatgaaactcacttacctaagttcatatactaagatccttcctagaaacacctctagcccttcaaccatattagactccaatgagaagaaactgatcatctttcctttttttttttttttgagatggagtctcactctgtcacccaggctgagtgcagcggcacaatcttggctcactcagcctcccgggttcaagcgattctcctgcctcagtctccygagtagctgggactacaggcgtgtgccaccacacccggcttattttttgtatttttagtaaagacggggtttcaccatgttagccaggatggtctcgatctcatgacctcatgatctgcccgcctcagcctcccatagtgctgggattaccaggcgtgagccaccacacctggatgatcatctttcttaaataacaaaatatggtagactttaaattagcatataatggcagtaacataattttttattttgcattttcaaggccaacttaattttcaagtaaagattccaatgcatttgattagcaatatgaaagttatatccctgaaagagaaacaaattgattcatattttaaagaagccatagggcatcaatttttctagtaggcggtcaaaagtcattatatcctcattattaaactcttatccagattacaggatgtaaaatttaaattaaaagaaggaaacttttggatgttgattgctcagtattacctttttttttgagacagggtctcactctgtcacccagactgaagtgcagtggtgcaatcttggctcattgcaacctccacctcctgggttcaagcgattcttctacctcccctctcaagtaactgagactacaggcgcccaccaccacgcctggctaatttttttttttttttttgatatttttagtggagacggggtttcactatgttggccaggctgctctcgaactcctgatctccacccatctcagcctcccaaagtgctgggattacaggcataagccaccgctcccggctagtatttacatttttaaaaagataaaggaatagatctgcgcttacacakgtgtttgattttccacaaaggcaccaaaacagtccaacaggaatttaaacaaatggtgctaaagtagccagagagccatatggaaaaatgaatctaacctctgattcataccaaacaaacaataattagagatggatcataggccacataaaaaacagctaaaagcaaagggtttaaaatgaaaatataggagaatatcatcatgacttgggggtaggcaaaggtttcataagataggtcataaaaaagcaataaccataagagaaaaaaatttatatacattagacatcatcaacatttaaaacttctgctcatcaaaagatgcctttgagaaaataggcaagccacacactgagagaacatattcactaagaatgtatctgataacagcctggtatagaaacagctcttacaaaaacaaagaaacaactcaatagaaaaggagcaaaaaatttggacaggcacttcacaaaagaaggtatttgaatgggcaataagcacatgaaaaagtgctcagcatcatgaagttatcagggaaataaaaattaaaatcacaataagatatcattgaatacctacaagaatggctaaaacaagagactgataacatctaacgttggcaagaatgtagagtacctgcaagtttcacacatggttagtgggaatataaaatagtacactttgaaaaatggtgaggtaatttcttataaaactaaacatacacttaccctcccacccagtaattctgatcctagatatttacccatgataacatgttcacaaaaaaacttgtacaagaatgttcatagcagctttatttgcccaaaactgggaatagctcacatgttaatctgcagaaaaatggataaacaaactgtgatagcttcagatactggaactcaactcagcaaaaaaaaaaaaaaaaaaaaaagaagacatgaactgcttatatgtgcaacaacatagatgagtcttaaaacatactgaaagaagccttatacaaaagagtacatgctgtttgattgtatctagataaagttctagaatagataaaactagtctactgtggaaaacacaagaaaaacggggggagtgggatcgactgggaaggagtatgagagaactttctagaaagatagtgtttgtttcatttacacagatgtatgcatttgtcaaaagttagtgaatgtacacttaagatttataaatttcattgtatgtaatttttacatcaaaagaaaaactaaatattaatatctagctagtgatatgcttgctgaaggatttaggagaaattgtactgaggcctgcaatttatttttaaatattccaaaaaaaaaaaaaaagattgatagagggagggagagggggaagaagagagacagagcgagagagcaaagcaaataaaatgtttatggtagaatgtaggtgttgggtatgatatatggggtgtttactgtaaaattcaacattgctatatattttataaagttttatgagaaaatgttggggaaaacaaaagtagatttttagaagaaagaaccagttttcaataatctttagatataacactcccctaatacatttcacagaattgttttccaatgggactatttgataataaataactaatttgttcaatccattaaaaaataaatcacgctggtatcttgagtctcttctagtaattgtacaggtataagaaggtggaggggaaaacctgtaggtcaaataaattaggaagtatttattgagcttttactatctgcctacccggtgagatacagagacatccaagacttagttagatcttacctgcaggggccacactctcacttggcagccatgaaraatgaagcaaaggtcaggcctgcgggcaatgcagggtaaggataaggacccacatgctcagcagtaccttcaaggccccaaccctgcttctcccctccactctgatcttctctctttctcccaccacaggtccctctacccagactctacccagagctctgtctgccaggctctsctccccggcaccaggcttgagtattccgcctcactcaccaagcctcagcccccgcccatttcctcagggacatgctccctgacccagagcagagatcacgttctttgttatacagtttcagagtacagtagtcctttattagagagcatttgattcagtttataattacatggtcactgagggatcgtttgggtaatgtgtgtctcccctactagattttcagctccatgagaaaaagaattgtatttcctttttaattctcattatatccccagcaatttagcagcatctgctatgtagaaggttacatatgaaaacacacagaaagcattgggtgtcttttttttccttcaaataggaaagaaaaagaagaagaaaacatggttataaccatatgaagctactgccaggaygatatgttaataaaataaatttaagaaaagatttgttaaaatcaaaagaggaaaaatatttgtagaattataaaatcttatgtggtaagggatattgtgggtcatctggtccacctaagcttaactatactcctgtcaaatgtatgaatatctttagtaaatatcttttgttattttacatttttaaaaataactttttatatcaaaccgttaaaaattcaaaaaaaaatcaattctccatcttcagaaactgattgttatataaagaatttagtataatgcatgattcacagtgatagttataataactactactagtaggagtattaccaggaaacctctaagttgtagtgcatcattttgataagaacatgtgttttggatcatttaaaaaaaggggattaaattataactctgcctctaaatggcaatacatctttgagcaattttcctaatatctccaaacttcagggttttttttctcctggcattcaataaacggtagccaatcatggttataatataacaacaacagtgaggatgaataagaatctgtgtttattctcaaagcgctcacagctcagcagggacatggatacaaactccaattctgcgcagtaaatgcaacaatggaagcacgccaccaagaatgagagagtgactctcaggcctggtctattgggggaggaaagagtttttttaaaaagtaattaaaaggaattctccaggctaattaagcaaaaaaggcatcctgggtggaagaacactgccatgcatgcttgctatgatccagcagagtattccaaggtgcagcatggcaggtgatgggctgaagatcctaggataccttttgtgtcatgataaaatacacagatttcattctgcaagtaatgaggagcccgtgaagggttttaaaggggtaaagaaacaatcaggcttatcttttaggaaaatcagctggggagtcatattagaaggggtgagccctggggcaggaagaccagtcaggctagtggatggaagaggtgatgagggtctaaactgggaagagtagtgtgggcctggagaggtgagaatgactcatggcagttcagaaagagtgtcaacaagattgagtgatgaggagtacagagggaagagcgccatccaagatgactcaggaacactcataacttgcttggcagactgagtgggtagacaaacaaatatggttcatggttcagtggagaaaatacagaagggagctgcgggggaggtgggggtgagaggtttagttgtagacataattgaggtctccatacctgcgagccaccaggagaaaggagaagatgtcccataggcacatgggacatcagaagaactgattctgggtcagggaatcccattatggagccaccagttggttcagggaaagactgtgatgtgaaaaggggtaagtgccaagtacagaatgctggagataccagcccatgaggagacatggagacgaatcgtggaacaggcagagaaatctaggcaagaatggggctatggaagccgaaagaataaagtatttcacaaagaaggaactgagcaactatgaaaaaggtgcagagaaaacaaacaagataaagaatggggactgttcactaagtcaggtagcacaaaaccacttgtcacttttgcctatggtgtttcagtggaaagggaaaggtaggaaagatggcagtggatggagaagtagatgggtggtggacagagagactgtgatactgtaatagacaagtctattgagatggtcagttaaagaagaaaaatgaagaatatgttttaaatgtctctcaagatatctttaaatacatttgtgtattttcctaaatttgaaaaaaaaaaaaagtccttaatatctgcttcatctaagcagaaagatcacctgaggtcaggagttcaagaccaacctagtcacatggtgaaactccatctctactaaaaatacaaaaattagctagcatggtgacatacacctgcaatcccagctcctctggaggctgaggcaagagaatcgcttgaacccaggaggtggaggttgcagtaagccgagatcacgccactgcactccagcccaggcgacagagcaagactctrtctcaaaaaaagaaaaaagaaaaatcatccaagggacaatttatccttaaccatacaaaacttacagcctcaagaggaagatgagctttggctactgttttctagagaaaattggtcctaaaaatcattactttgtaatgattgtcacaatttctcaacacatcttgattaaaagaaaacgatagattcctaattcaaggcgcttcatagtgccatctatgcgttgcagttacaaaatcttcaccttctagttctgttaatactggctttgcaatgtcctcacacctgttctttctcgtcctttcccacggtccttacaataaaactgtttattttttaaaaactgcatgcctttttaaaaaaagttcatattgaaatgtcttaacaatctttatccaaaagagggcgcaaatttctcatgaaatatagtgcggtattttacaaaatgtctttgctgctagtggtatttaaatttcacagctgctgtaagttaatgcagaaacactattcctgcagcatgtgcatgtgaatcctgtcctgttgtgtgtgtgctaattaagagccttttgcttctttagaagagtttcagagcagagctaaggcttgctgaagtaaagaagtaagttgaagctaacattttttctattctgggtagccatatcaaattaagatagaatattttaaaattaaacattaagtgggggaaaagaaaacctctctgtttacaatcttctaattttaggatgtatttccattctaccacagattaaagaatgcctaatgaagttaatatagttcagactttgtgtggggttggttaatagctaatcagttttgggggggttgttggttatttgttttgttgccagagctggaaacattcataattcaatgaatacccagtatgcacggctcttcttgcgtacaggaggcagtatgaattgcgaacagaggggatcaagtgaattctggtctcagctattactgtagcttgagtcccaccataatttgtgtacgttttctgatggggatgatatgccaaaaaggtgctgaagtagaattgggtgtcataaatatgaactatgcaaatggaaggaagtgcaaagacgaaaccattttttcaatggtagtaatataccacaagtttcccttacttaacagaaattcatttaaccaaattctttacttgaaatatataaattagggtaccacttcactccacagaatsgcatttccaaatttgaagtcctgtgcttattcttgcttctgtaactggcttgaattccaaattccaggttttccatcataactacctgcctggtaatttgctggggtgcggtagccatgaacactcacccacgagtaacaaacactcaccggggtaatttggattggcttccagcccctaaaagtgaaaccaattataagtagagaatccctgaaactttatctgccaattgataagcactggtggctatcaactagaacccaaaactacatccttcagtggcaacatacaaacagcactaaatkagggcaaatgcagagctaaattcatagccctttttatgcaccagtctaaaacaacgttgccaagaagatctgcagaaatttttggtagagaaccaacatgacaacaagagccaagcattatttccagctttcatttgattacaaatctgtgacccattgacaaactgtttatttcttttttttttttttttttttttttttttgagacatgcaatggcacaatcttggctcactgcaacctctgcttcctgggttgaggcgattctcctgcctcagcctccagagtagctggcaccttacaggcgcccaccaccacgcctggctagtttttttgtattttttgtagagacagggtttcactatattggccaggctggtcttgaacccctgacctcatgatccacccaccttggactcccaaagtgctgagattacaggcatgagccaccacacccagccaacaaactgtttctatgaattaccaacaagcattcatacctcctctccatatgtgatgatagagtgatatcaattgattcatcatattgatttcctcttgtcagtggccaaacctgccttcatcacgcaccccatgcagctgcarggtcaatgtgtgtgttcgctctgaaatcctcacgctgcatcttggccagcttcctcctttcctgaccataagatctgatctcttcttctatagggtagagcctggatcacattttcttttctgaatttctgaggccatgactcctcctcttcctctgcctattgctatagccaacaccgttgtcctgctgtacccgcttatggcaacaaccctaatgccttagattccattcctgtagactccacagagaaggcgatttttaagtactcaagttgtttgataatgctgaactttgtaacatttctctttttttttgagatggagtctcgctctgtcgctcaggctggagtgcagtggcacaatctcggctcactgcaaccaccgcctcctgggttcaagtgattctctggcctcagcctcccgagtagctgggtttacaggcacccgccatmatacctggctaatttttgtatttttgtagagatggggtttcaccatgttggccaggctgcccttgaactcccgacctcaggtgatccacccaccttggcctcccaaagtgctgggattacaggcgtgagccaccgtgcccagctgaactttgttacatttctaaaacattttattgctctccaagaatagaaaccagatcaaatgtttgaggatagcaatgtaaaagtagagggtacaaaggaaccaaagtcactggactcttaaaacaacacagaagaaaaagtgaggatgctggcattacaattggattktgaatctgttttcaccttcagtatttatattgagacatgtgggaatacagtattgtttcaatatgccttctctcaaatgatcattttttagttggtacatgactaagaggtttgctatattcattggagtaacattcacgttctgaattaatttgcttagaagatgaatctgactttataataaaaattttaaaggagtcaattagaaaagagcagctggaagaaagttgttgcattatttaagggcttgaataatatacaaaggtaagttagtaataaaaagttaattacaagatggctttatttcttattgaaactgtattttctacctttccagaatattgtcctgagaacacttacatattccttttttttagaaaaactgtggaatgaagaaggcactcattattttcagctcccatagttataattctgtttctatagaaatttgcaacatcccatagagtacagtattttattcagctttcaaaagataatcttgaccctttaacacatgtttacttttggctgggcaaggtggctcacgcctgtaatatcagcactttgggaggtcgaggtgggcagatcacctaaagtcaggagttcaagaccagcctgggcaacatggtgaagccccttctctgccaaaaatataaaaattagcctgacgtggccaggcgcggtggctcacgcctgtaattccagcactttgggaggccgaggtgggtggatcacctgaggtcaggagttcaagaccagcctggccaatatgatgaaatcccgtctctactaaaaatacaaaaattagccgggcatggtggtgcatgcctgtagtcccagctacttgggaggctgaggcagaagaatcgcttggacccgggagatggaggttacagtgagctaagatcacgccactgcactccagcctgggcaacagagggagactctgtctcaaaaataaataaataaataaataaataaataaataaatattagcctggcatggtggcatgcgcctgtaatctcagctgcttggtgggggctgaggcaagagaatcgcttgagcctgggaggtggaggttgcagtgagccaagatagcaccactgcacaccagcctgggcagcagagcagagacagactctgtctcaaaaaaaaagcttacttttaagaactgcttacattaattacaaaagaccactttttagttgttaatatgcattaggtaacaaatacttggcatatatgcattctttgaaaatatcagacaaataactaaacaaaattgcatgctagttagtggctcggactgggaaatgagaagtgatgttaattcttaacgttggctacttttgtcacctgtaaaatatgatcaagcctgttagtctaacttaatagcttgagtaattgatatagggagtgaagtttttttgggggttggggagagacattgcttttttccactgacactgacgataccagtttactactatgtgacactttttgcttgaactagaagagataagtagtatttttcaagttttgaggtttgggtgttctgctcttgtggacgtgtcatgtttaataaagcttgttcacaactactggcttaggaagtggcttgcagttgacaagtatgtgacttggaacactgggtggaatggccacgtggcccagtggcccagggcccacactgagaatgcagcagctgtgcatgctaaatctggctctgtcattaacctgccgagggaccttctacaaatgcttaattccaaccatgaaagcaaacataggcaccgatgcttgagaatagttgtaaaggaaatcaggccttgtgcagaaaataaacggaactcgtctgcctttcctttctaacacttgttggaggcagggaggaattcagaatgaccaggctgcaagttactgttctttgcttctaattaagaggcaactatacgcaagtgagcataattaggagaaactggggcagctggggcaagtatgggcaaaacttaagccaactttgaaaactaaagggcaaatctctggagtagtgagaaagagatttctccctggttccctctcttgctagctgcatatgtgtacaatgaccccatcacactctgcgtctgagcctccctctctttctagtttttttctgtttcccctgttccttcttgtttttcctttgtttgcactgtctgaaggggaggaggagacaatattctcccattgcattttttattacttcctctatcactagatctaggcagagcttttgagactygttttgacacactcactttttttccacactcactttttagacgggaaaaatgggcccaatcaaatgtaaatgaacagcaaggtagtgacagctagaatagatggcaggtcatttaaatgccagtccagtgctatttccatacattgcacccaagtttaatgattaagaacaaacaataacactcccaaggctgaactgaccttatatttttcatatgtaaaaatgtattctatgtttgttacctcacaactatgttagtccattctcacatagctataaatatctgagactgggtaatttataaagagaaaaggtttaattgctaggttttgcaggctgtacaggaacatgatgctggcatctacttggcttctggggaggcctcaggaaactcacaatcattgcggaagatgaagtggaagcttgcatgtcacatggtcacatggccagagcaagagcaagagagcgaggtgggaagtgctacacatttttaaatgaccagatctcacgagaactcattcactatcacgggaacagccccaaggggatggtgctgaaccattcgtgagaaatctacccccatgatccagtcacctcccatcaggccccacctccaataccgggaattacaattctacatgagatgtggtgcagacagatccaaaccttatcagcaaccacaggagttagggcaggtggaggatgtgacagcatttaaacaccattatttcatgtacatggaattatttgatgtagagtatgaatgtatgtacttcgaaattcaacatgattttgaagtatatccacaagtacggttcatctttggcccagtttggccagaaataaaatactgcactggaaatatgtatgctacattcactaaataattttaaaatgagagttaaaggtcataatcatagttatgaacatagatgccaaagcgggtgaatcacttgaggtcaggagttcaagaccagcctggccaacatgatgaaaccccatctgtactaaaaatacaaaaattagctgggcatggtggcgcacgcctgtagttgcagctactcggggggctgaggcaggagaatctcttgaacccaggaggcagaaattgcagtgagccaagatggtgccactgcattccagcctgggcaacagagctagactctgtctaaaataataggaataataataacaataataaagacatagttatgaccatagcaaacaaataatggtaaaaactcacactcacatttgtccagtgagaggtaaagcaaacaccagtatatatggagatgtaaaatccaccctttaggctgggcatgatggctcatgcctgtaatcccagcactttgggaggccaaggcaggtggatcacctgaggtcaggagtttgagaccagcctggccaatgtgttgaaaccctgtctctactaaaaatataaaaattagccaagcatagtgtcacatgcctgtaaccccagctactcgggaggttgaggcatgagaattgcttgaacctgggaggcagaggttacggtgagtcgaaatcgcacccttgcacttcagcctgggcgacagagcgagactctgtctcaaaaaataaaaaataaaatccacccttttgagaagtcttctgccctgagactgagagtcagccagagcttttcaggtgctaagtaacaaagaatggtgccatttaaaataggtggaagtgtggaggtacataccacttagggcttagcttgattttccctaagccagtgaaatacaagagtcttgaaagtcagaagtaattggctgttaggaaaaagagtaaaagaaactggtgagtctaatctgtgagtgaagttaccatatacctattccaggtagcaaaacaaactaaaagaaaaaaatactgcattttccaaaattcataaaatttcccaaattcataaagtttatgaatttaggaaaatgcagtatgtttttctattagtttattttttctattagtttgtttatgaattaggaaaattcataaatttcatttctaaaattcatatttaggaaaatgcagcatgtttttctattagctcatattttctattagttcatatatttttctattcctttcatattaatattgtgtgattccaaactatctgtagaaaaattgtatagtgataaacatttatatacatatatgcaatcgattgtaaaagacaaaaaagcaattatttgaggattaatttaattgtttaaaatataaactgacaaagccttatattcataagattttaatttgaaaggatatgacattccttcttcatgtaagaagattatactcaaaagagcaaatacaaattagacatttacagtctgtttttgagagttcatgcttaacattctaccaatcttaatcatatatccttttttgactaataaaattaaattcaacaacatttagcaaatgcctatagtatacccagttctataatatctattatttaatttgttggatcctctcaatcacatctggaaattaatatgaaataataaaattgtattatttgcttttctcctctacagtatatgaactctagaaagtcaagaataaacagagtatcattcaggttgcttaaccaaatttcattggctgctttatttagcatgtcaaaaaattacaatataatctttcacatggtgttttgattggaaataaaacatggcttaactctataggattacatatatggatgaattgtacggtgggaggcagctgacatagggcatgtttgtttgtcagaaagatttatgccagaaatcctagaggtgtggcagttatgataatacaggcaaaacatgacatcaactttgttctttagatgtttttattcattctttacaaaccctaaatcatagaaacagctattgctttgaaccacaaagagaggtgtgtctgttatcagtctgccatattatcagcatacaattccactgtgatttcctttctttttatgttactattcagaagtcatgtatagagatgactgcatgaacctgaatcacgaagcctcctagtaatacacttgtaaatattttactggggagcataaatatatctttgaggagaacctagatgaaatagggtagttttcaactttttttttttttgagatggactcttgctcttctgcccaagctggagtgcagtggtgcgatctcagctcactgcaacctccatctccccggttcaagcaattctcctgcctcagcctcccgagtagctgggattacaggtgtgtgccaccacacccagctagttttttgtatttttagtgaaaacaaggtttcaccgtgttggccaagctggtctcaaactcctgacctcaggtgatccacctgcctcagcctcccaaagggctagggttgcaggtgtgagccactgtgcctggctcaacttttaaatattattcaaatcttgcttctaattcagatttttcttcagcatcaaactcagataatttttcagatttatacatttttgaaaaatattgataacatgcaaaatgttattccaattgatatactacttcagcatatactttatgacctaatgtgcattaagaagtcacttttgagtccaggcacggtggctcacacctgtaatcccagcactttgggaggccaaggcaggcagatcacctgagttaaagagttcgaaaccagcctgaccaacatggagaaaccctgtctccactaaaaatacaaaattacccaggcatggtggcacatgcctggtatcccagctacttgggaggcaggagaatcgcttgaacccggaaggtggaggttgcggtgagccgagatcgcgcctttgcactccaggctgggcaacaagagcaaaactccatctcaaaacataaaagaaaaaaagtagtcacttttgggtcccagtttcctcatttgaaaaattgaattaggtaacttttttaaggtcctttctaacttcagcattctagaaataaaaatatataccttagtttgatgtcctttaaaataacaatattttttatggctatttaaaaaccattggtttttaaatattttcaccagaaaatgaaataaacatgagaaggagcgtccacagcacagtaaatgatactcactgcagaacgtccccaactcaggatggcagggaagaagggtgggtgctcactggcagaacgttcccattcaagtcactgggctagctccgtttggctgagagcacgggccagagctcaaagcacgcagaagacagatttaagaattctctaatgaagtcttcttactgtgtgtgtggactcaaagaaaaatattccagacccaaactaacacagtgagtgagccttgctcaggataccattaaacagcatattattgaacttcaattcacttactgcaagatctagacatatacagaaatgaagtaaggaaactaggtaccctgttcaaataattctgattataaaagcaattttcctgaaaataaagttaaatcaagttattcagaactgtcttaatgcattttgtgcatgtttgttcacacgctgtagatattgactgtactctgtacacaaagagttgtcttggtgggaagcaacttctcacaaggagtggagactctagaactgagctggcacattgaaacctcacctccaccaccttccagagcaagtgacttaatctctctgtggttcagtttcctcttctgtacaatgggaatgaaaatagtaccccattgcatggagtttttattaaatagtatctattgcatggaattgttaaaaggtaccaagatcagtgtttattagatagaaataagagaatgcctacattttgaagaaaaaaaactctcaaaatgaagcactagcttataggtatgtttttgtaagaacatgcatttttaaccctgaaataattcattttaaacttcctctgattttccccacaatgtgagccacgtggtaacttgggacttctgagtagtttggaataaactttgcacctgctgtattgtgaggactagagagaggagcaagtatctgcatttggtaacagacactagactgtattgcttcccactccttacacctagtcattgagaaaactgagggctatggaaatcattcaccctgtcctcagtgtcctctgctcagcttctcgtcccagtgctgtctccccttgatttcccacttcttctcttctttatctttatttcttgccccttgcttttctctttgcartttctgttccccttactctctctgccttatcattggtcacttctttcatttatttttacttttttagagacaggcaggctggtcttgaactcctagctcatgctcccaaagagctgggactacaggcggctggctaactttttttttttttttttttaagagatggggactctccctatgttactcaggctggtctggaactcctaggctcaagtgatcttgctgcctcagcctctggaggggctgggagagattacaggcacccagctgttcacccttttaaatttaactgtcctccagttttatttctcactttcctttgcaagcccctcactcccaaccacttttgctccccgggactatcctctgctctgacttcctggtttccctccctctgccctcactctgggcaccagccccttccatgttggcattcgactccacactttctgctttcctactttgagatttgcaatacacttcagccttattcacttactgctgttagcctaaccgattaataccatttttatgaaaaaatgtaattgtatctctttaaagagacacaaggaaatgagaggcatgaatgaactgaataatattcattatttactaagcatccactacattcctgtccttcatatacattgtctctattcttcacaacgcctttgaaagaagctgtcatttagtcccacgttatacttgaagaagtgatgctgagtgagattaggtgacctgtccaaggtcattcagaggtagaattttatctcacatctttctgattacatcatctaccctctgtccgctatatctccctgactcttaagtgaatgaaagtaccatgccttatcacatttctcctaaacagaaggaataagtgacaataagtctacatgtagagattttagattttctccatgcactgcctctcacatacacatctatacagacgccacctttaaatttaacaaaggagggaggcagaaagtgggaataaaacagtaaagacaccaaaggaaaactgctactctcctctccttgatgttatctgtgaatgactaagttcattaggaatcctagactcaggggtttttggagttgaaagtggtctcggaagatatccagaataactcctctgttttacaaatgagggagctgtaactcagagacataaaatcacttgcccaaaacatataaattaacatactgccccgacctgggtgggaggttatattgatattcatcaagtgcttatggacaaacaaaatgtacccaacctgtctacaagccctggaatgttctagcatcacagagtgagagtaattccaggctcgaagggtattcctgctggggcccaaaccttacccctccccttcaggggctcaagaggagtctactaagataatttagaattgggaatgagtgtgtttcaaatgaatgcatgaaaaacaaatccacaaggtatatggcactgacttgtaataggcccatagaaatattctgatggagtacaacttcacaggttgccaaatgacagaataaggcaactgtttttatagttataatttgcaaaaaaaattatagatatatatttatatatgaatggtgatgcaatggtgagaataactgttcattctgtaactattcctatcactctgtagctttcaygctaagtagattacaaatatcattggatttgcataagcattaagataaatgaaatgttagggaaaatggaaggaaaaagaacacagatatgctcttttaatatcttggtaccggcattaatgtcttctttaatgtgatgtaacaatacttggctcctgggcagttgttttttttagttaataccgtatcatcaggaattcagtttcttcccacctgattagcagcacgccacctcactggaatctaggaaggagctaatgtatactgaaaccaaatctgatgcttagaaaatccttgagctattgaaaggcacacctgcgttgcttggtaggtgtactgaatctcaagtaaggaatttctgcaaatctcctgtttagttggctaaactggttttcactcctattgaacaaccccagggtgggggggatcctctatttctctttaataaccataataagccaaagaaataattttcaatgctaattccagtgacttagacctcaaaagtagaaaggctcagaatatgtttgagggcattgtatgtcttcgggtcaaatttatagatcagttagtagttttcatattggaaaagatctatagctttttgtaaagactaaactattgttaactaagatgttactttgaataatttagaggaggcaaccttttttgatgtattyacttttatatttaaattaagaatagtctcttatgaaatttcagtgaactgaatcctaaagaaaataaggaagcatttatcagtcgaaagtactctgtaaatcggcttgcagattaactgcaaaggttatttgggaactgtataatcttaaagcaaaacaagacatttatccattacttcttttcaaaaatctctatttggtccatttttattttctggacattctttttttagattatatgctactccataatatctttagaattctcctgacaaaactagcttgagaagcataagatataagacattctaaaataaaaatgtttgattcattacataatattatctaggtattaaagaaagttaacatttttcattctttggtcaggaactcatggcctccaacatacagctttccacagtaactatgtagtacatcctagggaagataaagaaaagagtttagggttgtccaacctcatagaaaggagaaaggaaaattaaccaagtccacaggcatgacgaccctagtctgttttagctgccaaaggaactaataatgctgccatttaagttttaatttatggattgtttgtggtgtttcccatcccttttaagttgaaattgtgtgttgcaatctctacagtaatagaatatttcttttttcaaagtattcaacaatnagtttaatattctttcttcctgtgatgcataccaccatccgttatgctaaattaactgtttatacacacatacacagagctcaactggtcagagctgtggttctcagcctgagtccacattagaagttttggaaatactgctaccaaggccacccccagagattctggcttcactggtgtggcgatgcggcagagagaagagtgttccaagcaggaattcagaatttgtttcttccggatgctatgttgcaacggtaatctgggcttatggatttttgaagtataatgggtagagctacattatgtgttaaataaactttgcagactggtttaaaacaccaaaccattcttcaaagttctttctttaaaacaaacaatgtgcctttggatccaaacagtggacttcatagcaactaggtgataaattaggaagtgcttgagtcttaaaggtcacagcactacacttgttttgtggcaaaagtaagtcagggttttgtctagtaaaaacaaagaaataatcaatttagtgagtatctaccataggcgagccacggtaaacaaagggactatcgaacaaggccaggaaataaagtattaaatttgtgtaatttgtaattttagaaaaatcagtaagaaatgttatggttagtgggttttgtgtttttcaaatagtaattggatcagaaataggcagattgttcaggaaggaatatggcatagaaataatagtggaaatatgctggagggcaaaaaaacagatgataaaacactttaaaaaggcaagccatacaaaagaatagaggatgctttgtagtcattgctcaaaggtgactgatttgcatagcaaggaggatgagaaggaagaggttaggaagatacttttttttttttttttttttttttggatttttagtagagacgggatttcaccgtgttagccaggatagtctcgatctcctgacttcatgatccgcccgcctcggcctcccaaagtgctgggattacaggtgtgagccactgcgcccagccagggagatacttcttaaactcagtttttaagtttagkttaccagtgaacctaacatgatacatcaggacaagctggggttcagagcagaacagtagggtaaccatgtctgcattgtcacccttgtacccattcacgaaagccatgggaccattaagcacagagaagcccactacctgccagccgctgcacggctgcaacaagagtaggacttacttcgtgttctcagagcacagattacaacattcgggtagacattgaagagagacagatttggggctcaataggaagaaaagctttttwaaagggctgtcaaaacaacatgaagaaaaacagaatagatacgttgccatgcactgaactgctggtcctgaagggtggagcatgggctaaacattatctctagaaatagacaggawcattgttttgagtgtggagcgtgtcctgctggtctacagtgattcttccaatctaagttttgatgattctatgtccagcttcctctcttctccagtcaccttgtcgcctctaatttcactgggcacccatttggttaaaaaaaaaaagtgacaaagggaaattaagaaattcttcacattgaaccagagtgtttctrcctaaagatagtgacacagagggttagcacgagatttatcacagcagactgattgataggttttagacctttccttacttttggcaacaagtgaaacctggaagctcataacaaaactgcaagaacctttaagtggacaaataataacccgtgtccttgttctctcatttatgcccagatttgtggcctcaggagccagaagtacaccttgatctttatgtttaccttgagacagcaatgaagggatgaargaatgaatgagtttatatttcaattaggcgtgagagatggaggtggtttaaaaaaaaataaaagacaagatagcagttttgactgggataacagcatcctttcatagaatagcctctagacctggaagctggaagggacctacagggaaaatgtgttgaacaaatgccctctgcgtagtgcattagtatgagtacaccagcaagatcaagatcgtcaggatgccccatctgctgctrtcttgactttaggcctgtgccacgcaccgttttgccatgactttccgcatagcaccaggccaaaaagaactgcagagttttgagggcaaggccggtttccagcccagaatctgcaatgatccctccttgacaagtcaaacagagtcacccaaacaagcgtggcacgcaaacctttagagttcagcaaaccgagggctgagttaccaaaccgtgtcctttcagggcatgcaaaaggcttttcctgctctgcttctacaaggtagtcaggaagccaagctatttgccttgggtagggctgggtgggggtggtgaggtgggggcgcagcaggttgtccacacccggttgccagtctgaacctgagccgctccaacaagcgagcccttctccgcggccctttggctcaggggagcgcaggccggccttcctcccgcacgcgggcgcgggccagctgcagatggagaacccggggggcgaccgcragccctctgaggcccctcaagggacagggcatgggtgtgaggggtcgcgtgcgccccctggcgccgggtccgctgggcggggtggtgggcggggacggtgggcggaggcggaggcgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccmacagggccttagggagccagggacgctcctggtgcccgccctctcctgatggctgtctcgcggggcgcctgttcgagcctgggaccccgggaggggggacacgcagacaggcccgggttggtgactcccaggcgtcgggggatggggaagctttgcggtcctgagagtcaaggaagcggctgccctcccccaccccccatatcttggggaccgctgggacccagagttcatgctgcaggggcttgtctcctccacctccctcccctacgttccccgaaggctgggttctgataaaaatggtgtcattgcaagccaaatccgtttgtcctgacctcccttgagccatttcgttggttcttttaaaagtaggcgggggtgggggttgagaggttggaagcgggaaaacatattgcagaatttgttgttgttattgtttccctttaaagagcttctacaaacttgtctgcctaggcaacactacaaacacttcctccgagttttaggaaaataatagcccttgcggtgccgcgatgagtccgcagagggtagggaatcttgggccgtgagagcgtggcgccgggagctgaccagttctgcatccgagtccccggtgcctgctgctgtcctgggttgttcctttgtggaggttcacctgcgttgctctggttagtcaggccttatgctggtagcagctggtggatattcacacagaactctggctctgttgagtttcaagacaacagccgatgtcagcccggtcccattgattgctcaagttctaggcccgttgcttccaggattttacagcaaacgaatcctggcagaaacttaagaggagttatttacattacatatttctagatttgaggtgtttttttcttttattaccgcacttgcaggttttgtttacatagctgggtaaatgaaagaaaatagttgattcctctaagatggggtttgccacgaagagcaaactgttgctcaacgtggtatttgatggaacctccgtataaggaatacgcatctagttttagaagggtggcgcccgggtccgtgtcctgttcggtaaaataagcagccggaacagtgtttattccccagcattaccgttgaatttcctgtggtttgtagagcacgcatccaggtagatgaacaggcattctcttgttcctgtgatttatagtcagcaatgtgttactgtcctctgaacactcttctgttgtaactctattgttctctgagatagtgtgccagataggtacgcttccttctgtaggacagttgggggacaagggagagaaggaaatgaatgctctatgaatattattaagtgcagaataataaagttttctcctacatgtctgcagtgagagtggaggtggtaccatacctgtttgggggcagatcgggccgggagtgaagaggaagtaggaatagttgtcctggttagctgggaggagaacagagaggagtgacatttttatgccatccagcttgcaaaatggccttcctgtgtgctcatgtgactaaaaaatgacttttaaaaacataaatggcatgacactacctactgttgtacaacactttaaaatcaatgtatttttccaagtcagtacttaatagaagtgacttgactctgtgtaactgctgcatggtatattcattagactgcataaaatggcttagttaaccatagatccattgtggacattggaccttttccagcttttctttgttggtggtgctttactgaaaatcttatattcacctctttgtatgtgtgtgtatttctgtagactccattccactgagaaatggtatcgtaagagcagtagaatacacgtgcattttaatattcagttcatactgtcaaattactttccactgacagtgtatgagaatacctgcttctccacattctcaccactctgtgttaatccagttttktttttttttttttttttgagacggagttttgctcttgttgcctaggctggagtgcagtggcacaatctcagccgactgcaacctccgcctcccaggtacaagtgattctcctgtctcagcctcccaagtagctgggattacaggcatgtgccaccatgcccggctaattttttttgcatttagtagagacagggtttcaccatgttaggctgrtcgcgaactcctgaactcaggtcatccaccctcctcggcctcccaaagtgccgggattacaggtgtgcgccaccgcgcccagccatcttatcattttagttggcatttcccttattgccgtggtcaaaatcactggttataaaaatggtcaaaactcactgaccgtttttttttctcttttgtgaattggcatccatatcttaggcccatggttctgttgtttctttgtggtttcgatgatttgtcagtccttgatttgttatgtaggttgcaatctcacaccattgttcatcttttaaatttatgatgccttttctcayacaggactttgaaatttgtaatagaatcatatttatcagcctgtttttttgatgactttccttctgtggcttaagatggcatttcttaccgcaaaacaaacttacttttctgtatctctcagaataacatcttggagggttaaatcatgcaactgtgttttcctgtggaggggagttgattcccccacctgcaagtggaagcttccagggtaggggccctctgtttgtcctctaccttgcattcccaggtcagccacatctggtgggtgctggtcctgacattgcctttggagaaagtggccatggtggcctgagtggaacagccctccccttaaacccaggtatgagctctagattgggaagagaatccaggaagggagagagaaggctcgtgactcttgcctatcttgtgttaggtagaagaactcttggagtcaaacgacgaggtcattattctgaatttcttttctttttttttttgagacaaagtttcactctgtcccccaggacagagtgccatggcatgatctctgctcactgcaacttccacctcccgggttcaagcaattctcctgcctcagcctcctgagtagctgggattacaggcacccactgccacacctggctgatttttgtatttttagtagagacaggktttcaccatgttggccaggctggtcttgaactcctgacctcaagtgatctgcccgcctctgcctctcaaagtgctgggattacaggcatgagccatgcgcccagccctaaatttcttatataaagaaatctctgattcccctcccctaggggtatcattgccacttgttttccttataagaaaaatgaggcctagcaaagctatatgtctagatttaacgttatgccatattaagaacccagctctaatttctgcttagaatccattgtagtattataatatgacgggatgctttgatgactttcttactgctcagcagacatccatattattcatcctgtgaaggaggtgctgccatccctgttttacagatgagagaactgagcctcaaagagattaggtcctataaccaagtacataccttgggtaaatagaagcaccagaggtgaaactcagagttcctgccctccccataccactgttctctcaaaggatttgcagaagtacacaaagctaccaggaaaagaaaagcacattcttttttcccccctaaatccatcaactagcacaggtgctattagcgaattgtctccaccaagtggatgttttcgttttttgctgatttgcaattgaaaataaagtacacataatttggaaaacacttaacttttaaggaacaccttgaagctttcctccaacagagttcattaatttaaagtcactgtattttactatttgaaaatttcacagctgaatgagcttgtgatttctgtttattgttaacccatactcctttcaaagtaccacttgaacttcagctgagtatgattttcagccagcttgtttttagtgtatgccatctatttttgctagtgggaatgcttgccatttctcccaggagaactaactataaattatacttcagagaacttctaaataaatatgttcatgcctcagcaccttaatgtgttaattagctattaacagtgtcagtaaattagacctgtcaaaaataatggcctccttgactaggtttttactaacacttctcctggtggtgttacttgtaagttttgccctcaggaactgttagaaagcaaggctgtagaggtctgctttgcaaaagatgaactctgaaagggtttgttggaatcatcttggctccaatctgtgggtgttgtaaggactggtagccttagaacactgagaatttacaaatctcaggcttacgagcaactccattacatttatggctggcaggggagtttatcccctgctctttgctctccatttcagaaaatctggccaatgatcgtccttgtaaattgccttctttgtgcatgcgcaaaattaacaagttatggctgctgttcatgctggagaaaggtacctcattttccaaatccgggttctggttggcacaaaagaaggacctgaccagatcagaatctgccctgcccacttctyctctcatgcttgtgtcaagagaccaaagtgggtcctgctgccaataccagggctgggacggggcatctcagagtgagaaactcgggaaaaatgttatcagtggtgattacataaagttcaaagactactgttattttccctgttgtattaagaatcgaatgggttggcctgggattctacccactgtttatcatctgggaaatgcattccgcgttctaaatgaccagattgtagaatttaacctttggtaaattcccgacaacttgcactttctgttaacaaagcatggaagtaactaaaggcaatgcaaattagggtacatgctaatgttttctgggagtatatataaatggatgagtcccccatttttttgtttatttaatgactgcagtcagagtcagctataaaacctcaaaaccatagattaaaatgaatttcacaaaaagagcgaaaccacactgtccgagtagccctggtggcaagtgatgaaccagtttgggttatcctcacaggctctcttcaaacttgcaagggactgacaggcttcccctctctgtcttgcctctacctgctgtctgggctctggctggggagctcgaggactgaagtttaaaatacagctggttcagcattyggcagcggagacccagatagccctgcagcacaatgattgctatgaaagaagccttcattatcctgttttgctaaaaataagtttgttttgctgtttttgatagccacgrtgttagtgaaattgttttctgtatggaaatatttcacactacacaatggaaggtcactgtccttgcagtctgcatttgtgggagtctaaagtgtttacaattaagtagagcagctcctgtttgctcttcaaaaatgggtccaaggaataggattaaaacttcaatttcattcttttccaaagaaacacagactggggccaggtgcagtggctcatgcctttaagcccagcattttgggaggccaaggcaagaggatcgcttgaggccaggaattcgagactaatctgggcattacagcgagacactgtctctataaaaatttaaaaattagccataggtgggggcaagcgcytatggtttcagctactcagaaggctaaggcaggaggatctcttgaacccaggaatttgaggctgcagtgagctatgattatgccacttccctccagcctgggtggcaaaagtgagatcctgtgttaaaaaaagaaaagaaaaaaagaaactgaactggaggccactagtatgtactccctaaattcatgattatcatggtctcggaattattatttatcatggctctgcttgaacaccaataataaatgacttatcatatattgacacataagaggttttttccagttaaaaagtttaattccaaacgtaaacctgatgtaggtatatatgtttatttgcttagcagatacttacttacacccggtatgtgctactatcactattttagatcgaaatatggcattgtttcaggctgaaatgaaaatggcttatgtggtaaaagcttattagtttaaaccctgttaatgtaaaaacctggacaaaagccacactgaagtttaccgtgtaccctggctgtgcaaataaaaatacatgactaagaacatgaatagcacaggaaggatgaacaaacgaactgacagaacatactcgttagggtactttaaaggcattcatttataaaagaacagttgacttaatcactataaattactcttctacaaaatagtgctttttaaaacccagttttattatatacaccctgaaaacaatagtacttcactaaagtattcccttagaccccccatggttcatgatgatattccagttagtctgctattaataagcgtccactaatattggaaggtttgaccctttggatctctttctgccacccagttataaatcttatcatttgataatgtcaaaaccattaaaacacccttttaaagtccaatgagcggaggagctacagagttgtgatggtggcagatgatgttttttcacagtgaaaggcacctttcactgtggaatttcactatatggaattngtagtctgatttgggatggaatccatgtctgccactttctaactcacctctggtaagtcacataacctttgtgtgcctcagtttcctcactggtgaatatggaaataacactcagatctatcctgaggattccccataaaccgcacttcacagtgtgtgacctagaatwggcactccctgtagattaacttgctttcctttcttgcttgtcttgccacatgttttcaccatcacagttatctttttggaaaacaaacatccagaatgacaacgtaaaatgaggatttctccctggacagccacatgctttatgtaacgtaaatgacctactctaattgcaggttatatmcaggcatgtagaggacttatgatcgctgctgtcagcctgggcttctttggttccatatttgcgctctttggaatgaagtgtaccaaagtcggaggctccgataaagccaaagctaaaattgcttgtttggctgggattgtattcatactgtcaggtaaatagtaactttcttccaaacaaggtacttgatgatgttaatgaaatcacactaaccatagtgctttccctctaatatttgttagggctgtgctcaatgactggatgttccctatatgcaaacaaaatcacaacggaattctttgatcctctctttgttgagcaaaagtaagtrctcttctcagtctgtttccagctcacaggaagtgtatataaattaatattctcaaccaagagacatgaatttcctatatgacttttgaaagtaagacatactgataaatggtaactgatgacatcattcaagattaaatgtgtcatatgccacatacgcaaaatatgcatttaattagtttgctagtgttgcagtgtcttgtctcgaaacagttcaaggcatcaaatttagaactataaacttcatcgtytgctgtacatcatgaaactgaggtcaagtagaggaaacgtgaaaggtgtcagacggagaggaaagaatgatgcggtgtgcgaatagaaaattaaaaccttgccttgattgttgcccactcaaaatgatatttgccagatgctagtttctgggtcttttaaatttgctgtattaactactgtcttaacaagctcctcctaataaacctttataaagaaactgtatacgatgcaaggtttttgaaaaatgctgtaggagcacggcacctttacccaaatgtggctggtcagtcttgcagatgaatgctttggaattaacagatcagtttgcttgttggtgttgtttttaaactatgggctgttgctttttatagtttccctaggcttatttctttggattgggaaaaccccagggataccaaatcagaattaatatattaaatattttgtcttacctaagaatgtatctacatccctctttaggaagcctcacgtacgtgtgtgtgtattgctatcaatgaggctggtaattttattttagacttcaggtcaaattttatagaatttttaagaagtatattactgaaatagctggtcagctgggctttactttttttctggtggttttaggaatcttcaggaaattgattttctagttctggcttaagtgtaccttacgcataaacagtaaatgcttatatcatgaaataaaatgaaaataatagctagcgcatgttgagtccccaccaggagccaagcagagcactgcaaatattattttattgtgttattttattttattcttacaaacaaccttataaagtaggtcctcttggtactctttttttaaattgaggaaagaggccaagtgatgtgttcaagggaacttggaccaaactagtaggctgattgaactgggattcaaaccaggcagttgaacttcagaacactggctcttaaaaagcatgatttctaatattccactattttgtaatttttgtgacaatatgctacatgtactgttcatcaagaggtttctttcgtcctttttttttttttttttaagagttagggcctctttctgtcactcaggctggagtgtggtggtgtgatcttagttgactgcagccttgcgcttctgcactcaagtgatcctcccacctcagccccccgagtagctgggacatatatgtgccaccacaaccagataattttttttttttttttgagatggagttttcgctcttgttgcccaagctggagtgcagtggtgcgatctcgactcactgcaacctccatctcccagggtcaagtgattctcttgcctcagcctccttagtagctgggattacaggcacgcaccaccatgcccagctaatttttttgtatttttagtagggacagggcttcaccattttggccaggctggtctcgaactcctgacctcaggtgatccacccgcctcagcctcccgaagtgctgggattacaggtgtgagccactgcgcccggccccggataatttttacattttttaacggagacaggtcttgctatgttgcccagagttgtctccagctcctgatcttcaatgatcctcctccctcagcctcccaaagcactgggattacaggcataagccaccatgcccagccttttctatacatttaaaaatagtttttattcagaaatgttattaaatgggaaagaaaaacaaattttattaaatgggttttagacctcaatataacttttttatcccctgcctataatacaaaaacatgtcctaatttattaattttctcctacttatctttcaaatgagatttgcacagatgtacatggcaggaaacattgaaataaaaaccaaggctgtatttctgaagcttagaaatattttaatgatatttaaaagaaatattgtatttaaatgatacatttttattttagggtttgatatcataaatatgcagcaaacctgtacttctcatggtttattttattaaacacatttctcactcttccgcattatcttttctatattactggttttattttcctgacaattattaaggatatctttgtctatatcttaaaaatcattggactctttcctcaaatggtcaaggctaatttgtgtacaaacaataacttaaacctatctttgcgtgactgttttctgtccttactatagctcagtcacctaattcagtgtagtgccattggaatttcttattctcttttcagattttgattaaactcagttcagtaattaggtgctatgagaggctttcctctttttcaacctcttggtgctacattggctattccattctcattagcttcttggaatttctctttctgtctctgcctacccactctctctctctctctctctctctctctctctctctctctgtctgtattctcatctgtaaaacaaagataataatagcatacctctcacagaattgctgtgagagttaagagaggagagagagagagagagagagagagatagatgtgattggcacagagcaaacaccttgtattagctcttattgtgttatattaattattattaagattgctttttaattctgtatagtatgtaagatgtggcttatctttatagatgcctttattagctcttttctgcagtggcttaaaaatataacacctacaattcaccaatttacctaatgtaattaaaagcacaagaaccaggggtcatgaaaaacagcagtgcttatccattggtaatatttacaaataacaggccctttgcatcaaggtctatagaaaatatagactataaaaaacctgatattgagaatgagttgacttcttgagattaggactttctctccttcatctctgttttccctgcagtgcctttcacaaagaaaggtcctccatgatttcaacaaaatccagttggatcaaggaattatcaaggcctgagaattgtagataccatcagattctaattacccacaatgatagaaaaggggcataaaaatgacatgacacccacaagaactcagacctcatttaaacaaaacacacttgtataaaaactaataaattaactaatatgacttcacttggtttccgtttatcaacaccttctagtagaggggataaaaactgggaagatgaataagctataaattggctatcagcacaaaatgaactgatttcctagctctcaaatgtcatctttaaagcaatattttattttggcttattctagggatagcacttctctggctagcatttgctggaatttgataattgatgcttctggttttgtttgtacatgaacttagagaggaatacgttgtagaatcaaagcttgtggcagggccagtcctagataggctgggatgtggaagatgccactataggaatgttctatgtctttggtgtcttaatcagctggcataagaattaagttccttgaggtcagaaaacgtctatgcaactgtatcttctttccctagcacagtacctagaagtgaaattcttatgtgtagacctagtcctttcagaattagcaaagaaaattgttgtctcagtggatagagggagcctcccagaggatggagcaagaaagctctcttcttcccattattatcttacattaatcttacaaaaactagctgccactaaataccatctctccctgcaggagcatgtgtgtttgggcccttaggaagcgcagtgagagacagcgacttgtcacatgttctagtttaaatttctggtgagcaaatacttgctctccaatacccaacccctaaggaaaagagtttagacctcagagcatggttttgttgttcttgctttgctgctgctcttgtttttccttcagatttgtatgccgtgttaattggatcttctttgtagatttccaggacaactctacataaggcacatcttggttgcccaagttaggaaaacacaactaagctcatgaaccaagttccctatacattcctgctatatgcaaggaactcaacaggagctttgttgatgaggaaaaaatgagtggcttctagcatggacttggagtaaagattgcagcaggcacatggcaggcagtattgcactttatgttcagtggctagttcctctaaaagtccttcctttcccaccacryatctgggaagatttttcttccgagctacaatcatttgacagaactgcaatctgtaaagagtttcatcgtgttctgctatttctctatttttcccttttgttttgctttttttcattcgagctatgactatgtttgatgactccagcatgagctcttgcagagccttgaaaactgtttttcaacttttccctttaggctgtgtcaaactaacttcctcctttttattaaaacaaaaactaacaaatctgaaaaaaaaaaaatctcctgcaagcttctagtaatgggtactccttagcatgattcaccataccaggatgttgaaatttaattacgttattcccaccattgttttgttatccaaaccactaactttctgaatgtccagctttgttttcttagataaaccattgcaagtaagaattgatcaacattaagaaacttcttttcaaatcatgcaaagttatacgacttaactgattgctctggttgaggaagtagaacagaattgttgtcttagacttattctttttttgtatatgacatttaccgttaatattttggcccagctatttttgtgttggggtcttatcatcctctaggcttatttccagacttttcaaaatcatgtcgcacttctcattcctggcatgtatttggtttctactttaggatttaagctttatataataaaatattttcaccattgtggctatttagtagttagaaataaacaactacctactttctttttttattattattatttaagttctagggtacatgtgccccacatgcaggtttgttacataggtatacatgtgccatgttggctggctgtacccatcaactcatcatttacattaggtatttctcctaatgctatccctcccccagccccccaccccctgacaggccccagtgtgtgatgttccccaccttgtgtccatgtgttctcattgttcagttcccacctatgagtgagaacatgtggtgtttggttttctgtccttgtgatagtttgctgagaatgatggtttccagcttcatccatatccctgccaaggacatgaactcatccttttttatggctgcatagtattccatggtgtatatgtgccacattttcttaatccagtccatcattgatggacatttgggtttgttccaactctttgctattgtgaatagtgccgcaataaacatacatgtgcatgtgtctttatagtagcatgatttataatcctttgggtatatacccagtaatgggatcactcagtcaaatgctatttctagttgtagatccttgaggaattgctacactgtcttccacaatgtttgaactaatttacactcccaccaacagtgtaaaagcattcctatttctccacatcctccccagaatctgttgtttcctgtctttttaatgatcgccattctaactggcatggatggtatctcattgtggttttgatttgcatttctctgatgagcagtgatgatgagcattttttcatgtgtctgttggctgcataaatgtcttcttttgagaagtgtctgttcatatcctttgcccactttttgatggggttgtttttttcttgtaaatttgtttgagttcattgtagattctggatattagccctttgtcagatgggtagattgcaaaaattttctcccattctgtaggttgcttgttcactctgatggcagtttcttttgctgtgcagaagctctttagtttaattagatctcatttgtctattttggcttttgttgccattgcttttggtgttttagtcaggaagtctttgcccatgcctatgtcctgaatggtattgcctaggttttcttctagggcttttatggttttatgtcttacatttaattctttaatccatcttgagttaatttttgtataaggtgtaaggaagggatccagtttcagcttttacatatggctagccagttttcccagcatcatttattaaatagggaattcattccccatttcttgtttttgtcaggtttgttaaagatcagatgsttgtagatgtgtggtgttatttctgaggcctctgttctgttccattggtctatatatctgttttgttattagtaccctgctgttttggttactgtagccttgtagtatagtttgaagtcaggtagcgtgatgcctccagctttgttctttttgcttaggattgtcttggctatgtgggctctcttttggtttcatatgaattttagagtagttttttccaatattgtgaagaaagtcaatggtagcttgatggggatggcactgaatctataaattaccttgggcagtatggccattttcacgatattgattcttcctatccatgagcatggagtgttcttccatttgttcatgtcctcttttattttgttgagcagtggtttgtagttctccttgaagaggtccttcacatcccttgtaagttggattcctagatattgtattctctttgaagcaattgtgaatgggagttcactcatgatttggctctctgtttgtctgttattgatgtataggaatgcttgtgatttttgcacattgattttgtatcctgaaacttggctgaagttgcttatcagcttaaggagatttggggctaagacgatggagttttctgaatatacaatcatgtcatctgcaaacagggacaatttgacttcctcttttcctaattgaataccctttatttctttctcttgcctgattgccctggccagaacttccaacactatgttgaataggagtggtgagagagggcatccttgtcttgtgccagttttcaaagggaatgcttccaggtttgcccattctgtatgatattggctgtgggtttgtcataagtagctcttattattttgagatgtgttccatcaatacgtagtttattgagagtttttagcatgaagggctgttgaattttgtcgaaggccttttttgcatctattgggataatcatgtggtttttgtcgttggttctgtttatgtgatggattacgtttattgatttgcatgtgaacaactacctactttcagtcaaattatctcattcttgttgtcaagttgaatggacactagacaatgtaagaagtaaatttctaggctatacagattttcctgggtgaggttgaaaagaatattgacctcatcaggtgaccttgtcaagatgtttaatttctctcttctatacttattataatttaatacattatggatgtttgtttatttaagtttactccattcatgagttatttggaggatgaactaatgttggtagtgatctcacatattctcagataggagattccagataagtgccaagtggtaagaacaaaatagagttcaactgttaaatattaagaaagtgttactcagtggtttcagtttgttcagaaatagtgcaggccacctcagatcaccagaattacttagatgcttttgttatgctagcatgacctaaaaatctgcttgggaactaaatatttggcgctctcttttgtttttgctgacyagtgcrtgacatcatgatttctgccagcgtgccctgctttctggtaattcagctcttacccccattgctcctctccttttcacatcctggctaacctctgatcagccttcagaacctgcattttgggyggggtgtccctgttttgggtgctccctttctacctcgtgcttccatcctaaccctactgggtggtttgcacctgcttatttattggttgttctcctaaacaagaccacaagcatctagaagtcgaaaccatgtgttactcactttggaatctcttgtagaggacccatgctccatgatccttacagcaaggatggtaaatctgcagtggtgtaggactgtctgtctgtctgcatatctcctrgaatggtaagacggagtgtgcttgtggtgatcgcttaaaggaacasggagaggcagcatggcacactgttcaagaataaggactctggatccaggctgcctgagagtaaaccctcgctctgccactttctagctgtgtaactttgaagaagttacttaccctttctgtgcccagtgcccttcatccgtagaatgaggataatacatactaggaggctgttgtcaggattaaatgagatagtatacttcaactgtttagaatcatgctagttcatagtaaacacttactaaatgctagctactatttttagggatactgaccctaatgcacagtatattaatgtatagtatattaccttatgtaatctattaaggttagccacagagaaatgtatgttgaaatgttggagacctagtagaagagacaattgttttaagacacttggctctcaagtagaaggcacgtttgaaggggacctagcatgaaactataaggcttggctgggtgcagtggctcatgcctgtaatcccagcactttgggaggccaacgtgggtggrtcatttgaggtcaggagttcaaggccagactggccaacaaggtgaaaccctgactctatgaaaaatacaaaaatgagctgggtgtggtggcaggtgcttgtagtcccagctactcaagaggctgaggcaggagaatcacttgaacctggggggtggaggttgcagtgagctgagatcgcaccactgcactccagcctgggcaacagagggagtgagactctgcctcaaaaaataaataaatagatataaaataaaataaataaggcttgtgtaatttaaaaattgttggtcacctctgtcatagcattgagttagagataagtaataatttaaagttgtcaactggatactcttggttcaattctaaaatgtgctcaggtaggttacttgaagactgaataaaatgtcagatacgccttttttttgagacggagtcttgctctgtcgcccaggctggagtgcagtggtgagatctcggctcactgcaagcaccgcctcctgggttcacgccattctcctgcctcagtctcccaagtagctgggactacaggcgcccgccaccgcgcccggctaattttttatatttttagtagagacggggtttcaccgtgttagccaggatggtctcgatctcctaatgtcagattcacttttgattgacccaagcttcttttgctgcaagtccatctgtatatttttacctcaacacaaagccacgtacacccacatccacacacggattcttgacccatgcttaccaatactggccatgccctaaggcagctcaggacagtatttgttattttaggaatttcccatcttgaagcacagccttctctgtgatgtcagtttattcagacttcaaagtctgcatgtaaacctgttattgtgcctactgtaactattatgactcggtgcctcatttctcacttacggccaagcaaaccccccaattatccacacacgaatggagatcaatggcatggatggtgctaagcaactgatttggttttgaattgaactatgtgacttttggaacatgagatgttccttttacattacagtttactttggctaacaaagattagccaacattagatttagtcctactgtggatggtttttaaatttctgtgaataattttcaagaattagtacttctgtgtagacactcactgatcactttacacactattagagaggcaggtggtggagaggagaagggtgaggttttggagtttgactcagctcagatcctggcccgggccagagtcctggcccttactctactgttatattaggtagattgcagttgtcttgactggataacagaggcaatatttcctgttctgaatgttaagaggattagagaagataacatattggggagatattggcccaaagatatgaaatttcagttagataggaggaataaaatatatacataatttaaaaatgtatatatatatacacacacacacacacacatatacgtgtgtatatatatatatatatatatatagaccagttttataactatttataaattcatttcagcattcctgattgcctaaatatgtttcctgaatttacctttggacaatttgtaacatattatgttggtgcaaaagtaattgcgtttttgtcattgcttttaatagcaaaaactgcaattacttttgcacagacctaatatatctgcttccctaattagttaatgagctaaataaaatccttgaaacatgttcattttagaaaatacaaagaaaacgtctagaaagcatccaccacagtgacacatggtaggtaatcaatcaatgttacctgttattaatatatacaatttatagaattctgaactaccctaatgaaaatcacagtgcatggaaggataatgggcatatgtctgttataatctagccacagaaaagcagtttttttgtttaggtaccccctcccaaatgtctttattttaggtttcctaaatgtaagaattctctatgaagtttccatatataagtagacacttataacttaaatttttccatcctactttagccaccatttgggaggcacctgtcactattttgcaagtcttgttggatgccttgggtaggaagtcctttggcatctgccaggcagtgggagagaacccagcagagggggaggctgagcgtctcataagagagactggaccatggcagcctcagagagatacgcaggatcagcgggcaccccacataactggggccccaaaagaatgaggcgtattttggggaaatgctgataattgctgtagaatacttatataaaaataaaatcaattcatgcagttatatagatcttagattatagattatatttaatataagacaatgcactgaagaaaaagttttatgttagaccaatagaattcaattttgaaatgttaactttgataatatatgagtgtactttctggattttaaactttgtaaaaaaacctatgtagttattttaaggtaattggaaaatgcattttggctgttactactcttgattaaaatgaggagcaggacaatatgtttgaaaaagacacaatattgaaggatgacaaaagacctggctcctagctctgtgaccttcagcaaggtcgcttcacttctctggggatcttaaaaggatgaggtgctttcgtttgttaaaaccgatcttgctttgttttgggagtggctgctctttcctttttcagctccaacatgccctgattttaattggtatcctcacctctttttgtgccggaagaaaaggcagcccgagggcattcagaaaaaaatcctgtgccctgaagctcttgagccactgagaacttaatgagccagggagagagacaactccgatctttctgaaatgacaactaaaaatatgttgcattgattgggttttttatagttataaaatcttttacttaaagtgtacataaaaggatgatggcatgacaattaagagcttcggtttgcaatcacagttatgggttttaaatcctgggtctaccatttacttggctgagacatgaaggaacaagtaatttaatctcccagagccttagtttcctcatttgtaaaatgaggatagtaatacctatctcccaggcttgtgatgaagattgaatatggtaatatttgtgaaaaaatcttagcacacaccgaaaagtcctagtacaatgagctgacagtaatagtagctattgttagctactatggacattgacttgaaccacatctgagcgtgtttgggagaaccacggtaatgtttactttgcaaaaacatgctctttttattgtttgatcacactttactgtaattatcagtttaatgtctgactatccccactagactatacaatctggatctgtgagccagggccatgtccctcttatctgccctgaacacctgattagcacaatacctggcatgtcatttctgtgtaggtaaccagaggaggttacaccagctccccatggatggcaaacctaaytcagaatagggatttgggtgccaggaagacaaaagcaggaggtgaaagtaagttgttcagcattccatttccttaggattactctaaatggctaaactacaagttgaagtatgaaatgcatcagaatcaaggtctccaggttggtgtagccctggccagctcaacatgaaatgagagccatgggcaacagcctacagcaccacatacagctgggtggagagtgacttcaccttagatctttatggtttcttctttgagaaaataataagtggttatctgtgttttaatttctgttagaagtaaatttgttccacattccttgtttctaaagccactcagtgactttattaatgtgtattgaagttatacgcgcagcttttgattagtccatcaccaagatcctctaaaaacaatgttttcctccataaatgaagttctgtcctcaacctgaaagtcatggatatggattggtccagtgtcatgtagatttgcaacctttcagaataatgaagaaactttggtattagtcataaagagggcacactctgagcaggaaggctggccgagggccaggaggatattgttcacaaaagacctgcaacagagaatctgaaatttggataatcttaccaaggtgttgaaatcagcttcttagtgttaccgaaaaggaagaaagatttccagacagagactaaataagtctcctaatcaatgtgaaagaatatgtgccttgggaacaaactggagtggatattatgttcatctctttctcaaccctgtctttcaataacacacgtcagttttttttgatatttttaaatttatttttatttttatttkgtgtgtgtgtgtgtgtgtgtgtacctctaagttctagggtacatgtgcacaacatgcaggtttgatacacaggtttacatgtgccatgttggtttgctgtacccatcaactcgtcatttacattaggtatttctcctaatgctatccctccctcctccccccacaacaggcccccgtgtgtgatgttccccaccctgtgtccaagtgatctcattgtttaattcccacttgtgagtgagaacatgtggtgtttggttttctgtccttgtgatagtttgctgagaataatgttttccagcttcatccatatccctgcaaaggacatraattcatacttttttatggctgtatagtattccatggtgtatatgtgccacattttcttaatccagtccatcattgatggacatttgggttggttccaagtctttgctattgtgaatagtgccgcaataaacatatgaacacatgtcaatttttgccagatacacacggagaggtgtgaattaaagtcactgttgagtaagtctgtgatatgtgtctttcaatagaaagaaggaaaagtctctgaaagaacaaacaagagccctcacatccaaattgttaaaaaaaaaatggggtagatgtatggtttctgaaatcatctccaaatggatactgtctattaaatgtttgtctccaacataattcacactgaaatgcaaatggaaatgattttttccttggaatagagtgaatatgtagtgacttagatatttttcaaaaagggccacgtgtggtggttcacacctgtaatctcagccctttaggaggctgaggtgggtggatcacctgaggtcaggagtgcgagaccagcttggccaacatggggaaaccctgtctctactgaaaatacaaaaattagctgggcatggtggcacacacctgtaatcccagctactcgggaggctgaggcaggagaatcgcttgaacccgggaggtggaggttgcagtgagctaagattgcaccactgcactccagcctgggtgacacagtgagattccatctcaaaaaagaaaaagatacataaaaaaggatatatttaaaaagatattaaatattaatataagccaaactcatgattcctaaatttctccagaaagtttcaatatggcttaacatagacccaattcctcatccgcctgggtaatttatcctgtgatttgtagcaatactgtgtctgtgtttgtaatgctcctttcagtgaactcattgtgccaagctatgcttatgatttctatcatcttcatcccccaactggccactattaataattagatatttatttatttgtaatcaaccatggtatctggcactggcattctattttagtgaagctcaatattttcagaaaaatctcagaccatgttttcagggcatatttacactaagagtaatattaaggtatagtttcaggagagaagatagcctaacctgtactgggaaaaaaacagagaaaaatagaaagcgttatacaattatagtcatcctataataatgtacttcatgcagaatttttcagttatgctcattcctttagttgtctgcagtaaaaagggtgccaacagacagatctgatgccatcttctaggatttccaggtgtttcaggggccaaatgacatgcacctccagtttggcaggcatgctgcttgttgtctgtgcataatctcattaaaacaacataaaagcagggctgattgcagaaatccggggcatctttttcaggtgtgtaacacaatatttaatgaaagtatcttttctgaaactcccggtcagcactcctgatttagccagctcttttttcacctgtggacttcgctgctcagttcgtgtgtgtgtgtagactgagggtgtttttcctcgcttatacaaaccctctgtctctgccattgccccttaagggaacccgctgaagtttctcagatgccaaagcacagttagtgctccagggcaggaggggcttccccctagttattctgttgcagctgttccttgccccatcagtcaccctgatgtcccaggaaaggcaacacaagagtgagtaaagaaagggtcacagagcagcatttcttgtgcacgtaactccatcccaaatgaaaatgcacaagtgggccccgtgtccctgatcaatgtgatatgtgtcttaaaatactgaggttcactaaaataggatgccagtgccaggtaccatgcatgcttgattaaaagcacgccctgcttcctgctcccctggctagtgatgggcccaccctattacaccaccctgcctgcgactcagaccacaccagaaagcctgcccatgtgcagagccagagttcagagatagtgacacttcaagtaggcaggggtgcagcaaggctcaggacgaacccaggcagcactgggtggccttgatctgataccgaagcctggcctcagctcttgaacttggctcccctgcacccygaggaaggaactaaccctgggccctgtcttgccttctcctggacctcttactttcttgcctcatctcccctatggattctgtgcaatcaaaacagaccctccgaccctggctttattttacactgaaaagcaccaagatttcttttgccttgcaatggaagtttatgggccccaaataagagttactctttataaaaacaaacaaacaaaaacctaaaatcaacctattcttctggagaaagctaaacaaacatgagaacacacatagtccctgaaattttggtgtacttttctcattccttgttctctgggtgaatatatctcccctgaaaggatttcctctagtccgctactgcaagtgatcttgttttttgtcctcagtagcactgttcatacctttgtttcgtggccttcccaggggaagtactgtcttgtttatctttgcatctgctcctgctgcggtcatcggcagagcactgtcacctgccatatgggagatccttaatagtaatttatcactaaatgatagctattgattcatttccccactagactgcagcgattagtgacgatttgcacatagcacgtgcttaataaacatttactaaattgaactaacatgaaagcaaaagcaaccttttgttttctaactaactacagtctgcctaaatgatttgcgctgcagaacagaacaaatagatggaaagcttggcaaggttaaggcagcgtgcagaggaaaggtgctggctgagtcaggagaccctggctgtgactacttttgctttgactttgcccccgtggatgccctcatctcctttcaggatgttgggatggtctaatggctataaaaacactttgggaagmgtttacagcattttacagacacaaggtgttattatttcctttacaattttcaatagcaaaaaaacataataagcatttagtaaatgttgactatcagtgttaaatactgtttactctccaaataagtgagctgtaatacttgtgtaatgctttctcacaggtatgaattaggagccgctctgtttattggatgggcaggagcctcactgtgcataattggtggtgtcatattttgcttttcaatatctgacaacaacaaaacacccaggtatgaaaaagagacaaaaatgacctgttaaaaagtagaatgctatcataaatcattacatgtggaacaaattacagatagttcatatgattcttagaaacttccaaaatccggaattggaaaaggttagcagtacagttaattttttaaagttttaccattactatattycaaagaaaattctaacgtagaaataagggtctgaatatgaggacatgttcttcacgttggcctcatcataattttcctctaggtaggcaggaatgttgatggcctctactaagtctcctagcttccaggagggtgagttttaaaacatggttttgtaagaggataactgaacaaatgaccaagtcatgagtttcttctgcagagattctccatcccactcagaaatgacactgaaaatacttcttggggcaagaggagagaagaaagctatctaagaaagaggaagatttacatttagatattggcagagacaggccgaaacagtttcttcccatttttgtttgccctatgtgtagaatagaatctaccaaactatgttttacctttcagatacacatacaacggggccacatctgtcatgtcttctcggacaaagtatcatggtggagaagattttaaaacaacaaacccttcaaaacagtttgataaaaatgcttatgtctaaaagagctcgckggcaagctgcctcttgagtttgttataaaagcgaactgttcacaaaatgatcccatcaaggccctcccataattaacactcaaaactatttttaaaatatgcatttgaagcatctgttgattgtatggatgtaagtgttcttacawagttagttatatactaatcattttctgttgtggctttctataaaaaataaacagtttatttacaggatttgtaaaatgttttctacatttatatagaacatgaaaagcatttagtaccaaaggttcaagaagtattcgtactctagcctttttaatcattcatagatagaagtctttgtacccactccttatgtttcttttcattcataaacaggtgtataaggaacaatgtcttataaacagcatgggggcaatctgagaatattcctcaaaaggtgtccaggttaaatagacatgttactggctgcacacaggcaaattctagtttgttttttttaagtattctacaacatttatttaaaaaggtaaatctttttgttgaagcagcaagttatctggtagaacttaacttctacaggatcagagaggatcttgctcattcatggccatatccacatgcccatggccactcagtagattgttgaaaaagcaaagccacaccattctctttgatgtatgcagagagttacgtagcaggggatgttctctgatttattccactggcmccattagtgaatatttagttgttttcataaacgatgctgtgatgaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccataccttgataatccttgaaatatcttttgcagaaatacaaatcaactgaaagacatgaaggtagattaggtcctacaggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaattttatacaaaaaaatgaaatgcagcagggcgcgatggctcacgcctataatcccagcactttgggaggacaagacagcggatcatttgaggtcaggagttcgagaccagtctggccaacatggtgaaacctcatctctactaaaaatacaaaaaattaagccaggcatggtggtgggcacctgtaatcccagctacttgggaggctgaggcaggagaatcgcttgaatctgggaggcggaggttgtagtgagccgagatggtgccactgcgctcaagcctgggcaacatagtgagactctgtctcaaaaaaaaaaaaaaaaaaagatacaactaaccatgtaagctaaaggaggggctcttaaaagacacagatatagtgacttaatttaaatactgcgtttacttagcaaaagttcatttccccaagctcttctgctcaggaatgaaaacatggcagacacaaaacatggaatagagacctggcttaaagtctccccttgacactttgtacttgtatggcttctggcaacttacttaataactctgtttctcacacctttaggatgaggattataacaataactacatcgcaaagttgttgtaattaaatgaattagtgcgtgttcaaaaccaaaccagaccaagtggttcaataaatatctgctgaataaataaatgaatgaacaaagtggcacatgggccatcttaggcttggtgtagttttgtagattgccgttctctgtcctaccacatgaaacttggattcggccttctgttctctgtcctactacatgaaacttggattcagccttcactaaagcttttagaaacatacatataaagtgagtatatctgcatgaaatggcccctataggaagttggaaggattcttttagagggcaggaatgggctacaagtaaaaaggatcccagggtgggtggaaacagataaagatttgttctaaccattaggacagaatgtcatatggcatagcaatcaaggccagattctccctctgtaagacccctaataagtacaaatttaactcagaattcatctctaataacacagccacagtcacagtgatgtaacagagggctttactgaaaaggttgacaaatgaaaagagatctaaaacccaacaaatcttttagttaaaaggttacttggaaacagaatatagtataaccaagttataaaaatgcaaaaaacagcttataagaactttctttcgacaatgtcattgtttaagaatgtaactaaattacttttgaggtatttcataatacatgttgggtattttaaatagtaaaaaaaaacatacatatgtgaattcagtaatggctcaaatattttctatttagtctgataaattaattggcacttaaaataactatactttattcataaaatatccaagataaagaatatgctatataaaataaccaaccatttaatagtaacatgcttacagtggctcaaagctgaatgtgacaaatgtactccaggaaaatgtatttaacattggacctagctatattctaatcctaaacttacttttttggggtgtggaggggtggagtcttgctatattgcccacgctggtcttgaactcctgtgctcaagttatcctcccacctcagcctcccaagtagctgggattaaaggtgaacaccaccacactcggattaaacttacttctatatgaaaaataaccagactaacttttaaggattagtggttccaccaattcaattttaagactactaacagaattttataatataaacgcctacgatacgacagcatacataagaaaaatattttttaaagttttagtaattcaaaccaaaacatgctgtaagtttaaaaaaaattcactaaaaaattagttgaaaaaaatacacttaacactagagtacctttctgaagaaaaaactttttatgacttcaatgacatgttatttttaagcagcagcggaagtcttaaacacctttacatgcttcgaaatactgttgatgatctgattttcaatactgtattgggtgccattaaagagaccattgttctttgaatcagtctctgtgttgctgtgggaaacacggtaaggcagaagcactagaatcatggaggcaaattactgaaacactgtgatactgaaatactgctggcttctggaataatcttctgacatgtggaattagacatctgaagtgtcgctccaatcagtcacagttactaagctgctttttaatgtgcttgattcattttcttgaagtcctgtaagtggtgggtagaggcagaagagaaggcctcaatggttaaacaagcacattgtcaagtctataaaaatccataatttcatattgtcattaatcactcagtgtctaaatctgttcatgaatcctcatctcccaaccctcatgagctatgtataggacgccactttaaaatccaactgtgaactggtcgcatctctaggatacactcaggacccttggatgcaagcttctgccctgcagcctacaaacagcagggaccacatcctgcttcccactccttccccagcattcagctcagggcctggatgttgaaggtgctcagtacatttgtgttgtagttactgactctgagtgaatagatggtaaagaaagaaggatgaaattagcaagccaagtaaagtgttaaaaacatattttctaggtagataggattaacaacgaagtcaattttaaaatgccatgattttgagccagtgaaatagagtgcagagaattccactcaagtttgactctagaaatgtgttcctccaggggcacaggtttatgatgttggaggaaagagacaggagatgtccttagggcatcctcttggccctgtaaagagtcactctaatgccaacaggtctcctggttttcaataattagagttgatgcttagcacagataactgatgccagttatgcaacagctatgttataactggacaatgtgagagaaaaggtagcgtgaaggagacaggcagcaacatcttatcttacaaaggggcgagaggctgctgaaaatggaaagagcaagggtggagacatgcaggtattaacttaaaattacagtctgggtgcagtggctgacacctgtaatcccaacagtttgggaggctggggtgggaggatcatttgagcccaggagtttgacaccagcctgggcaagctggtgagaccccatctcttaaaaaaaaaaaaaaagtaataaaattataagtaggagtacaaaaacagtgaagaaggcgtgagaggtgcggtgggtggtgaaaatgagccaagtccccatctgtctttgcaggacatcaacagttaatatctaaagtcaatgaatcaacaaagagtggtttaaggccattactgagaggcacagagctaccactaatgaaggtggtgcgatggcatagagaagccttctgaacaactcagctttcaacatgtgcaagaattactttgacaaaaaaattacaattttctaatttaaaaaaaaattactaagttattgggcttatctaggctctagattgggggatatgaaaatcatttcaagtaattatctcatagtatttcatcccactgactacaaggctacaagagaaacctcccttgggagaaaatgaagaaaaatatttaatagggaaacagactaatacagagagactgccagaagagtggtctcattcaggtatatgatcagaaattttaattcctaaaaggcatcttcatgaagagaatacgtgtatagacatttttaaaaataatataaaagctgggcatggtggtgcacatctgtagtcacagctactcaggagactgaggcagaaggattgcttgagcccaggagtttgaatccagcctaggcaacatagtgagaccccatatcctaaaaaaaataaaaaaataataataataaattttttttgagacagagtctcactcttttgccaggctggagtgcagtggcgtgatctcagctcactgcaacctccacttcccaggttcaagcaattctcctgccttagcctcccaagtagctaggactacaggcacgcaccaccatgcccaactaatttttgtatttttagcagagacagcgtttcaccatgttggccaggatggtctcaatctcttgacctcgtgatctgcccgccttggcctcccaaagtgctgggattacaggcgtgagccactgcgcctggccaaaaaaaaaaaaaaaattaaaagaatacaaacaatttgggggccacgagcggtggcccatgcctgtaatcccagcactctgggaggccgaagtgggaggactgcctcagttactggggaggctgaggtgggagggctgtttgagcctagaaggttaaggttgcagtgagccatgatggcctgggtgacaataacaccgtttcaaaaacaaaaaataaaaataaaaataaattaaaaatttaaagactaaagattagtcctataattaaataaaaataacaagtaaatatatatgaatcagtgagttatgcatatccaatccttatttaaataacataaagaaagcactgacagcttttttgtctgatgatataccagcataagttaattagatatttataaagatgaaacacaactaataagaaaatggatcgagcttgtattagaggggaaagcagcaaaccttctccctttggccccttaggattaaatgcgccccaggcatttagcacatgagcaaaatgtggttcatttttcgcaggtggaggttccttctgttctttcccagatttttttcccaaagatatctcttcctctagggatgatatgtcccagtcttcatcctccacatccgcacactaaaagaaaggcatggagaataattaatgttgcttagaaaaaaatggtgtccctcaatcattttattggttagactgagcatctaacactgaaccataaggaaagaagtggggaactattaatacttccaaatctagtcatttctgcagggcaatgaaatagatttggaagttggtattttgaaatctgaatcatctctttttcgtttctgccatggaaatatatgtttcctactctaccaatcatgaatgtagaaaattccagaaatactacactgtagcggtatgaaactctaaaagtcagggtgctccagagtaggagtgaggcttgctcttgcttcttacctctgtgataataatgacatctaactgtgggtacatcagaccaaccgaatagcccccaactgaaaggtgcacacagttctaccatgcccttcctaaagaaagatgcttttgctctctcttgaatgtcataggactttctgtcatttttggcttgtgtaacacaaatagtattaactaataaaagtaatttgacaaaatgccctggactggaggaccagtcaacacagatgagctgtgcccagaaatacaatgatagagctccatccacagaaacacttctggcgtcctggctgttagaaccactgggaaaatgtttgggcttcttctctaatgcagacagaggagcttggcctccaccctcacttcggctcccaagtggagctaaaccctcaaaagt

SEQ ID NO: 10670 - DNA, 13115 bp, Homo sapiens
gggagtctgaggcggggaaatcacctgaggttgggagttcgagaccagcctgaccaacatggagaaaccccatctctactaaaaatacaaaattagtcaagcatagaggtgcatgcctgtaatcccagctactcaggaggctgaggcaggggaatagcttgaacctgggaggcagaggttgtggtgagccgagatcatgccattgcactccagcctgggcaacaagagtgaaattccatctcaaaaaaaaaaaaaaattagccaggcgtggtggcgggcacctgtaatcccagctacttgggaggctgaggcaggagaacagcttgaacccagaaggtggaggttgcagtgagccaagattgtgccattgcactccagcccgtgcaacaagagcaaaactccatctcaaaaaaaaaaaaaaaaaaaaaaaaaaaaagtagagctacttcaggaaaactcaggctataacagtaagaactaagataagcaaaacaactgaatatggggggaaaatcacaagaagaaatgggagaaaatctgtttgtttgttttatttattttctttttgtttgttttgttttgtttgaggcagggtcttggtctgttgcccaggctggagtacagtggcacgatctcagctcactgcaacctccagctcagcaggccaagcaattctcctgcctcagcctcccgagtagctgggattacaggcacctgccaccacactggctacccctttttgtatttttagtagagatggggtttcaccatgttgcccaggatcatctcaaactcctgacctcaggcgatccacccgccttcggcctctcaaagtgctgggattataggcatgagccaccacgccggcctcaatccttctacttttaagctatttctgtctttatattaatatgagtttcttgtctatagtatataaatgggcattgctttttttaaaatccaatttggcaacatctgcctttggatatttggggcatttgtatgtaacgtgaatactgatgtgactgtttaagtctataacttatttgtttctatttttcttcttgttccagctgttctttgatcttttttctctttttaagccttctattggatttagtattttttatgattcttccttcaggactttgctccaatgtacctttctcagtgaaactaaatttttgcctaatttatcatttttgacattacaagtattcccatttttcttccatttctacttggaacttgttattggctaacatgtttaacatttgtatctaggccaggtgtggtggctcacgcctgtaatcccaacactttgggaggcggaggcaggaagattacctggggtcaggagttcgagatcagcttggccaacatggtaaaaccccgtctctactaaaaatacaaaaattagccaggcttggtggccggcgcctataaactcagctactcaggagcctgagacatgagaattgcttgaacccaggaggtggaggttgcagtgagcmgagatcacattattgcactccagccagggcgacagagcgagactccatctcaaaaaataaataaaaataaataaataaataaatgtgtatctaattacctgttagctagtgactttttaaatttttttcacttttttagaaatggagtctttctatgttggccaggttggtcttgaactcctggcctcaagcaawcctccttccttggcatgagccactgcacccagcctagtgactttcatataattctgtattcaagttaaatatgttgatgtagtatctccaagaagttggggagtgtttttgttttggtttttctttttgagccagggtctgtctctgttgcctgggctggcgtgatcactgttcaccacaccattgacctcctgggctcaggtgattcttccgagtagccaggactacacgcataggccaccatacccagctaattttttcatattttttttttgtagagacaggattttgccatattgcccaggctggtctcaaactcctggcctcaagcgatcctctcacctcatcctcccaaagtgctgggataacaggagtaagccaccactcctggcctccagtaagtttcttattgttgaagtagccatactttctttgatataaaccctacttggtcagtcatttattcagtgaatatatattgagcatgtgctgctacagtgttggaaagattgttgtgaacaaaattactactttcatggagaggatattctaatagaacatcctgtatttattcgttggtataatcctcgatgtagtctccctatattttttgtgattttcatttgttgtgttacaagattttgttattaggtgtactttctcaaagctgtttatatttttgttttattaccttgcttccttattaatgccagctttagatttaatcacttttatgaccagttgcaacaaactgcttttagttttacacttagctttgctccttattatgttttaattatattcatgattttatcctaaccttgtcctgctttgctttttttccagtttctttgagcaaatatataattcataattattttcagtttagttttaaaaataagttacactattctgcaataaatttacttgttgccctaaagttgtcatgtattctccttacaatttattccagataattaataatttggattttgatatttatcttaagtccaaagttttatttaagggatgatttcttttatgattatatatcataagtaatttatctatttagttttaaagctcacaattaaggatgtaatatcttgaaattctttttttttttgagacagggtcttgctctatcacccaggctggagtgcagtggagccatcttggctcactccaaactccgcctccctgtttaagcaattctcctgcctcagcctgagtagttgggactacaggcgcctgccaccatgcccggctaatttttttttttttttttttttttttttgtattttggtagaggcggagttttgccaagttggccaggctggtctcgaactcctgacctcaggtgatccacccacctcggcctcccaaaatgctgggaatacaggtgagggccactgcgcccggcctcaaaattctacttctaacaaatttctactttttagtattaaaaatgttcgggccgggcacagtgactcacgcctgtaatcccagtactttgggaggcccaggctgggggatcacctgaagtcggaagatggacaccatcctggctaacacagtgaaaccctcatctctactaaaaatacaaaaaattagccaggcgtggtggcacatgcctgtaatcccagctactccgaaggctgaggcaggcgaatttcctgaacccgggaggcggagtctgcagtgagcggagattgcgccattgcactccagcctgggcaacaagagcaaaactccatctcaaaaaaaaaaaagaaaaaaatgtttctgggccgggcacggtggctcacgcctgtaatcccagcactttgggaggcggaggcaggcagatcacgaggtcaggaaatcgagaccatcctggctaatacgatggaaccccatctcatttaaaaacacaaaaaattagccaggcatggtcgcacgcgtctgtaatcccaactaatcaggaggctgaggcaggagaatcgcttgatcctggaaggcggaggttgcagtgagctgagatcgtgccactgcactccagcctgggtgatagagcaagactctgcttcaaaaaaaaaaaaaaaaaaaattcttagtgactagaatatgatctaatgatgaaaaatgagtgatgaaaaatttgttgacctagatcccataataggcatggcacttaatctttttacttcagttttattttgggaaaacaatgatatctatgttacacgtttgttgttgagattagattttataagtttaagatatttagaaaaccatctgacacagaataaataccactgaattttaggtatgattatctcttcaatctttgcaatttttccttgaagagtaaaatattccattgggtagaatacaggctagctggctatctttccttatttttaatctctttgatctgtcataagctgaaagaggtttcttgcctctcttaatagttttctataaccaaggtagcagctgcttttgtatttggctatataaaaagatggcttttatcctcttgcctaattttgctatttaccattgtgtgatatctattttcataccattacgggtacaagttccactttgatataaataaaggtgctcttatttgccttttaattgcttttgccaaaaatattttgcccatttctttgctttccttccttcatctcttttagactttttttttttttgagaaggagtttcactcttgttgcccaggctgtagtgcaatggcgcaatctcggctcaccgcaacctccgcctcccaggttcaagcgattctcctgcctcagcctcccgagtagctgggattacaagcatgcaccaccaagccaggctaattttgtatttttagtggagacgaagtttttccatgttggtcaggctggtctcgaactcccaacctcaggtgatccgcaccctcctcggcctcctaaagtgctgggattacaggtgtgagccaccctgcccaggcttttagatttcttaaaagcatgtttttaagaaacaatatggctgcattttggttttttaaaccagtataatagtctgtcttggataagaaattcagccattcatattttttgtaatgtgtgtattttggttttgctctgaatcttggtttatcaactattatattaatgttggaacataacatatccatttcaatttataccattaatcacactttctcagttcctttacctcttctggtttgttcagaaaagaaaggtctgaaatgtgaaatagaattacaggcacaaatgccagagagtgtaactgcgaactgtctayactaccccataaatacagcctaaatggggaaaaaaaatgatttactgaaatagtctgaagatgcacttgatttcttcctccagatactctacattttatccctgtatcaagcagcaacaccagaaaatggcctagagcagtgctgtccaatttggtagccactagccacatgtggcaactaagcacttaaaatgttactatgtgacttatgaaatatattttaattatatttcaatatccacatatggctagtggttactctactaatctacataccacactagactacaatattttgattctctgaaaacctatattcactgagttttctcatagctcttgagtcctttgttcccactgaagaactactgaaagaggttgaatttctaagttattggaaggttgtacacttcatcgcccatacagagtgcaaaaagagaacaattttagactcattgccaggaagtcttcatgccccattcataatcaatatggtttttctttatggaaatgtaaatcatgtgacagatgtctgcattgtgcaatggctatcaaaaagattcaaatttacagctcaattttgataactatgaaagaccataaaacttgtacttacctatgtattaaatcatgctatcagtctgctattgtctattttcctgttgatttctatatttccattctaatgagccttaaaagcctcatacattgcattataaataaagctgataataacaactaaacaactcacctgggatctgttcattttctactgatcttggaaaaatgtgaagagtaaaggtaatgctgggaaagaggaggtaagaataaagttaggagaaatctggcccgccttgctgctcctggatccaacttcctaaaatgctacacagaagagaccatttgaacaatgtggagacatctctatgaccagattgtgttgagcttagacatgcaatttttcactgggtgaaagtaaacacatgtatcccaatgattaacaatttatgtcgctaagacacaaaaaaatttaaaatacaaacaattcataaatgacaggatcctaatatagaaagtgtcttcattaaaattgatgtggtaggaaacactcatgttgtgctgtttatctgttttcctatgaatataatactgggaatattgttgaacaattcacagaaactctaaaaaatagaatgaatgcttcagtacaagatttttttaaatatttgttctaatttgattacagtttcacaatcttttgataagacttgtttcagctatgcaaaggaataaagaaatcacgaaactttttttttttgaaacagtcttgctccgtcgcccaggctggcatgcagtggcatgatctcggctcactgcaacctccacctcccaggttcaagcagttctcctgcctcagcctctcgagtagctgagattataggtgcccgccatcatgcccagctaattttttgtattttagtagagacagggtttccccatgttggccaggctggtctcgaactcctgacctcaggtgatccacctgccttggcctcccagagtgctgggattacaggtgtgagccaccgcgcctggaccaaattcttatcttgatcagtaacaaaggagtgacctgtaataattcattgattctctcaggctccatacattttatctttcaaatgaggcagaaatagttaaatactgtatactctacctgcactaccatcttgtgattctaaggtgagaataaaggccgggtgtggtggctcatgcctgtaatcccagcactttggggggccaaagcaggtggatcacctgaggtcaggagttcaagaccagcctcgccaacatggcgaaaccctgtctctactaaaaatacaaaaattagctgggcctggtggcacacacctgtaatcccagctactcaggaggctgaggcagaagaatcacttgaagccaggagatggaggttgcagggaggcggacgttgcagtgagccgagatcatgccactgcactccagccttggcaacagagtgagactccatctcaaaaaggataataaataaaaataaaataaaatatcaattattggtcaggcatggtggttcacacctgtaatcccagcaatttgggaggccaaggcaggcagatcacttgaggtcaggagttccagaccaccctggccaacatagtgaaaatctgtctttacaaaaaatacaaaaattagctgagcatggtgacacatgcctgtagtcccagctacttgggaggctgaggcacaagaatcacttgaacccgggaggaggaggttgcagtgaactgagattgtgcacctgcactccagcctgggcaacagagtgagattctgattcaaaaaaaaagaagggctgggcatggtggctgtaatcccaacactttggcaggccaaggcgggtggacacctgaggtcgggagttcaagagcagcctgaccaacatggtgaaaccccgtctctactaaaaatacaaaattagccgggcatggtggcgcatgcctgtaatcccagctacttgggaagctgaggcaggagaattgcttgaatccaggagacagaggttgcggtgagccaagatcacgccattgcactccagcctgggcaataagagcgaaactctgtctcaaaaaagtaacaacaagaaaagaaaagaaaagaagataaaatatcaattatttgctgttcaatgaaatatcacttctaggcaaaagatttctcatctttattgggtgttctcaccccaacctgggttgtttctgctatggaacgagtccaagaaggtgaaggtttctgagccttcaggatgttgacaagggtttcctctatgttgtctctctgacatttagtgaagttgggattctggtaaaagctttcattatattcatagggttgctcccttgtgtgtgttctctgatgtgttgtgagggatgacttctggtagaaggttttcccacattcactacatgcatagggtttctctcctgtgtgggttctctgatgtactgtgagggatgacttgtggtagaacattttctcacattcattacattcatagggtttctcccctgtgtgaattctctgatgttctctaagttttgacttcacagagaaggatttttgacattcattgcattcaaagggtctctctcctgtgtgagttcactgatgattaatgaagtttggcttctgggagaaagttttcccacattccttacactcatagggtttctcgccagtatgtatcctctgatgtacttttagagctgacctatcaccaaaggctttctgacattcattacatccatagggtttctctcctgtgtgtgttctctgatgtacatgaagatttgacttctcacagaagttttttccacattcattacattcataggttttgtcccgtgtgtgttctttgatgtactgcaaggcatgacctatatccaaaagttttcccacattcagtgcattcatagggtttctctcctctgtgtatcctctgctgtaggataaaagaggatttatggctgaaggttttcccacattcactacattcatagagtttttcttctgtatctgttttctgatatacagaatgctttggcttacagcaaaatgtactagcatactgattaattttataggcattctttcctatatgtgtttcttgatgttgagtgaaatttggcttcttgcagaatacttccaaatgtctactacagtcaagttttctctcctctgtaactttgtagaatgaggagtgatttcttgccaaaactattctcactcgcattacactcatagtatttcatctccataaccctgtggtgtttatttacaggtggcctctcaccagacctcctctcacattcattgaattcatggtgactcttccttatgtgagttctctgatgaacaatgaatattggtctatcggaaaaggctctcacatgttcattatattcacagggtctcccatgagcacactctcttatgggtactgcaggctgcctcttcatgaaaagccttcccacactgattgtattcaaaacactgcttaagagtttgaatatactgatgcctaaataagtcctcattctgagagacggctttcccatttccatcatattccaaaggtttccctctggcataaggattctcacgcttcatacagaggagaaatttcccacgtacattacactcagcagggttccttacaaaggagcttctattactaataattaattctgaaatattattcaaattcattccagatgagtcacagttgccacgtatttttcttgatagaatggggtttgtgtcaagagaaaatgtttttcctaatacaccatttctgtccatagtcagtgttttattgttgacaaaatcaactttctgcaaatgctggtcttgattttcctgtctcttctccatcaggtcatcatctatgcagcagtctagaaataataataagttatcacagattataaatgttaacatatttttcatgaaaaagagacatattcacatgctttttttttctttttttttttggcacagtgtctggctctgtcacccaggctggattgtgcagtggtgtgatcatggctcactgcagcctcaacctcccaggctcaggtgatgctcccacctcagcttctcgagtaaatgggattacaagtatgtaccaccatgcctggctaattttttgtattttttgtagagatggagttttttgccttgttactcaggctggtgtcaaactcctgttgcccaggctgtaatgcagtggcagcatcacagctcactgcagccttgacctcctgggctcaagaaatccacctgcctcggctcccaaagtgctgagattacaggcatgagacactgcacccggcccaggctgttcttataacaggatcatatgcatacctttattcatctagaatatcatcatctaactcatagtctgagatttcacttatgygatcaattatactgtaattattagagtctacagtggttctgcttcatcttctgatttgcctaataattgtgaagagtcttcctcttgtcaattttctactctttgcaattaatggaagaaaataaaagctctgaactctcaactgtgcccattgaattattaaaaaaaaaaaagagagagagagagaggtgggcgcagtggctcacgcctgtaatcccagcactttggaaggccaaggaaggtggatcacctgaagtcaagcgttccagaccagcctggccaacatggcaaaaccccatctctactaaaaatacaaaaattagccaggtgtggtggtgtgcatctgtaatcccagctactcgggaggctgaggcaggagaatcgcttgaacccgtgaggcagaggttgcagtgagccgagatcatgccactgcattccagcctgggtgacagagtaagactccatttcaaaaaataaaaaaataataataaaaagtggccaggtgcggtggctcacgcttgtaatcccagcactttgggaggctgatgggggtggatcacgaggtcaggagctcgagaccagcctggccaacatggtgaaaccctgtctctactcaaaatacaaaaatgagctgggtgtggtggtgcgcacctgtaatcccagctactcaggaggctgcagcaggagaatggcttgaacctgggaggtggagcttgcagtgagcctagattgtgccactgcactccagcctgggcaagagagcaagactccatctcaaaaaaaagaaaagaaagaaaagaaaagaaaagaaaagaaagaaggaaggaaggaaggaagcaaggaagaaagaaagaaaagaaagaaagaaagaaagaaagaaagaaagaaagaaagaaagaaagaaagaaagaaagaaagaaagaaagaaagagagtcaggtgcagtggttcacacctgtaatcccagcactttgggaggccgaggcaggaggatcacctgaggtcaggagtttgaaaccagccttgccaacacggcaaaccccgtctctagtaacaatacaaaaaaataaaaaatagccaggacacagtggtgggtgcctgtagtcccagctactcgggtggctgaggcagtagagtcacttgaacccgagaggcggaggttgcagtgagatgagatcacaccactccagtccagcctgggcaacagagtgagactccatctcaaaatgaaatgaataaataaaataaaaacaacaaaaaaaagaaagaaactacaaataaggtttctccaggcttcttttatatttttgtcacaagtaatgcttcaagcagctcaataagaaaattgaaggatgatgtaatagtgacagtgttctttactattctattatccttacaagcaattccatcattcttttctattttagtttattttaccacagttggacataattgatgagtaatgttgaaataattgctaagaaataacataccaaaatgtttcaaacttaagaaaaatagatcactaaaatagtatcatgcttcttagattataaatgggaccaattcactcaaatgataacagcaaaaacagaatgagtttcattcaattaaaaaataaaagtaggccaggtacagtggatcaagcctctaaaccagcactctgggaggcagaggtggaagaattgcttaaggtcaggagttcaagaccagtctgagcaacacagcaagacctcatcagtacaaatttatatatatatacacacatatatatgtgtatatatgtgtgtatatatatatacacacatacatacatacatatattcacacacacacacaaatatatatatatataaattttctctttgtttatctaagttagaaaaaaaatttttttgagataggatcaaaagagatcggctactgcactccagcctggaagacaaagcgagactccatctcattaaaaaaaaaaagaaaaaagaaaaaagaactgcatcaaaaataaactcaaaagctaaatttgggtccactgagaggtaacattctattttgtttattatttggaccatatatcatttatattccttttatattctaaggtttcatgttcacatttcatatatgattctcaaactccatatagcttgatttttgttttgtttttacagacaggctcttactctgtcatccagactggaatgcagtggcatgatcatagctcactgcagcttcaaactcctgggctcaagcgatcctcccacttcagcctcccaaaactgagactactggtgtatgaccatgcctggctaattttttttttatttatttttgagacagagtttcgctctcgttgcccaagctggagtgcaatggcgcaatctcagcttaccacaacctccccctcctgggttcaagtgattctcctgcctcagcctcccgagtagcgggattacaggcatgtgccaccacgcccggctaattttgtatttttagtagagaaggggtttttccatgttggtcaggctggtctcgaactctcaacctcaggtgatccacacgccttggccttccaaagtgctgggattctaggcatgagccaccgcgcctggcctaattttttattttttgtacagatgggtcctcattgtgctgcctgggctggtctcaaactcttgacctcaagcaatcctcttgggttggtctcccgaagtgctgggattacagcagtgagccactgcactgagcctatataacttggtttttgaaaatccaatttgacaatatccatcttttaataagatggtttagcccctttaactgtattatgatttctaaaatatctggattggttttctctttttcacttaagagtttccagtttttctaatttttacctgcctttccccactttttcattttttttttttcttttcgagatggagtctcgctcttgtcacccaggctgaagtacaatagtgcgatctctgctcactccaacgtctgctgccccagttcaagcttctcctgcctcagcttcctgaatagctgggattacaggcatccgccaccacacccggcty

SEQ ID NO: 10671 - DNA, 13946 bp, Homo sapiens
  misc_feature (1)...(13946): n = A,T,C or G, or insertion/deletion polymorphism (see Tables 1-2)
aaaaagtttacagagtctccattatttaaagatatttttggtaaatcagtcatctcatttaggctcaattacatgtagggattcccaactgctaaccctatataatatataattttattgtaaattcaaatagaaatgataaacattcaacatcaacttgaatttcttaacatttccttgccttccacgcttctggcaggctagtgaaacatataaaacattttccagaatagttgttctgtaaaataaaatacatataattacaagggaaaattattttattagaacaatggtgaatatatgaaaaagctataatataagcatatgtttgttattacacattacataatattgtgatgagtactcaactttttgagtattggtgataaattatgtatatgcagatttaaaaagaagtgtactgtgagttaaaaatatctgtgctttatcttggtgaaaaaaaattacatgtaaggccaatgctgttgtagtttgtggtcctcatttgcagtggagtgaagcctatatttcattaagagattgaatgccatttttatctgatccaaattcacagatacattgaattttctttggatgcatgtgaatcacaagtgaaaaatatctgagggtctaaatttttttagtagagaagcgaaacacaatataatctaataaaatgctagcattgccaaagttagaaatatcacaaattttagtcttatctaggtgactagcaatgtaatcaactcaagcttcttcatttattcgaaatatagtgtcatcatttgaaaatgaaaattttaagtcatccagtaattttgaaattgttcatgtaagaaggcccccctcttttaatgttcactctttatcttgctttgtatattgctcttgaggaatcagatgccaacctaattctctctcctttgtcaaatgatggtttttttgcttcgatgtgcaggtgacttttttattataaaagtctatgaattttgagggagtgtctaagggttgatgattcccaaccaatttccccagatcactaggtactcttctagtaggttaatccatgttttttttttttacgttctaaaaaatttcctcaaattacaattttaaaattagttttattacattgtggagtataggggggttacactgtacctatgttccttcttctgtctctagcttctctatcactttctctttgactatctttgtcccttttttggctattctttttatctgcttaatatcctctgttctgttgaatattacattcttaagcaaatgaaaatatatttcatattactgggaaagtttcttccttgtccacaatttcttgagtacaatcaactcttattttgtattatatcttcttgttttttttccatatctattttcagttttgggatttcttaaggatacattctttggtaattgtgtgtgtgtgtgttctgtaaattttgttttgttttccttgtggggggttagtttttgtctgcaaatgaaaacactttctagtttattcacacagaagcatcatgtaaatgctgattgatttacatttattattaaatgtgtgaattgactttgaagaaaaataacatagttttttacagatgaggttactgaaatctctaaaaaacaaagtgtgttctggaaacagaggaggtttttcatcgtgtcttctcatcctctaacatccttgttttccaaattccttgaatcccagaacatgcttccttctttcccttcccttttaagcttccacatgatgccttccctctctgagcaaacttctctgggcatcattttctttcttggaaacaatgtcttccaagatgacaacctctggcctcaactaatttcagataattgtattcaatttctccctattcagggttctgatctataaagtcccagatcttttctcaaagtgaactctcatcttttgattatgaatttttaatagctacatactcaatgcattatttttctttacataaaatctttatcagttcctgtgtcagctctaaactggtgtctcctagtcttgaatttttattccctcactaacatattaattggagtttgttgtaatatctattagatgtgctttaggcatggttatgtctagaagggaaccatttaatattgattgtacaaaatgtcatgagtcatgttctcaggtggcagaaatttgtataaaagaagtttgttaggaattatggaaaagaggcaaggaatgagaaccatgccaaaggggaagttgagctgtgatgtagtcacaagaatggactcagtcaactctattgggtatctgaagctaggataaccctgtagaggtgtcaagagttggaatgactggagacagataagttggatatgagtctacctggggaagaaaaagaccttgtaaggcagttccctttagtgaagaccattttctcagagggtatgacagttgaaagaaagcttcaaatgtacatattgtgcaaactacaaagtatatatattccaattattatttatttatgatctggataaattacctttgtgaacccactttgtctaacagtccttaaaatgtgaaaatgccactttttctagtatatggttccctgaatcaatgaagtccttttagtaaagatcactgaaatcattatcatgtgcatttgttttggtgttacaatatctttcctcccagactattcttccctcagtgagtttagagtcttagaactgattcacgttccaatactgggaaaggaatagtagatctgacattgcaccagctgtctcaagtctcttaactattcatctataatttattttgtttgtctaaatttagcaatagcattgttgggtatccaactatctagcttctagagacattgtgttctactagccaaacataactttctgtgggtcaagcctcctatgaacaggccattcattttggctcatgaacaattaagtactgtaattggaactgccttgattttctagggagtggtgtgaggaagggtcctttaatcccgttcactactagtcatctcagttctaagatgatttcacttacagtaagcctgatacagcaaagagccaatgcgaatcttagtgatgatggtgttcctttcactaccatattccctgtatttttgaaaagtggtgcatcctattggttctcccatggaacatgagaagaaacctgagaacacgaaacgagggtaaaaattccttgcatagaaagaagcactctcttttcaaccttgcgtagactatctgctctaggattcctatttctctaaggcacttagcaccttctttcccagcctgccatggaaattctaacatttcttctttgcttattgtgggccattgctttgttcatgcttccaggtgcatatcattagtgtgtttgtacaatcttagagggatatttactcctatattccaggacagtgctccgaaaacataaacaaatctttattcaattttatactttacccctcttttcaaacaccctcagattccaaccccatgtgtattctcctataatttgttggttcatgctgggtaggttctgcagctcctttggggcattatcttttttgttctctgtcagccccagaacagcctcaggtagtttatattgtgatataaccctagttgtagtggctagaagaaaagttaggggagatcttcaaggggggtattcttgcagtgtagtgccttctgtgttgcttttaaggaaggatgtgctcaactttcatagggaagagtgggccacctctgcaggctcaaggaatttatgaaaacctagatattccaagattttgtggtaaacaaacttgacttaacagatctgcattggattggagttgtacattctttagagtttgactacttttgcagttaagacctggacctgttccttagctttttctgccctcttcgagcctctttgcatactatctaggtggacctctaactttcacaactggcttttaattgccaattagcagtttgttttagatgtgtttgttgagccattcagtcccacttgtaatattagaccagatagaatattgttttcaaccactataacataacaatataccagtagtaaaagatttttacacttggattgctaccctgtaccattagctgtctgtctgaacctaccatcagctatggagtactcattgcaggccttttggtaagtcattcaactctaaaatgccattccaacatctgctttttgtgccattcctggtgccaactatgtaagctgggttttctggawtgcaaatgccaggatggagattaatactcaggaggattgttaaggagtagttttctggatagaagaaataaatcatatttaggtaggaaattgagagcgatatagtctcaacaagtctccaatgattgcatgggacattctaaaactgggatgaacaatccatgttcttctgaattgagttaatcaattttcaatattgatcaaataccatagtaaagctaaatcagtgagtgtgaccttgggtgaggttgcttccaactatagggagtactgaaagttgaagtttctctgccagtagcactccctgaagaaatggaataaaccttatatgcctaaagaagaatctggtggggcagcattttaatgtaaaaaacctcctgactttaatttaatagaagctctattataataactataggttgagagaacatttatgaagaatgtaagtattaaattagtaactcctaaacttatttaatattacagttaacagcaactgtgtatacttgaaacaatattatctatatacatatatttttctgtgtcataaggcatatccattatttaatctacaaactaggtctggaaaaaatgtagatttgtagacccttgatcattccacacctctaggggctgaacactcataaactacaggctctaaaacagactatttcctgaaacttctgcctctgaaattcagtaactataacttgggtggattcctcaattatcttttttttattaatataggacattacacaaaggtgtctacaaaaattctgtaaaaaatcagtaataacaaaaggcctacatatttatttttatgaacagttgtaaaatctgcacaatacttagcataatttttaactttgatatttcagcaattgttacaattttgaaaacaacacactgacattttattatgacttcagagttataagtaaaagagtttagctgatttgttatctgattaaatcttggtatggagaataaaacagtaattttataattcatatttacttttacaaatgtcacagctccaagttcaacctgaaatcattaaaaatttgttatctaaaatgtttcttaaaaacaagtgaaaggggaaaataattaacaaaaataaagtgacaatatgtgaagtataatgagagatgtaactatcaatcctgactgctgaacagaaacgtggtatctcagaatattaactatactgatattcagtgtaatccttttattagaggtgtgcatacttttctggtataaatgacatctttataaaattccttatgactttcaccaatttaatacagggaattttgaggtatttaataatctcaaacaaatgtatcttctttgatagtaaaggggaatgtgaagaggtgggcaaatgttaaaacacactttataatttcagcatgtagtactatttcaatcattataatgtaaaaataatttatatatatttaagatcttaaagaattgattatccttatgtactctgcagtgttacagcaacatagctgtagacatggtatgaaaatgacagctattttatttgagtcaaaaggttataacatttaaakctgggtctcttctgagtaatttgcaaaataggttrctataaatacgtgatgacatttcatgtggtacacagttattttggggaacttagtattatataataagcatatgatcagatttgcaatgtgtagcatcattgacrttttactttcctttgaaaaaggaaacaatgcctgtttcccaagtccaaattataaccccttcacatggatgtttttcctggtttcatgtcctaactacacctatgaggtatgttatttatgtatgtaaatgcttgaatcctattcatgatatactaaatgcatgtgcttatgtatttacatgtattataaattaatatatacaggaaaaatatagaggtcttatccacagatcatggtataacaaaatagaacatttcaatcacaattttttcaaatattaaacaatgtctttcattttcttataaatatgatcccatttwatgagattgcttatgactttatatgtaaaaattaaattattatttcttgaaaatgtattcctatctataagttttctaatattttaagccttaaaattrcctgttaaagccacaaatgaacaaattactagattccatttatgtatgtgctaatttaagttttaatataacagattggatcatggattagtttcacagtcatgacacaaacactgccaggtaagacctagatatactgataattaatcaaaataaatgcatctttargataaatggtytctgagaaaaagttattatagtactaaagtatagcatgattgtaaaaggatttcatagtttcatactgagtttgatttttagcagtattaaaatatattgaagtacttttgctctttgtctctgtataattgttgcttaatccaagccagggattgtaatccaaatgtatttattaagcaatgaagttttgtttagaagaagttttgataacaacgcatttcgcttgaaacttcttgtgcatgtgcacaggcatgtgtatgtgttttgtcttcaaaggaagagttgggktgtatgagagttcatcttgaatactgagcattttaacacacactaagaagttgaattgcatgatttccatatagtagaagggacatatgtaatgtccattttatccattttgttatattgtacaaaagttttgaatcacaattaatgtggtttattatattatgtgcatgtagaggaatattatatgcatacaggcaactattattgaaaatttttaagtacaaaaataaatccttatttgggaatattttgtggcagtggtatataaaatatgtagattcatttttaatttttaatgtattttctgtgtttactcattcatgcgatattgattggctattgcttgggaatgggtatgaataatgaaaattgataagaaattatgcaacatttgagaaacatcttaaaagctaaacatgctagggatccttttcctaatataacttatttcatagaamtaagaaagaaataataattatttcttttttcttctagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaatctgattaaaaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctagagagagccatgattaaaccaaggcactccagcctgggtgacagagtgagactgtctcaaaataaaataaaaataacatattggtgaagatgcggggaaaaaaaaagaactcttagacactgctggtgggaatgtaaactagagcagccatgtggagaacaacatggagtttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaaccgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgtggaaattatagctacattaaaagtgtaacatttttatttagttgtgtacttatttgttaataatacagacattgtatgttatcatactgcaatttacaattaaaatattttctgtagattatttgaaaatcattctgaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgtatgcacttgcaaagcaaaagtacattggtaatttgggcacattcagagtggaaaaaatttgttctatttttacatctttaaatacctatcttctatgaaagcctatgtgcatgtgtgtgtgtgtatgagtttctatgtgagcatgcatatatacttcacaaagagatgacctatataaatcaaagtacacattatttaaaatatttaaaagaaattttcagtttcttcatttttaaattgtgatttttagatttgttagtctatggagcattttcaattctcagattatacatatgtaataaaatatgttcattaaagctcttagattatatgcatatatgacaatatatacatatacgactatatacacatatacaactatatatatgtgacaatatattgtaaagcaggtctatatacactgggtaggggctgtttattactaacatatgtggccactaaagaaataacaaaaagcccttttaaaagccttataattcccaaagcatactattaaaatttctaaggagaaaacaataacaacaataaaattctcactccctaatatctattcagctaaattgtatgatatcatttaatgatcttaaaaagaaatgtcaatgcagtaaatcatatatacctaatgcagctatatgatcaactacttgtgataaatgtcccttttttgaaagactaagaatagtttctgtttttgtaactcgatcctgacaaatagtaacctaggaagtttgcacattcttgtaggactagaagaaggactttaagtatggggtacctatatgacagacattttttttcccattatactacactcccttatgccagttgctccatcatactttttttgtatcagttattcccttactgttggcagacatacattagttaaaggatatcttaattatgaaatgtgttttttaaatttatttctcatttttatttccaggtggtctcactgcctaagacatcaaaagaaaaagcctgacaaatttacaccatcttgttatcaatattaatgctacaggtataatcctgtagcagccatgtacacatttttagcctttaaaacctaaccttcatttacaggttttaggagttactatacataagtatgtacacatatgcatatgtatatgggtatgtgtgtaaatgtgcacacttacaaactttaatgatactctaaattaatatataagatttatgtaaataataagtttgcattgctggctaaaatattgtgcatttattttaatataaaacaaatctatataatctcacatattcatggttttttgccacatatctaagtaacttaattttagcttatggagtattttgcaggagcagcattcaacactgcatagattagttgtaagtgtctcaattacatttacatatcagtgtgtttggtggggaaagaagatgaaaaataaaacatttgaatataaaattaaaataaataaaatatgacatttatttatgatagatgtcataatttgatcatattcataggaaaaacattaatgaaaaatttaaatgcagaaaaatatatacacacattatacaaattaacaataacattactaccacagttacttattgaagtaatatgctgtcttaaatatgtttcattataccatgttctctcagagttaacactctcatcctataaataaaagatatattctcaaattctaaaattcttgtgtgtgtattttcaacagttgttatttttasgtcaagaaaaatattatganaatattagcaactgttaaattctatgctttgagatgtataggcctcatttctaatttaataaggtatgtatatatttgatattttcataaaagcaatacagggtttggccaagaagttttgccgtctgtgaaaggcatgcatttgatgctattataagccatattaactggagaacatttctaaaatacctccatttcacatgcaaattttatactctatatattgatggatttgtttatgagattgagattcagatgtagcaattggtgagagaggaaacagttacaaggcagcctctactttttagatagttcgcttgtttaagagacaaaacaagttcaactttaattgaaatattgcatatttgcttgcttaattactgttaaaccttaaattaaatattctttataataagcatgtcttcgaacatgaaataaaattaacaagtctgagagtgaaacttttcccattatgagagacattttagtcagcctcatcacaagaagacttttgctttcctcaaaccatcccatatttctttttgacacttgaaagtatgcctctgcttcctgtatttcttttaaacattctggagcttttgttgttttgttgtaactgttgccaaatttataattgttagatgacaaatgtccttaacaagtgtttttcagtaattgtgcctaaagaaatacaattataattgtcatcaaactaatttggtatgcatgcttttacctcccaaaccataaattgtcctcttccttcaggacactgtaaaccttgaattagaatcaaatcaacaatttccattattgtaatgtagaaatcagttcattttttaaacacaggaatcaaagactgcctggcttacatatcctaaacagttttaatatgaaaaaaagatatataaatgtttagaaaaaaaattagtagaattaattaaaatcaattagaatatgtgtattaaaagcaatattaagttgtatccatatgttgttcttttattctttgggttacatgggatataaagggattgacaacctcaacctgtaaatgcttctttaaaaatcatggaattatgaatctgattcccattttcagtcttccctaaggccctttctctattataatttcttagaatgtatttgctcttcttttctataacttttgccgaatatgtcatttattaaaacaaaacaaagcaaacaaaactctaaaaactaaaaatacaccattactggttataagtctttcttcagataaatgcatagttctgtaaattcatgccccatgatatcttcacagattatccattggttttcttggtgtttagtaattcttgtacatatccaaagataggtcagttcagagggtcttaaggaagatgaaactgctgaaataaagactggacccggttgggaaatgaatctcacttaaagcaaagattgataataatctcaagcaaaagtgggaaaatatcataacaggaggtctcttgccaaactatagctttgcacatcccatttggagtttaagactagtacccagtaatttaaatatttaaatttatgagcatagtaagaaatatgagatttgataacctcagagttttctaatactagattttgataacaatatttaaaaaatcaacagttcctttaatttaattattattctagtagttacttttggaaaaattgtttaattctctatcccaaaacaatttgtcaaaaaaaacccagtgtttttaaaatgccacatctttgtctttcccagtattttcataaaaaatagctggagagagaaaaacaaaacaaaacaaagagatgcatcagctgcagctacacatcaattaccgcataactgcttccagtgcctaacccttctacctccagtttctactttttctacctctagttgttacttttaaaatgcattctgggctgggcatggtggctcacccctgtaatcccagcattttgggaggctgaggagggtggatcacctgaggtcaggagttcgagaccagcctgacaaacatggagaaatgccgtctctactaaaaatacaaaattagccaggcatggtggcgcatgcctgtaatcccagctactcaggaggctgaggcgggtggatcacctgaggtcaggagttcgagaccagcctgacaaacatggagaaacgccgtctctactaaaaatacaaaattagccaggcatggtggcacatgcctgtaatcccagctactcaggaggctgaggcaggagaatcatttgaatccgggaggcggaggttgcagtgagccgagatcgtgccattgtactccagcctgggcaacaagagggaaacttggtcttgaaaaaaaaaaaaaaaaaaagaattctgtttgactatatatgtgcatttttagtttttggctaactgtggctcaaaatagactgcagtgcattttgtttgttagcaacactggtggaaaaaaatgttactctctgactcagacacacacacagatcaattttaagcaacattactccttaaatgaagcatacaaaatgaaaatagtctcat

SEQ ID NO: 10672 - DNA, 15267 bp, Homo sapiens
tctcaaaaaaaaagcaaaactttgggaggctgaggcagatggatcacttgaggtcaggagttcaagactagcctggcaaacatggtgaaactccactctactaaaaatacaaaaattagttgggcgtggtggcatgtgcctgtagtcccagctactcaggaggttgaggcatgagaatcacttaaactcggaaggcggagtttgcagtgagccaagaaggggctactgcactccaaccatgggcgacagagggagattctgtatcaaaaaaaaagaaaggagagagagaggaaaaagaaaaagaggagaaggaggagaagaaggagaaggagaaaaaggaggaggaggagaaaagagaaaagaaaagaaactaaaaacgttgttccccctctggaaaccagtacttttaaaatccatgaaaaatgaggatgtagacacaaagcaagacacaaaaagacaacaaaccacagaaaaatcttttgacctcagttgaataagtacatccagagcatttacaatgacatgtctcaacctttctttcagtattagaccccactacagggtctttttagacatctttttcctaatcatcccctgatgaaagtttaatatcacagatatactgtatatctattatgtactatggccctttgggggccacaaactattgtaatagctaagatttttccctgaagaacctatttttgccctcttggagataatatcaccctctctaagaacgcatgatttacagtattagaccctctacagattcacagtactaggctgtctagcaaacttgactgaaacaatcagaggaatggggatgcacataaactactcaatgctaaaacatatccaaaagtcttctaccaatattaaaagtgcctgcatgttgctaaatatctgaacaaacagtgaaaaaatcatttttaatgtctccaaatatctggaggttggcattttatagatataacatctaggtaattaacagtattttgataagtttaattcagatatttggtatcatgtatagagaatgtagcattgtgattattgtttaatataaccatgacagaattcaccatttgtcgtggttatatttcccattctatcaaaaagacacatgcacctgtatgttcactgcagcacttacttacaatagcaaagacatggaatcaacctagatgcccatcaacagtggactagataaaggaaatgtggtacgtatacactgtggaaatctacacagccataaaaaagaatagaatcatgtcctttgcagcaacatggatgcagctggaggccattatcccaagtgaattaacacaggaacagaaaaccaaataccacatgttctcatttttaagtgggagctaaacattggatactcaaggacataaagatggcaacaaagacactgaggactgctagatgggggagagagggaggaaagcaagggctgaaaaataactatgatcagtacctgggtgatgggatcagttgtaccccaaacctcaacatcacgcaatacacccaggtaacaaacctatacatgcaccccctgaatctaaaataaaagttgaagttacaaaaataaataaataaaataaagctaattacagctacctaaaaaatgctgtagggctaaatgagatcttgctggtaagctcccaaaacaagtgtttaataagtgttaattcccaatccactaactccatcagcggcagtaaatattttcattccctacggttgaaaggaaggtattttacttcacagacaatcccaaattaaaggaacagaaagtgctttaatcagaaaccacatatgctagttttaaggagcctcttcaccaaaactgagagggggcatgatgctctccaagcctgttaaagattacataaccctgaaactgtcagtaagcagagagctgaattcccctcttagatgtattcatatgtcctcttgctatggaaaatagcagaaattcaacaaattggtttaaaaaaatactactaaaccacacacacacacacacacacaaaaaatcttagttctcatgaaatcacagtaaaatgcctataaataaaattcatagtaattttgtagcaacttcaaaaaaatgtctaatttaagagaaaaatcttagaaaaatcccactgccctttttgacatcagccagaagctaggtaacacctggatgctacttgtttagaaatatcagcccttctcaccctcgagagttcagcatcaggccaagaaagccaaaaggtgaagttcagccagggccctcgagatcttcctgttaacctgggagaaaaaaatcaagaggcctccagatcagtgtcagctatgagccaaaagaaaatggtgttttcaggagcaattcattattggtctcagaacaattagaaaatctttcccctcagtaatgctttccatggctctgtagcttctgaaagggtttgttttgctctctgagagctttcttgtcttgtctgttacaggacaagaaagagaagggtttgcctcctcttcctcagtgaggaaaagtctgtatctgaacagctggattatgctgacctcggtcatcacctccacactggagaggatgctgccaaatgtttccgtcatctgcactgtgcactgatgtcatgtgctaactcctctcagactgactctgccaccgcagtgctccacgcctgtaccctgcccaactgtgtctttggcctcagcaggatgatgttagaaagacggtggagaggggtggtggaccatacaccgtattctgaggccaaataaataaacaggcagggttatctgcctgtttagatgatctgtgtggctgatgccctgctccatcagggattatgcggggtggtgaatgagactaggataaacttttctctccttttattgtctaaacaacctactgtctaacagaagcaaaaaaatattccacccagccagatatttctttagatgtcagatttaaatagaggaaatatatattaccaaatgcttaaaatttacrtaactgtcatcctctttgggacagcaccttcagccactgcagcgaattcactaatcccaatgaagagaatctctaatccattctatttagaaatgtgcttttattcaaacaaaaccccttaacatatacagattatcatgaatctgggggtccagccaaatcatcaaatttcaggttttcctcattcataaaatggccattcatacattttaattttacagctgtaagaatgaatgagggcatgctataaagtatttcaatttactctgatatattttcccatatagtttcatgcctacggttggtgggaaagtactcctctaaacccacacatcaaatctcctgggagacttctgcctcgggatatcatagttctaggtcactgacagaagatagtgttacattagatttatgatacttcatcacccattctatcgatctcctccattagtatctcagtccttcctgggcctttaaagcaaacagacatgattcttgctattactaaactacaaaaacatcccagattttctttctccaaaaaactatcccccaatattttgccccaaagcaagtatggctactcaaacataagagagtgactccaaagttaagaatctgactatgggaataggaaagaaaaagaaaaaaaaaatcttaccatttaagatattttaataaaatatcagataataaaaatatacctttgtgtttgaagagtcaagtcacacaaatacgtaagagcaaatcaattgtttccagctrtaatcagcgataataacccaagtacgtgacagcatgagaaagacgatcagtttccttttgaggttacatgataagcagcagctaagcagcctttttctctaagaactcgccgtctgacctcgtggcaagaggaggccagcccctytcactggcgccctttatagcgttcgctttcagttctccactctagtgaggacgggggcgggggaagctaagagcctgttttctaaaatgcagaatacggtcatcctctctttcgaaccgggttgcgtgggcactgaggagggccagaggaggcagggagggggcagcgaggcctagatttgtggattttttttctgcacactggaarttcccagaccaaaaaggtaccgacccgagtcccggacattcccctcgagggccggctccaagacctggactggagccgcagggaggaatcagaggcaacatctacaaacaaaactttttccttaaagacgtccttttaaaatgtcctagtgaatctcctgatgggcattagagttgccttctcattagattcacctcatcttatttcgctttttctgtgtggcccctaaacgtgagggtgcagtgggcgggtggagggagttaccttttaccatatagcttttacaatacggcaatcaaaaagtagtatcgcaatcatgtgccttcactgactaattaaaggacaagaaatctgtgacataaataaagcaatggtcctgtaacatgaagatcactttattttcaaggagtaaggggaatggtaatggggtagatttaacagcaaatgaaccactgcacaaaactgaaaggatttctcctatgacatttagtttcacttcttttccatttaggacactagctgctgtaatctcggtactacttttttttaagttatcttccccaagcagtgttacaatccagctggaatgggcattagatatacacatcattagactcttaaaaagaggcccgatggcctctcatttaaccagaatattaaaaaagaaaatatatgtacacacatataaatatatttaagttcacacttttttattttttatttatttatttatttattgagacagagtttcactctcgttgcccaggctagagtgcaatggcatgatctcggctcactgcaacctccacctcccgggttcaagcgattctcccacctcagcctcctgagtagctgggatgacaggcatgtgccaccacacctggctatttttgtatttttagtagagatggggtttcatcatattggtcaggctggtcttgaactcttgacctcaggtgatccgcccacctcggcctcccaaagtgctgggattacaggcatgagccactatgcccggcccacattttttaaaaaagttaaaatgtaaaagcacttttaagagacaagttagacagaaggtggtggagtacattttctgctctcctagcttctgtgtcctttaaactcctgccctcaaccatcctcttatcgtccaccacctccattcccctaggattcccaggtccccttagcactcaggggctgtggtctcaccttcaaatgaaaaacaacaacttcaaaattttatttattgcacactgaggtgtcaagaatcctaagtacactaatactacattgtagacataaaccaggtagaataatgcttaacacaagaaaataaatacacttgaagtggaatttctggcattagtgactagctgatgttaaaaagctgaatttacccagaatccacagagataatgctgagcagttttttagaaagttggggaggcttatttctgttgtttcccttgggtgtttatttccctgtacctctctcagtcatcactatttccttgaacagggtccagaaacagactcatttctggcatgtaacacatgaatatataaaggcgtaccatatttattcttgtcaagtaccctgatttaccaatctgcaaactaagttttcagattgataaatgtgaaactggattcagttattaaactggatcaagtttcaatctgaaacttaataactgaatccaggaagtgtcagttaaatggtcttaattaaaatgatagttgttcagaatggcaaaatgaatcatactggaacaccaaaggtctgttttgcattcgctgaagaaaggttacttttagtaggataattctataaaatgtaacttgcatagaaaggctttattatgggttctgtctgtcacaaatagcatcaaatcaatcatctcagttctggaatatgagattcactacattaaattaatactttcattccaaaatagaaattcatattttaaaccactgaaattgatataaaccactgctttaatattgtaaacctaaatgtccaactataatgaccaacttatctaataatgaaaactgcagtagcagaactattaagcagatctttataattaacttatgaagactatttaacatagaaaaatatttatatgtaaaaaacacagacccaaattacatattctctataagtatatggttaaaaaacctgcaagaaaatatacctaaatgctaatgttcattgcattcagatgatagaattatggattttatccatagatttttcttctagattttatagtttttaaaaattatgatgccccttatatttatattgggaaatatacatttaaacaaactattatttggctaccatgctaatattcacaaccatgtggcactagcctaaaataaacttttcagaagaaactaaattattctatctaaatattctgggaaacgtttaagtgatattggaatctctatcaaaatttccacaccagagtgaagaaagacaaattagatgtgggatgaaagttgttctcactgataagtgagagctaaatgatgagaacacatggacacataaagggcaacaacacacactggggtctattggagggtggagggtaggaggagggagaggatcaggaaaaattactaatgggtactaggcttaacacctgggtgatgaaatcatctatacaacaaacccccatgacgtaagtttacctatgaaacaaactggcacatgtacccctgaacttaaaagttgttaaaaaaaaawtttttttaagagagatgaaagtgactcaagaagctgtgtcaccaaatctttgagagctatgtcaccaaatcaaaaaataacagaaaaccagacaagatcataagaaatcatttgcacaatcaagtggcatcattccaaaccactggaggagcaatgcccgctttctttttaaaattctcctgggaaaattactcctcagcctcctttataaatccttgaggaaatgtcaagttctttcargacaagaaaaactctcagctgggcacagtggctcacacctgtaatcccagcactttgggaagctgaggtgggcagatgcttgrgctcaggagtttaagaccagcctggacaacatggcaaaatgtagtctctacaaaaagatacaaaaattagctgggcatggtggtacatacctgtagtcccagctactcaggaggctgaggcagaaggatcccttgagcccaggaagtcaaggctgcagtgagccatatcatgccactgcactccagcctgggcaaaagagcaagaccctgtctcaaaaacaaataaataaatacaaacgcttctttacgaaagtctcacaagtttagctgaaaagagatatggactctcacataccttatttcagatctaaacatgagttcctcatctataaaatggagctaatatcaccaatactattggatcatgaacagaattaaaccagttattggtaaatcccccaaaataataaacaagccatgtttattccctcattctatcttacctcttctcttagtgtttctcacagtgtggaataccaccattgcatcagaatcactgagcactcgccacaaaggttggtttcataaatcccagaggcatcatggtccctcttttttttttttttttttttttagagacagggtcttgccctgttgcccagactggagtacagtggcacaatcaaggctcactgcaacctctgcaaccttctgcctcctgggctcaagcaatcctcccacctcagcctcctaagtagcggggactacaggtggtgccaccacacccagctagtttttgtatttttttgtagagatggggtttcaccatggcacccaggctggtcttgaccttccgggctcaagcaatccgcccacctcagcctcccgagactataatccctgctgggattacagatgtgagccaacatccctggccttaattcttttattatttaacaaaaattttttagagataagatctcttgtctgttgcccaagtgggagtgtagtggcgcaatcataactcactgcagcctcaaactactgggctcaatcaatcaccctgccttagcctccctagtagctgggactgtcggcccacacctggataattttttattttttgtagagatgaggtcttactatgttgcccaggctggtctcaaactcctggcctcaagcaatcctcctgcctggcctcccaaagtgctgggattacaggcttgagctaccacaccctgccatgactctttaattctgcatttttgtcagatactacaagtgatccttaggtactgtaaagcgtaaggaccattaaaattaaactattttaatatattttattacctcattaggctcagaaacaattaaaaatcttctttccccctaaaatactttaaaaacttgaaggtgttcctcaaggacaggaaagtaagatctggggccctcctattttaaattaaaaacccaaattatttgacccattcttctaagggtatatattgttcatacttcaagcatctgtcttcctctctaaagcctccctagtttcttcatctgtctacttaggagcaacttaaactagactataatctatcacagctcaaaaagaaaagagtacttactaaatgatcccaaattaaactcgtttaaaattaataagtcaaataaaattaataattccattcttcttagatagccagtaggaatagcagcttcttccaagcatgagagaatgggtgtgccttttatgcccaaatcaagaaataccaaaaaacaaacaaacaaacaaacaaaaaactgtcatgaattttagtatcttattaatttctaattagattttaacttctaattttggtaagtagttcaaaataacaacaacaacaamaaaaaaaaaaacacctgaaactagtggaaaaaacttccacagctttataataycgtagcattctttacacaaaagtcaattcctaaaccctcaaatttcagaacataaaaataaatttccatttacagatttcccccttccagttccaaaagtagttattctagagtaagtattcaacacataaaatttagctgaatcaaataaaaaacaatcaccaaatgcaaatatcaattccaaagcacagattttatatatactgctttcatatttcccttttgcttcttttctagataaaagcaggaaattgtaaatattcactaaaaaactcgaaccaagcacattggccttttcaagtaattcagaaaaggtagatcatcaagagaaactcctgagacacagcagtcttcagtgcattcacaagagcctctgactataagctttctctagttaaccgccagaagatggattacttgtgctatgcatgcagatgcactcaatttcctttaccagataagctacaaacactctactaccaaccaaacttgtcccttccatcaaaacatttttcatactctttagcaaagtagtcacccctcctaggagaagctaattcaaatacactcattagcatctttggttacaagagcaatatagtgtgtagatgcagttaagagttctaccatggctaagtcaacattggataaaatcctataggtagatataaatgtaacctgcattttctaagctccttataagtcatcatattaagtccagatctttttgaaattttatacttattaagggcagtcatctctcactggggccactttctgtaactcaggtcaattgagaaggtcattgaatatgattcctccagtcccttccaagacaggctaggtttccaaggggcacacaaaggacaagaacatgtccagctggttcttcacaataacttcatctggatgcagcttgtgcggtagataatgggccagggtcatctcccaggcatcgacgagatatactccaacccctgagaacatcctccgaaggatggtgtccagctgaaagttgtaccagtcgctgttgaaaaggctcacctcaggtcccagctcttgggcgttggcygtccggatgaccaccacggtctttgggcttcgatcgaggagccgaaccactgctcgacggatgttcctgagccgccggatgtacacttccaaagggaaggtgctgaagtgagaccatacagctatggcaaccactgtgttcttccctcccacaatgccattcagctcattcgccacatamtggagctcattgctaaagacagtcgtgaagcggatgggtggaccatggcagcggtatttgagcaggatgttgtgcttctggtccactgcaaggaagggacccacattcttgggactacccaagttaaactccactaaatctgaaacaaggaaaactcaagttcataaaaaccttcaaaccaagcacatatattttgattataccttattaagtggcttcaaataacaatttttttttaagtacaacaaaaaggtacaatataaatgtaaagggaatacctatttcactgaactctgcccccttttgtatcaatgggcctttattctaacatgtttattatttaaattattacataaacataacattcattataaataacaccatcagtgatagactctacactacacctgtctatgcctgaaaaacaaaataacccatttttctctaattattaggccaagaaatgttgctatttgcactgatcattgcaatcttttttatctatgtctaaaaagtttgggtttttttacttttattttaggtttgggagtgcacgtaaaggtttgttacataggaaaatgtgtcacatattatttcatcacccaggttttaagcccagtacccaatagttaccttgtctgctcctctccttcctcccaactcccccactcaagtagaccccagtgtctactgtttccttctgtgtgttcataagttcttatcatttagctcccgcttataagtgagaacatgcaatatttggttttctgttcctgtgttagtttgctaaagataatagcctccagctccatccatgctcccacaaaagatattatctcaattttatggctgcatagtattccatggtacatatgtaccacattttctttatccagtctgtcactgatgggcatttaggttgattccacgtctttgctgtcgtgaacagcgctgcaatgaacatttgcttgcatgtgtctttatggcagaatgatttatattcctctgggtatatacccagtaatgggattgctgggtcgaatggtagttctgcttttagctctttgaggaatcaccatactgctttccacaatgatcgaattaatttacacttccaccaacagtgtataattgttaccttttctctgcaaccttgccagtatctgttgttttttggctttttaataatagccattctgattggtgtgagaaccacaatttcattgtggttttgatttgcattgctctaatgatcagtgatattgagctttttcttcatatgtttgttggctgtatgtatgtcttcttttgagaagtgtctgtttatgataatttaaattataaaaatcaaattggcatttacattttattctcctaacagataaatattatttctctcaagacatgggctttaacttctgttttatgagcacatatcagcaaccaaatacttctttggggaaattccgtcatttgtaacaacatggatgaaactagaggacattatgctaagtgaaataagccacacacagatgtctttgatgtggaacctcatgcaatatttgccttatactgacttatatgtggaacttaaaaaagttgaagtagagagtagaatagtggttaccagagggctgctagacgggtaggtgcaatggggaaatattaatcaaggtctcagaaggaaaatgttttagacatctattgcacaacatggtaaccatagtaaataatcatgtatcatatatttcaaaactgctaaaagaagagattttaaatattctcactataaaaaagtaagtatgtgaggtgatggatatgttaatttacttgatgtactaattccacaatgtatatatataaaatatcacattgtaccccataaatatacttatctgttgattaaaaatgaatgtttttaaaaataaaattaaggcaagttcaaatgtaattttgaaaaatgaaaacaaacacctctttttgcaataagcaaaagaaagaagcaaccctgtttcttttgactttcaattttaccctgtagatgaaaaatcatgttaatgtcctacagaaaaacttccatctctatcatgagaataacacagatagcatcgcaaattaaaaattcccttttctccctctaagttgtatttcaaggtccagttgcctggagacattctgaaggtcccaggaatcagtggcagtccttgttattcctaaaaaactctgtataattcatcacttagtacgtgcacccatgaggaaagaagatgtgtctcatatccctaaatattcccttaagtgccttaagtaaatgttgacaatccaatttaactaatatttccttagcacctacttagtgcccactactataggtgctacaagccagcaatgctcagatggataagctatatagtccttgccctcagtgagttcacggtcaattttgaaaaagtaacatcagaatataattgtcctataggatgggcaaggtggctcatgcccataatcccagcactttgggagggcaaagcaagcagctcacttgaggtcagaagtttgagaccagcctggccaacacggtgaaacccgtctctactaaaaatacaaaaattagccaggcatggtggcaggtgcctgtaatctcagctacttgggaggctgaggcaggagaatcacatgaacctgcgaggcagaggttttagtgagtagagatcacaccactgcactccagcctgggtgacagagtgagacaccatctcaaaaaaaaaaaaaaaaaaaaaaaaaaaaaaaatatatatatatatatatatatatatataaattgtcatatattcttaagggttaaagtaggtttcatttttttctccttgcatttccaggtttctcttctagattttcctacctaactactacttagcatttagccccattttaactgaataaaatctcaagctaccactttcttttgattagatcaagcactgacacaggctttatttttatcaggtgaagatatgtctgtaaagtatatggtgggacgtgatgaaaacagtcagtgtgatccttgctatcaaaggaaataccaagctacatcattagaatttaagaagcaagcaactacagacacctaggaaggccctcactggtcagcatcacatcaaaccttgtctagcatcaagccatacaaagtatttcccttctcctaatgtacaaattatactttatcaaacaaagcttagttatatctgtttcaatttaaaaaacaagcaaaacaaaaagtggaactgactttacacttttggggacaatatctacttcccctttccttctaaaaattaaatttaaaactaagttgaggccaggtgtgagccatcagcactttgggaggttgaggcgggcggactgcttgagcatgagaattcgagactagcctgagcaacacagtgagaccatgtctctacaaaaaatacaaaaaaattagctgagtgcagtggctcacgcctgtggtcccaaatgcttgggaggctgaggtgggaggatcgcttgagcccaggaggttgaggctgcagtgagccatgatcacaccattgcactccagcctgggtgagagagtgagacctcatctcaatcaatcaatcaataaaactaagttgacataataaataaaaaggctgataaaaacaatcacaaacaactcacaacaaaccatcaggctttactttattaaaagccttgcccacacatggccattaaaaacagttcccacaaaactatcagctctctaaattgtaagcagggtctttatttctgctccttcaggatccctccttccttacctcatccataccccttccagaaagaaaagaatgcccttgtgaagaaggggtgggcctccaaccactggggttttgttctgagtctggagaacagccccagagccaagcagagaaatcaagaagctaagaatgctggaacttacccagactccctcaggaggagccaactccatctcagagtcacaccaatggtaggcccaatggatgacacagggatggctttgctgcaaggatgcaatatggactaccataggtctggctgcttccttctactcaaagctactataaacttggagttggatgagacagaactaggggagaaacaactggaaatgcccacctctattttacaacccagaatattagaagggaaagacacctgtgaagtgacatggtccagctgtctcatctcacacatggagaaatgaagccctaaaaagtaaatgacttgtccaaagtcatacagctcatcagtgacataaacctcaatgagaacccagtgcttccatgagtacaacacaacacagctattgatcagaaactgtcacacatctctccagggtttgggtacctctttagtcctacacagaaatatatgtttcctcacctgataacctttcttcaggcacctgagtgagtctgcttatttcaaagctgatgtgggaaagagttacgaaacaaaaggcacagtaccaacctggaacaaatgtagtaaggtattcaaaccattgcctgattgttgagtcaccaaataaatgcaccacttttctttgtaagcactctgtaatgttgtcagggtcattaaactgacgcatcttaaactttctgggcctccactggtctttataataatacccagaaggaaaagttcctgasccttgagatagttctagactgttagtttctgcaaagaaaaaagaaaaacaaatattttaatattctcctccaacaatagatgaaaaatgtcccaagaaacaattatgcccatgtatttgttagcctgatagcatgtgggaaacatttcctgctgtcagacctcaaatcccagact

SEQ ID NO: 10673 - DNA, 34463 bp, Homo sapiens
ttctgagaaattgtatctttgttatccttacaccattgctctctatacctggatgaacctattgatgaagtaacctaccaagcgaccacctgaagagagaatttagggctcttgggacacttcatttaaagagaggcgaatgaaaaaaatataatcaagttagaggaaaaaaacacaattactgagatcaatgtcagccagcccaactgggcagaattttcaggaagaggttgttcaatcaaataaacaaaaatatattctagaaggtgagtaatagcaatcataaaattaaaaaaatggctgattatgggaaataggaggcagggctgagtgaggatctgaaggtgaagatctgaaatgatccttcttttttaaaaaatagtaatttaaatatattgctttcgtagtttgtgccattttgtagttaccgattttacattctgtgttcacagcttctgccaccccatctctgcacttaaagccaccatattacttttaattacttcatacctcatttttagtccatttgaataataaaataagactgcttagccaatgaagcatttttttgaacatggtttcccaggaatagttgagttttcacattagtatctgaacctaactttgttacatgaagcatgaaacctgcttttattttaaaacatcaattatatatttactgtaagcaaatagtgtaaaatcaataaaaacacttatctttattatgtgagaaagtgtgacattttgtttgagttactaagaaattccccggacttagaacttttgaattttctccacttataaatctgagactattctttactgtgtcataggatttaccctacggctttggtacattttatttaaaaaaaggaaaatgcagagagtgaaaattgagatagaagtaggaggctttaagtacaacagccccgcatgtgtatgttcagggcaagttaaggcgtccctccactgggacatctgtatatctgtaggatgaggggtaactgcgccctcatactcttagtggggcaggcataccctaaggtgacacctactgagtcacaccttgtacaaatccatccctttgagtgcaaacggaacctgagatttgcttcttaccaacagaatatggcaaaagttatgggacttatctctattattagattatgatattaaaatctatgggaacttgaacatcatctgcaaatactggaaatatttctcagtttctaatttttacatttcttgcttatttttctggttttaccttgttggctataacctctttaataatgtcaagtaacagtggtgacagtgggcatccttgtcttgtttctgattcaaatgagaatgctcctgaattttccttatttagggtgagagttggtgttttaatagttatcttttatcatatgcatggtaattctagttgctccactgccttatcaatacttagtattgttagtctttttaatttaatatgttttagtgagtatctcatagtggtatctcatagtaattttaatttgcatttcccagatcaagcattttttcaagtgccgaatggccactcatttatcctctttgctgaagcaactcttcaaatcttccacccatttttcattgtgttttaaaattactgtgttgtgaaaattttttatatattctaaaaataagtcttttagagatatacatatcacaaacatttttcttccagtctgtggttgcttttttatttcatctattctaatctttagaagtttaaaaatttgattatgacattctagaagagttttttaagattggagttggctattcctcaagaagacagacaaaactttctgactatgaatcttcatatatcttgtgtagatgaaagtcaaaaaagaaaaataaaaagaaagagaattctggctcttgaaacttaaataaagagcttcaaaattaaaagccttcaaaaaataaagacaaaaagtcttgtgcagatgaaagtcaaaaaagaaaaagaaaaacaattctggttcttgaaacttaaataaaagtgcttcaaaattaaagtgcttcaaaaaataaagacaactgtttgcaacttatgaggacttcagaatttcaaatgctttgctttaaactatgccaagaactctcatcctggccaacttcaaaccagtctactgccttcatgactcaacgccttattaaataatgatctcaacaagatgcctgccctcaaaatatctgatagcaattgtgcctgtttttttttttcctggaaatcaaagaaagtaaacaaccaagagcattaaaagaaactttacccaaaaaatatagtattgaacagaccattctatatacagaaatgaaactgtttatcaccttcatttatagctaaggataaatgctcgcccactgactaaaatgacccttttctttcatatatctcattttaagcaaacctattctaagacctctggtaaaaagagacttcatcactctgagatataggattcgaaagcaaaatacaaattaacagttgtgattcgcatcacaagaaattgtatgctaaggaagtgtgctgaagttttcccaaagttcaattactgatttgttcaaatggatccaatattaagattctaagaacatcattctgattcattcatattctgatattgcaccttccacagaagtaaaggaagaggagcccttggaaattgcatgtggcctgaagacaaactttggccaagcctatgaaaatgagattcttagtctgcttagggtttatgtgggaaaatggctgagggctttggctggaggaatgaaggtcactgacaggttttaatcaggagtgtgatctcctttattcttgtgtctagaatgactatccaaactgccaattaacaaaactggaaaaattaataattcctgaaacgagagaggcaatggttactctcattcaagattggggaaatggacactgtttcagccgttttctcaaactcctggcctcaagcaatccttccatcttggcctcccaaagtgctaggattacaggtgtgagccactgtgcatggcctgttacagccatttttgaaagcagtttgtaaatactcatctttgtcttgcaaacatattactttctcttgaaaaggtgatccagtttctgctaaaaatatcttctacggaaataatcagaaattatatttttacacgagtcacatttgtagcttgaagtcagtcatgatagaagtgtttacactgcagaaattggcaaatactatccatcaagtcttgatttatcattttattgattgtctacgcttgatatagtgatgaataaaatattaataatgcaacttaaaagatgttaatatctgcagtcattacactgtaaatagcacaaaaattcagaaatattcttctagtgtagatattccaaaacttatctgattaaacaaagagtttactcctgtcattgacagaagaataaaatcccaccatacatctcattatttctgttttatcttactccttaatgtaaatgaaaatatcaaccaacattcataactacacagtgtactgttcatcaattgccattataagttagctcaagttgcaaaagttcagaaaaatcagtgaaaacattctgtgagaatcagttgattatgtagaatttacaataaaaagtatagtacattttattattatttaaaagttacgtgctgcagggagatgaaggcccgtgggacgtgaccaactcagcattccactggaggctatatgatcaaacagcaaactgtttatcatgaatgcaggatgtgggcaaactcacaattactcccactgccagaaggtttgctgagggccattgcttcctggcgccgagctccttgaagttatctactgggacatctagagaatgcagtcttgcaagcctactctggaccaagcagctgacctcttcttccaccccacttctcgctatctcttttgcctaataaatacagagggctgtgtaaagttcagggcccttgtccactagaggcaaggtgccccctgaccccttcttccaaacatgctcttttgtctcttgtcttttattcctacgttcacctccctttgttcagttaccctaggtccatgagagttacatagtggcaccccgaacagcgacaaattgagtgctcaacagtgtgctacaaatactttatatcagtaaaatttattatgaatatgtattttttggaaatccagttgttaaatatttctcagcacacttctgccccaatttcatgtctctcttgaataaagaatagtcttcatgggtggaggaaggagtggggaggagaaaggctattctactgggatctttctcactcacccccacaccaggtattatccaccagcataggctgaggggtgctcctgggaacatcagctccatgggactcctagtctgcccctatgccggttgagtgtggaatgccaagttgcatatgttcacagcgaagagttaatttgcacatatgggaatagtacatgccaattatattatgaatggggaattaatattttctatggtttttaacttcctgagccccaaatatcagaagtgccagtcagactcctcaggggttgagggaggaatctgcactttcaccccttagggccagcccatttactggatcctgttatagcagctggcaaaccccttcatctactctcgtcctggaaaccatagctccactatcagtagcagaattggttctctgtcatcccgtgtcttcttgtgtaggagggtcttgatgtggtcatttttctttgtccttgatgccatttcttaggtcaatgtgatgccacttctggggcaggtcaaaggtgctcaatacctgtcaaacggatgggtagctgacatccagactcagataggagaggccagatgagggtgttaggttgaaactcatttaggatcaagctaaacacacattatgtggcccaggacaatcgtgtgctcataaccacaagtggactctggcttcatgtaaccacaagctagatagttttcaggaaggcagcccataggccagatgtctgctgggaggaggcaggatgaggaagggagatgctgcggtcttagtggatgtggggacagatgaaggactgggtaaagcatgaaggaggggcatcaggacctgctgcaagagcctgcgaagagaaagaaatccaaggggtaggcagagcaggggttcagggcaggcgttcagggcagtgagagcagtaaatggcaatgcttcctgggttctttctggaagaaaaaaagccccacagcaaagtcagagctcacacagaaaccaaagaaaggtctgtgaggcaagtccaggctccttcctgaacccaaacaagcatcagaaagcaacaaatatcccacctaagtcaggggctccattcatggcccccaggcttcaaccctagcaccacgggtttccctgctcagagaacttcgagagctcagccagggcttcccaaggctcccgacgtgcccagatctgaagaggagcatggaataggaggattcagtcccaggtgggacccagcttccagcatctccttccctgcatggtgggaaaatgaccccaaatccacagctctcctgagggaaggtgaagaattggcttcagggggcataatctgaagtctgagtggggaagcgaaaggaacaaagttccctgctagggtgtccttggccctgcggtgaattgggctaagccttcacttccccaaaagtggtttgggtgtttctgttggagggaagggtttgaggcaaaaactcaaaatagataccaggtgtctgctgggaagggctcctcagatggcctgaagggggctctaaacagcccttgcagtctcagagatgccatctctgctgctactgctgtccctgctgtggggaggtgagggggctgggcagaggcgggagggttggcgggagctcaatgtcaaagcctaaatgctggaggaccacgcggggtatgagctgcagattccagagctggtgatggtgcaggagggcctgtatgtcctggtgccctgctccttctcctaccccagtgacagatggagtcactcagacccaccctacgtcttctggttccggcaaggggacaatgaacactgggatcctcccatggccacaaacaaacccagctagaagctgcaaaagagaagctaggaccatttccaatttccttggggacccccagactgacatctgttccctgagcatcagagacaccaggaggaaagatggcggagtgtatttatttcggttggagaggggtcctgtcgtgaaattyagcttcaagcaaaagacactgtctttgaacgtgataggtaggcgtgctgtgtccaggagcctagggctcagatgggggagccattcctggggctgggacagaggctgcttctgagttcacaccctggaagtcccctctctgtgtcccaggtctttgcctctctccttcccagccctcacccagacacctgacatccaagtcccagcaactctggaatctggccatcctgcgaacctgctacgtgtcagcagcctggaaaagcagaaagtcactcatcttttcctggacatggggaactgtcatctcccwgggccctaggacccctcacttctcagagatcaccatcatcccacttccctggagycacggctccagtatcaccttcsaagtgactttcccaaggtttcatgtgaccacagagatgaccatccaactcaatgtctcctgtgagtctgagttattttgggcagtgactgtgggaagagagtcagggtatgggatacttggagtggggtcctggattctgggcaggggaagggaccaaaaggatgctcccctaaccctcaaaactgaagagggatgtgtcatcttttgaattcagatgctccacagaacctgaccatcagtgtcttccatggaaataaaacaggtaggaggcaagccctcctttccaaggttgtgattagggtgggagggcaccttagagagaatctaagaacacctcagaatagagtctaagtctcagagcttgcacgataggagggttgagatcaggaattccagcacaggtgccagaagacttcctaaatctaaatcctctgtcccctatttcagccccagggaacactccctaatctcaccaccatgacaaagactttcttattgtcaaatctttttttttttttttttttttttgagatggagtctcgctctgtcaccaggctggagtgcagtggtgcgatctcagctcactgcaaccttcgcctccagggttcaagcaatccttctgcctaagcctcccaagtagctgggactacaggtgcgcaccaccatgcccaactaatttttgtattttttgtagagacggggtttcaccatgttggccaggatggtctcaatctcttgaccccatgatcttcccacctcgacctcccaaagtgctgggattacaggtgtgagccaccacgcctggcctcttattgtcaaatcttatagacactttcctggacctcacttacctagacctctctgggggatttgttttgttttgttttgtccgatgactttttttttttttttttttttttttttgagacagggtctcactctgtctcccaggctggagtgcagtggcaccatctcggctcactgcagcctctgcttctcaagcttaagcaattctcctacctcagcctcctgagtagctgggactactggtgcgagccaccaatgcytggctaatttttgtatttttttgtagagacagggaatcaccatgttgcccaggctggtctcaaactcctgagctcaaagcgatctgctggcctcagcctcccaaagtgatgggattagaagtgtgagtcactgtgcctggcctggcagctttctggaacttctcagctctttccccaacactaacagaaccaaatctgagaatcacatgttgccttcctgcctcttcattcagcctctcctctctacttttcaacaattttaatttaagattttttcccaggcgatttattcacatgatctcataaagaaaagatataagtgggcatgtatagaatgcacctgtctcacctctgccctccagattcctagtttgcttcctctgaggcctccattgtaaactgttttggatacattcatccagagatgccttatgcatgtgtatcttcatctacaagtaaatataaaaatttcatgtgagcatgcttttttacacacaaaacatccttgatacactgttctgcaccctattttttttttttgagatggagtctcactgtgacacccaggctggtgtccaatggcactatctcagctcactgcaacctccgcctcctgggttcaagtgattctcctgcctcagcctcccgagcagctgggattacaggcacccgcaactacacctggataatttctgtatttttagtagagatggggtttcatcatattggccaggctggtcttgaactcctgacctcaggtgttacacccgactcggcctcccaaagtgctaggattacaggcatgagccaccgtgcctggcctattttttttaaatttaataatttttggagatctttttatgccagtaaataaagaacttcattctttttcacaactacaaaatattccattgcatatatgtcatttgctacttataaacactgctacaataaataatacttacatatattttgcaaggaagctaatatgtctgtataaatttgaattatttgatcaaagggcacatgcattaccaattctgagaggtgtggccacatggcttttcccgtggttgtaccattttgcaatccccacgtcctccccagcccatgcaatgtgttagtttttgcctcactccaacctcaacaaccaaatacgttagcaatgattttgatttttccatgactactgataaaaaatgtaccgcaccatagctttaattgcatttctctagctgggcatgaaggtgaggtttaattgacattaacattgtccgttctgttgtgttctgccatgctatgaactgtctgttcatacaatttcctattgtcattagcttgtgcttattttcttcatgatttggatgttatttttatattaggaaatgcaaccactaatccataatataattgcaaatgtcttttccagtatttttgtcattggtcagaaaagtttgtcaatttcatcattctctcctgatttcatttagcttggatgtgccatggaagttttgttttatgtagttgagtttgtaagtctttgcttgtaaatctttgtttatcattctggctctcccgcctctgagattatatataatgtacatagtatacataatgtatgtgtatatatacacaaacacatatttatatttatgtttatatttaatttacatttatatttatatataatcttgccaaaggttcctcttttcaccctgttctccacatgattatgcacayttctatcctcttcccttacaggattaatttccattccctgaaactccaaggccatttctagtcacagttgtctttgcactgctcttcctttctcccagcatggtcttctgctccaatattgtccactgtctgtttccacttgtccatctcactcttcttaagcccctcctcctccagggagacctccctgactttctgtcttattgtgttgctcaccctccttcacctgagtcactccatcacatcacctgtcatattgcagagtgaagatctagtcctgggcctcttataaccattagactgtgacaccctcaggagctgataccctctcagtagtacctcatttaaacaaggatcagtaaagggctgcagattgaataaataaatgattagactttagggtaactggagatgttggtaaagatagcaggaaagagggtgtgggaactagggggtggccaggagatcttgactgggattctcatcaaggacaaagtcctttcctctattcctgtacctcacggcgtctgcatctaaactaacagaataacggagaaggggaagagacsaaactgcatcatgaaggggaagggrgacccctctgtacatctgaacccaaggcctgcatgtgcctctcttggtatctctcttgctgagtttctcttctcccctctattcccagcacctgtagccttggagaatgccacctccctgtcagtcctgaakaaccaatccctgcgttttgtttatgtgactgacagcaacccacctgccaggctgagctggacctgggaaggccaagccctgaatctctcccagtygtcagaatcagccgtcctggagctgcccccagtggagtcttgtgatggaggggaatttgtctgccaagctcagcaccctttgggctcccagcatgtctccattagcctctctgtgcagagtgagtcattggtgggaagaatggacagggcacctggattctaggatgggactgtgagtgggatgaggtctaggagaaacactttattcctctcctccccttcaggtgactccgttatctctatagaagaaggcgttttacagaccctgggtttcacactgattaggggaatcctcatggggaccagctgcacattcatctgtggattcacctggatctgctgcactaggtgagcagtgccttgctcagatgacccagtctctgagcccccaaattycaaggaaaagtggcctggtctgtcttcctcagggtgagctctctgcagccctaactgctaacctcctcttacattttctcacaggatcagagggtcccagagaagcatggctgggagagtggactgaactgatctctctcctctggacatggtgagaagatggacattgaagtccagaggaacagagcccctgtatctcttactaaagcccacctctctgcatcttgaatcacttgctgacttggttcatccagaaataatctctgtccagtttcatatcctatctcctgaactgtactgctgggcgagatggatggatggatggatggatggatggatggatggatggatgaatgaatgattggatggatggatgagtggctggctggatagttgatggttggatggaccgtccatgactgctctgctctcagaacctttccttgcacctcctctacattgctatgtactccagatacttcctctgccagaccacatttatcaggcatctttattagccagcttccaactaggttcagataatgagaggctaatgctggagattaaaatacaggaagaaaatggagaagcagcagcatttattttttcccttctctctgaattgtgcaatctctttggtagtggcagcaccctctctgagcctccagcactcagactcggagtgctcagcactcagcctctgggtgcccctgattactgggctctggtgcactgccctttccctctgtcctctagcctagaagtggtggtggtttcctgctgttgttcatttctaggttgcctgattgtcctctgtttaatttttcatccctaacatcaactgcgtaatcaatttctgccattaaatgtcctctgttttaaatatttatgtgatttcttttttagtaattggactttaactgatacatatggacacatgaatggatggataaatggaaacacggacacacagatggatggatggatggatggatggatggatggatggatgggttaataaataggtgggtggggattctactcaatgaatgtaaccctcttaccagccttgggattttaccccacactttttcattcctggtccatttcctaagcatcatcattctctcttagtcttaaacatgtttacttgtgcaatcaggaatttgtaggtcaaacttatttcagtgttattttgtgggatattcctgctccttccaattccaatctaacttttgtacttcctatgagcattaaaagcttttattttatcatgaagaaggagttcgtctcagatccacacttttgtgttcccacctttctatttccccataaccagcccagttgtttactttatggccaccattgcccacaatcttagatatacttctgcctatttgatgactgaaaaatctcatcctgaaaattctgtccctttaggctggctgggtgtagtcctgagtaattgtgttttctccattaacttgactgcattttctttattcacctccctttaaataaaatattgcaggattcctaaattatctcacagtttgtctcttaatggataatttcatcaatgggttcatccaggtatacagagaaactgtgcaaggataccaaagataaaatttttttagaacactatgggagaggatgaattattttaaaatataatttggaagagagattttcttcttgacagtcacttttcagttttgccaattctattttattttttaaagataatatacaattctatatggaaaattccaaaataatgtaaaaacaaattataacagaaactttagcaaacgaatgaatacagatatatttaataattgtatcattatataccagtaactgttgatagaaaatgtaataaaaagataccacttgaagtattaacaaaaataaggaactataagagatgtgttacatctaaatgtagcactttataaaactgtgttggaagatatcaaacacctaaataaattgatccatatgctgtattaatgaatagaacgtcccagttacataaagatgccaatcatttacgaatcaataatttcaataccctttcattcaaaatcccatttagggtagagaggaatggaacatgtgaaagtgcagactaagaataagacactttgaaggagaagagtaaaatggtgaggcttgtcctactatatatcaaaggttattataaagcaatataaataataaaataccagtgggtgtgaacagccaatggaagccaagaggctgatatagtatagaattctaacatgtgtgagggcaagtagaagatcactggggaaaaggtgaacctagccagcacaacaggtctgtgggaaaggataaattacttaatcaatgatgctggaactttggtttaaattttattttttaagtttcttttctcccccacctcctctcttttttaacgtttattttaggttcrgaggtacatgttcaggtttgttacataggtaaacttatgtcacgaggtggttgtacagatcatttcatcactcaggtactaagcctagtacccaatagttattttttctgctcctttccctcctctcaccttccatcctcaactagatcctcatatctgttcccctctttgtgtgcatgagttctcatcatttagatcttacttataagtgagaacatgcagtatttggttttcatttatttttctttattttaatttttaaaatttattttcattgtatatatttaatatgtacaacgtgatattcagatagacatgtacacagtgaaatgattaatacagtcaagcaaattaacatatccatcaccgtccatacttacttatttctgtggtaagagcacctaaaagctactcacttagcaaaatttgagtatacaatattattaactttattctccatactgtacattttatctctagacttctttatccttcataactataagtttgtaccctctaacattctccccatctcctcccactccctgccccattctactctgtttctatgtattcacctttccttgttattctacatgtaagtgagatcgtgcagaatttttctttctgtgtctggtttatttcacttagcaaaatgtccttcagttttatccatgctgtggctaatggcagcatctccttatttttaaggctagtagcatttcattgtgtgtgtgtgtgtgcacacgtacacacacagtgatttgtttatccgttcatctgttgataggagtttaggttgttccatatcttagctattgtgaatcatgctgcaatgaacatgggggtgcaggtatctctacgagatgctgatttcatttccttaaggtatatacccaacagagagatttttgggtcatattgagttccctttaactctttgaggagtctccaaactcttgtccataacaattgtatcaatgtacatttccaccaacagggcacaagcattccattttctccccaccctacacaacacacttgttgtcttttatctttttgtgaacagccattctaataagtgtgaggcagtatctcattgtagttttgtccattcatattgagcagcttttcatatacctgttggtcwttttcatgtctctacagaaaagtgtcaattcaagtcccttgcccaatttgaagttgggtttttgtttgtttgtttgtttgtttgctattaggttgtatacattcttcatatattttggatatcaactttttatcagatatttggtttgcaaatattttctcccaacctatcagctgcatgttcattttgttgattgtctcctttgatgtgcagaagctgtttagtttcaggcaatctcacttgtttagttttgctcttgctacctgaacttttggtgtaatatccaaaaaattatcatcaatgtcaatatcaggtagatttgcccccatgttttcttgtaggagtcttactatttctggtctcatgtttagatctttactccattttcagttgatatttgcgtaggatgtaagatgagagagtccagtttcatttttttgcttgtggatatccactttttccaacactatttattgaagagattacccttttgacattgtgtcttaaaatcctaacaaccccacaaaactattagaatgaataaatgaattccataaagtaataggatgcaaaatcaacatacaaaaaccagttgcatttctttacaccaagaataatccatccaaaaaggaaatcaagaaagtaatcccacttgtaatagcaccaaaaagaataaaatacttaggaataaattttaaccaaagaagtgaaagatctgtacagtgaaaaactacaaaatattaatggaagaaattgaagaagacacaaataaatgaaaaatatccatgtttgtggattagaagaattaatattgttaaaatatccatactacccaaagtgatatayggatttagtgtaatctctatcaaaattccaatggcattgttcacagaaaaaaataattgccaaattcttatggaattgcaaaagactctgaatagccaaacaattttaagcaagaaaaacaaagttggaggaatcacattcctgatttcaaattacattacaaagctacagtaatcaaagccgtatggtgctagctatattccaaawgacatatggaccagttagaccaatggaacagactagagagcccagaagtaaacctaagcacatgcagtttgttaattttcaagaagacattgaattctttagtagaagggggaaaaaaacccttcaaataagtgtaaaaatataaaagagttatttttcagaatatgtaatgtcagtcatacacatatctgcatagatatatacacaacagggtccctgccagtatggcacagctccaagaccttgctgtgtgagaccccaaggccttccctggctgtatggaacgaccatcttttgaagatggcgtcctccagtgaccaactctatctgggcacgaccatgttgttctcctgacaaagccgctgaagaaaagtttacaatggaaataacggacacgccctccaccgcgttacaccatgataactatctgcagagcatagctccaaaagtgatattgaacatgcgcgtcaatggacatgctgaagaaatcacgcctggacgccaatgtgaaccggaagttgcccagagaggccttcactgatgtcgccaccagttcctatgtaaagcctgagggaagctgaggtgatttggggtaattgggataggggtgttaaagctcgaaaattctgagtttaaccaaccaggaaaaaaaaaaaaaagaccaatttgtaggacacatttggttgcatccaaactctggttttccatcaaatcaaggacaaatcagactactttcattgagaaatgacagaatgagagaaatcatttgtttcacctaaagctcacaaggacttttgaactagaatgtgtaagaaactcccacaaaccaatgagaaaaaggaaaacaagccaaagtaaaagtatgcaaagcacatgaatattaatctgctagtatggaagcatgagtggaaaacaagtccacgttgagatgcgcagcctcactggtagctgaaaaaaaatcaaattaaacagaaatgagatacttctttacactcattcagaaaatcaagaaggcaaataacagcgagtgtggcaaagatatgagtaaatcgggacctttgtgttctgatggtgggagtgcagtttgttgaggcattttcagagctggcaatacctattttgtgagctgaatgtgctcgctgtgtgataaatcattaagctgtacacttaatgatttgcatcccttctgcatgacagtaaaaaattcttaagctattattgtgtgaagtagctaggaaaaatgcatacaatatgatgcaatttacataaatgccaaaaacagtaaaacctaaactttgatatttagggatgcatattttgtcggttaaaaaaattgtattattctccaaggtaaataataggagaagactaatatcttcacaaaaagcttagacacattgttaaggaaaaccccaaagcccctctgcataaactctttaaataaataattcacagagattaatttaaaaattgggtcaacaaggctgtttataatcacatctttgaaaagtaaggaagggagattatattatttatctaatcttgaattaccaaaagtgaaaaaaagtctgtcatattgggcactgtcatgcatggtcaggagatttaaaggagtatggcacttttggaaaatatcctgttggcttcaaatggaattggggtaatcttcacccctccgtattgtatcaacgagaaatgcactttactgtgagtctgttgattttcaggggctttaacaaataagatttttttttcatgcaacaagaggtctacagatgagctgctgctggctttgacccaaaacattcctggggtaaagaaggagccgggaggggcacagagggaagtccagcccatacagacccacagtcggcccctccttaacttcctccctcttgggcggcccaatcctgtgactcagctgttttgccggctggagaccccgatctggatcctatctagtcagactcctctgcatagcccagtcattcctaaaccagggacacagtcctgcttcagcaccagggacagcgccactctccctgatgcctgtggctcgccaggaccaaaacgtgtctggatgtgcagcgasagccaccagcctctttgsgcggtccctgatggtagacatgggagagaacggcgcaggataggaaaacctcccagtctgtgtctgcccttctcgggctctcggtcacgcccaggagatgggcccttagatcactcagagagggaatctgcacatatccctggtttcttgcctcttaggacagactccacccccggggccttcaggaatccctgtctaattgtgataaactcccttcgcctccccctctccctcctcctccttctcctccccctcctcttcctcccctccccctcctcctcctccttctcctccccccctcctcttcctcctgctcatctttctctgtctctctccctctctcctacccctttctctctctcttccctgcttcttcgtctatctcagtctatgtctcttttcaccttcttcccctttcccctcttctgtctttctctccctgtctccctttttcctgcctctctacctttctttctgtctcagtctgtttctagtctctttctttccccctttgccttgtctgagggcaaagggaatgttcctgttgaaggaaaactttctctctctctctctctctgtctgtctgtctctctctttctctatctctttcccctctccctctcttcctcttctctctttttctctctccctctctctctctctgtctcaatctgtgtctcttcccctctccctcttcttccctactcctctcacctctgtaccacctccgactggtactcgtacccaattggagctctggaggacaaagaacaagactcatggtccttttcagtctttagctttgtgcccaatcctaaaagattacatatatatatatatgtcatatatcatatatataatatatatattatgtatatatgcttcaggatctgtaggctaaatggaggaacagaatatcaggcagctgatggaagcatggtctttggaagtgatggaagacattcaaagtgtttaggcacacaagggatcttacttagattgaaaaaagagtcccgtgagctcagagatggggagctgtccatgggagacctagcaggctattcatttcaagagagagagaggccaggagaggaatatttgctggtcactccacagaggggaggagttgtagaggctggaaaactgtggaaaagtcaaagtgaagagactgtgtatgtatatgtgcaggcagggcccacaggaagtgagagtaggaggagagacacaggacaagttctttctgcctcaccctgaacccaaagagctcacctaagtctggagccagagctggagccacggctggagctgaggacagagagggttccattttaggagagtctcagtctcactctcctatgaccctatgcaaggggctccaagaaaagcaactggggaaaacagacccagaaactccacatctctcttgagggaagtgggggttggtcttcaggtggtgaggaagaggaggaaggaaggtcccaccctgctgtggtcaggggagaggagagctcagctttcatttcccctgtagtggtctgagggcaaaagtagcgtttgctgaaggcagaaatttgggagaggaacaatacattcaatccaggaagagaatctrtcactccaaggttgtgcccacttccaagtgggagaggctaatcagtgaagacagcctagttctctcactgtttggggtgctacttgtagactgcccaatcctgtcrctgttcggggcaccgcttgtaaactgcacggaccttgggggactgaacaaagggggacgaacgcgggaacaaagacaagagaacaaaagaatgtgtttggaagaaggggtcagggggcaccttgcctctagtggacaagggccctgaactttacacagccctccatatttattaggcaaaagagatagcgagaaggaggggtggaagaagaggtcagctgctccrtctagagtaggcttgcaagactgtattccttgaacagtaggccctagatgtcccagaagataacttcaaggagccggcrccagggagtgaccgccctcagcaaaccttctggcggcaggtgcagtcgtgagtttgctcacatcctgtattcatgataaacagtttgctgtttgatcatatagcctccagtggaatgctgagttggtcacgatctctttggccttttcggctcccaacaaatcagatggtgtcagcggaatgtagaacatccttttccgctgctgccattgccccagctgtgagggcagcagaggcctgaggaagaggttgctcagtcgggctgcagccacagcttgcttcccggcagcagtcccatgagaatcagccggctgtgctctcacctttcagtcagtgacggtgaagagggaacctttgcattctgtgcccagcttcattctccagtccaatccatgggttttctggactgactttaatccagtccacacccacctttggatcccagagggggcccacagacaccataatccccctgtggccacaaataagccctgtcaaaacttggaagaaggctgggcgcagtggctcatgcctgtaatcctagcactttgggaggccgaggtgggtggatcacctgaggtcagcagttctagaccagcctggccaacatggtgaaactccatctctactaaaaatacaaaaattagccaggtgtagaggcaggtgcctgtaatcccagctactagggaggccaaggcaggagaatcgcttgaacctgggaggtggaagttgcagtgagccgagattgtgccactgcaccccagcctgggtgacagagcgagactccatctcaaaaaaaaaaaaaaaaaaaaraaagaaagaaagaaaagaaaagaaaagaaaaacctggaagagaggacctgggscaaagctaacctcctcagagacccaaggacccacagttgctctcagagcatcagatgttccagatgcaggaaagtaggaacacatctctaggtcagagatatcacatgaaatatagctcccaatgaatgacactgcctctgactgtgaccagtagagaagggtccccaggagagagccccagaggcaggaacatacctgtttcttatctggagagtaagggagaggtgcaggatcctggggctgagggcaggggaggccaaccccaggctgacactctggggtctcccctctgagtttctcctcctctgtagcttgtatcagatacccataatttatatccctttaagcttaaagccagccatcttggagtctaaacagcaccatgccaggggcttgtgaaggaagatgcacctctcttcctggggttctgaagcccccgcttcaagtcctcagtgtacccctgtatcctagggtccaagattgtggcatcaggcctccatgccaggtgaccttcctaggaagcggtagatccatgggtagaactatctgaggagtccagcacatggttaaaaacctaggtgtggcttttcaggttcgatcacaggcagttgcaaaggcttttcctggcaggcctcactgggagactccaccctcttcacactcggttgtggtcaaggaccccacctttctggccagtcatgcgctatgcatatttgcatttctatcccagttacatttatttctaggcctcgttttctgaggccttggacagaggtcttccacagatgcctctgctgagaccaccttgcggggggcaggaggaggaaccttgaagacacgtttccccactctgactcagtactcagttcttttccactcctagcccttctcatgcccccacccttcccagggtctgtggaactgcctgagccttttgttcagggctccctcctcagtgagaggaccccgacccctatgtctgtgttgatccatgagccacctgaccctccagcagtgtgcactgttccagaggggtggcaggaaatgaaacaagaagagttggtgcattctctggtttagactcttgcctctatcactgctgtctgtgattaaaggcttgattcattctttcagtttggtctattgttgctttaatcggtgatcctgccaccttgaagcacagctctctctcacagcccagctgagctcctcataccaccaggctcagcatcccccttggatgttggccaggacacctgggtggctgagggctgccaggatggacaggaagggttcagggcctgagagattcaacgcctggtcaggagctcgactggagaagggaggagaaatcacagcagtccccacctcagcagctttccatggatttagccaaagaggcagagcagccatactcctccgcatggtggtagaaaatggtggctttctccattccagatgccagatgccagattctccacagaatctggctattggccccacccaaggaaatggtacaggtaggaaaaaaaccttccctctggggtcgtgatgaaggtgggcttgctgcttgctcaggacagaagtggaggcccagagctccgacaggagaggactgaagacatcccaatgagtcccactccccctcaycccgctgccccctgcagtctgcccctcccacccatccctgataaaattctcaccactgctgtcaccaatgtgcagctccttctcctcctacctccctggccaggccatctcagccattccccagcccacaattaagcttaagattgtgtgttccccacccctcccactggggccttctgtttccccttggtgaacacatccacctcccctgagtacaacyccartaggctttgtgaaactccctayccctccctctccagcccagacctgcccccaagccctgacggttcatctcaccagctctctgccatgacacccccaagtccctgctgcttgagtcggggctctgggagccactgcagatgctcccctctctcacgcattataagaattaaagaaagaagaaggaaacacaaaaaacagctgaacagttaaagataggtttattttggagactaaacctgagaagggcttctggctgagttaggtcagaggcactctcttttaccgactaagagtttttaaggattcagggcggtacagcttatcacaggctcagaatgtttctgtgtctctttgtcttgcttacctgggagggagagttttgtgtctaatcccatacatcttcctgcagctgcaggcataccccctgagtctgcttttagcttccctatcttagtgtacctaaaggggaaggaatgtgtttattagggcccactgttttactggggcccattgtatgagtgtgaagtttggtggttacccaggagacttttccccctcagacatccctttatgcctgagctgtcttatctgtgtttcactgtctgctctttccggctgcttgttgtyagaagataagtgatttccttgaaatgcacgaggctagaaagggagctggaacttaaagtggcagtgttagtctgagatgatggtgctcctgctctgtcatgcaccaccaccaaccctgcaaagtccactttctgaaaatgtctcaaattgcttctttcttcaatcaccaaggtgacttgttttgagagtccccagctaaactggggcttcagtgccagagtggctgatgaccctgccctaatgggaaatgaaggagagctggacgtggtgtctacagcgtacatttcacaggatctttctcttacgtggaggatgatctaatgcctggttgtctgacccatgaccatgggtgcctcacatgggcaacttgtttaagctacagatgcccctgtggttcttttctgacccgtgttcactttatgcctgcctgaccatttccctggcactggaagtccacccttgtaccctcccaggtgtcctggggggaaacccagcctagagtagccacagttcttcaggtggagggtgcaagttcaatgcaccatcaagctaggaaatatgtttaaagatttttacttataaactccaggcaatgagggtgtaatgagtggagggggggcagtaattagtggggggacccagtccatccctgggtcacccgagtcaggaatgaggagtcaggcagagtgagaaagaaaagcacacggcaactggcagtacctctcagggaatcgggtgtggttactttaagttcatgggtaaatatctgtggttcccttaaaggtagcagcagaaaaagcaggaaggcaagtctgcttttacaggagagatgccgctggttcttttatttacctattgttttttgtagagatgaggtccctctatattacccaggctgtcttgaactccactcaagagatcgacccgctcagcctcccaaagtgctggggttggttgaagggcatgagtcactgtgcctgtctaagttcttatctctggccaccagcttgagccatttgagtgtggtttagaactggaagttgttaaggatgactgagccccgcttctggtatttcaaaaggacactgaggtcgcatgcaattctaagaattcactacattactctctccttgaaggcatggttcttccttaccgaacaatcgcaacagctttctctctaggcccttagcctgcagtctggccttggagggatctatctgacatgtatatattatggtgacccttttctgcacgagaaccttccatgactccctattgtccttggagaaagctcaagcccatcattgtttctgtcttccaggactacttgagttagttgagcgtcaggaatgatgcaaatctgtctcttttacttttgtttgagaatgaatgcacacatggaatgaatgaagtgttgctgctcttacctcacgtggaccctttcatgcctctggtgctgatctctaggagactgacctctgtgggggtcccacgcctgtgattcatggggaactggccaggtggcacctgtttctccagtcacttgtgcacaagtccaggaggcaggacttggggactccggtccttcgttgcygccttacttagggcaagcctcttgccttgtctgagcaacatgcagaaatggaactcagttttcttaaagagttaattacaatggactcattgtgtgtctgaagttccctttactgggctggtcacctcttgttctcaccacaagcttcctctgctgtcccacacctgtagctttcccttccctttcagagaggtctgcccctgggtatgaggcagagatgccactgctgctgaccctgcataggctgcggggacagcagcccccactcaggaggctccagagcccaaggcttagtcttttcctcactccagggctcctggcttaggttctgggattmcagctgcagttccaggaacctgtgatggtgcagaagggcctgtgtgtcctcaggctgcagaaatttccctactcctggacttactatggaaccctccacctgtgctggttccagaaaggggtggatgtagaccacaatcctccagtgaccaggacaaatgcttcatggcaggacccaggaccaattcctcctgcccagggacctcaagaccagcaacttctccctgagcatcagaggcacacacggggactctttttttcttttcttttctttttttttttttttttttgggatggagtctcactttatcaccaggctggagtgcagttgcacaatcttggctcactgcaacctccgtctcccgggttcaagagattctcctgcctcagcctcccaagcagctgggattataggcacccgtcaccatgccctgctaatttttgtatttttagtagcgacagggtttcaccatgttggccaggatagtctcaatctcttgaccccatgatctgcccgcctcggcctcccaaagtgctgggattgcagggataagccactgcgcccagcccacacggactcttcagaaaggagaaaccattcaggaaacattcatatcttgtaggatgctctcttggaatatgacaagtatgttaaaagcccagacaccagaaataaagcaatgaaggttctgctccttctagaggtggtggcatgccgacagcgtgaaaggaccctggggtgggctgataacactcagagggtccccaagctcctctctctcctcaccagccctgacccacaagcccaacattttcatcccagggattctggggtaccagtcacaccaggaaccttacctgctatgtgttctgggcctgtgaatgggaggagccccctccacattcttctgaatgggggtctccctgttgcatctgggctccaggaccttcggctcctcagtgctcacgatcaccccatggccccaggaccacagcaccaacctcacctggcaggtgaagttccctggagctggtgtgactacagagagaaccatccagctcagtgtctcctgwgagtgctggggccaggatgcctgggttcctgagggtgtagggggtagaggagggtcagggcaggggacactttgtggctatgtcctggaggcctggctgagcaggggaactagaaggacacaagctctgtcttttgacattcctgtggcttctggggtaggggaggagtacctactttyacctcatctccaccccaaagaaagggaaattctctcttcctgttctagatgctctaaggaacccaaggattggtgtctctctaggagacggcacaggtaggacagagccccctccctggggctgrgggagcagggcctgcagcttggggcagggctgggctactgcttcttcctggactcaacttcgtaacctgagaccctcttgtaagtgaaacagaggtcttccccatcgttagtctccaaggccacctgagcacctgtccccatcctcccctcactccccttggcctcttccacacacaactcccactggccccataacaagggcagggtgccattcacatagcagatccaggctttgagtccccacctgctgaatactcctcttccctcatcttcttattctccccagtagtcctgatctaagttcttctgaacagatgatatagtcacatgggtgagaattcagagtgcacagtagaatctaccctcagacacccgtccccttccccagaatccgccagtgtctgtcctggctgcgctgcgccttgatttgcttgcccgaaggatctcagtgatggtttaacatcagtagtgacatcagagtgacattactctcctccagtactgtgggtgattccactgtgtggatggactmcaatttcgtggcatcaaaaatgtggactctgattttgtgcctaatggaatatcatggcactaattttatcttaccaacagtaacactgcaataaataatcttgtatctactgccacaagtgtacatctatgcctgtgaaatcagttcttaaatgcaaaatagttgggtcatatgttctttctaattttgaaaaaatatggccatggagaacccatgaaggtgaacaaggttacacgygcaacagggaggggtaaaagtgtatgtattcacctacccattgtggggcaaaacttttttttttattttttgagatagagtctcactctgttgcccaggctggactgcagtggtgtgatcttggctcactgcaacctctgcctcccaggttcaagcaattcttgtgcctcagcctccctagcagctgggattacaggcatgtgccaccacacccaggtaatttcttttgtatttttagtagagacagggttttgctatgttggccaagctggtcttgaactcctggcctcaagtgatctgcccacctcagcatcccaaagtgctgggatacaggtgtgagccactgctcccagccggggcaaaactttttgaaatcagggcctgtggtggaggtggtcttggtggctgtcggggaggcggctgtgaagatcctgcctatctgcctctgcttcctcttcctcagctgagcgctgccccagggaccaaggagagatgtggggagtacaggggacatggtgctgaatcccaggtcccagtgctggaggaatctgaaggctcaagagggccaggcagtaggctgaattgtggcgagaattccacatggaccaattgttgtctgacctcggctttcactgaatgtccgggctgggaggttcctgctctcattagggaggttctgggggctaggcctgctctctccaccccagtcccctcctgccccttagcagggcacggggagatgagtctgctgccctctgcaccccgatccggccacactggcaggcctttgtctttttactcactgtcagtttctgcaggaaggaagggcagcagcaggcgtggaggctgcagaccctgtcacgggctaatctctcaggggttgtgggcatctcatcctcaacatcccactggacacctccccctcaatggcctccaggattgctctgctcagtatggcttaagttgagctgcccatcttcttcccccaacccacttctcctgggatccccatcctactgatgacatagtggctcccatctctaaagtcagaaccaggatatgggtcttcaccttcacctccctccctcctccagatcccacaaatcactaattcttgtccctccttctaagcagggttcatcctggggcccttttctccatcttggccctggtcatgcctggggcctcgcctcctccctgaacactgagccctcctcrcctcctgcctccatytctcccaacacagactccagactccgtttccagatgcctcctcatccagttcctccacagtctgagcagccgtgtttcctctctggtgctggagaacaaggggaaaatgccacagcctggaatggaggccttgcacagtctgttcctggccagactctccacccaaagtctctgcaggccaagccctctgtggctctgagactttgcgtgtgtaattccttctcctgaaatgcccttccctcccattcctgccaatctaggtcccaattgtccttcaggctcagtcttaatgtcactcagggttgtgtgtgtgttgtgtgcatgtgtgtgtgtatgtgtgtgtgtgtaattcttatttggttctgagtggagcagaggcattattggtgatagacacgaagcgactaacttcagtgactctactgagcatccattatgtgtcagcattattattggcaccaggggttcatcagtagacacagcacgaaaaaaatctctgtcttcaagaagctatcattctagagacaggaaaagtacaaatgaaaagaaataataaataaaataagagcatgtggggtggagatctgtgtttggagaaaaagcatgcagggaaagaaacataagatagactggggaaccgtttcttatctgataatgaggggaggtggtgtgtgagcaaaggcatgaaggtgctgagcagggaggctctgtgtctgaatgagagacaagcatcccagcaagagggaaggggagcagtgagtgcattgctcagaggcagcagcaggcctgggcattgcagacacagccagagccccagtctgagagcagaaggaggcagaggagggagcagcggggatgacagggcagcctgcgtggggccctgaggctacgcaggaacctggagcctttggagagagcagaggcttgactggactctcactctaacaggaccctcagctgctctggtcagagcagaaccgcgtgtgtcacggcagccaaggaggctgggaaggcgctgctgggtcatccaggaggaggcatggggctgagccagggaggcaggatggggtaaggatgtgtttttggatgtgagtggaaggtcaggctcacagaattttctaatgagtgttgtcagggaggggaagggaagagcaaggatggggccagaatgttcctctgagcacctggaaggaaagagctgtgtccatggaggactgcagacgggtggctttcaggggcgatgataattctgagaatccccctgacatctgaatggggataggagggagacagctgaatgcaaatgtctggagctcaggagaggggtccaggatggagatgtttcaatgcacagctggagtaaagtgatgaccacagatgaggagagacaggggtgaggacagacggagaagtgggcacctttgtcactcatgatctttgcaacggcaggtttttttgtttattaattccaaaaatttatttggattccatctggagttttaaaattttatttgtttattatattttttagaaggttcttactttgttgcccaggtgggagtgtggtggcttttcataggtatgattgtcatagcccactgtagcctggaattcctgggctcaagctatcctccttcacagccgcctcttgaatagtgggaacagcaggtacccgccatcgtgcctggtgcctttggatttttcaaagcaatatttccagccttattgaggtgtaattaaaaataaatattgtatttatttacagcatacaatgtgatgttttgtggacatttcctttgtgttttatcattattctattttaatagacaaataaaattgtgtatatttatgatatgtaacataatgctttaaaatatgtgtacattgtgtaatgaagaaataagctaatatatgcattgccatctcacacttatcaacccctttgcactttaaagtaacaccttatactcatcaaaaggattgctttgtatccagcaatatttgttttgttttgtgatgagaacattggaaatttactatcttagcagtattgaaatatatgatacagtattattagctatagtcaccatgcagtacaggagatttccagattcctcttgtctacctgaaacttggtaccctctgactaacatctcttcattgtctccaacctccacccctgatcaccagggttctagcctctgcttttatgaaattgacttctacagattcctcatataagcagaatcgaagtatttgcctttccgtgcctggcttatttcacttggcatattgtcctccaggttcatccatgttgttgcaagtgacaaaattttctttcttttcaaagctgaataatattctcttgcgtatacatgccacattttctttatccattcacccattgatggacacttaggttgattccatatcttgactattgtggatagtactttggtaaacatgggagtacaaatgtctcttttgttttctttcaatagatacccataaatgggatttctggatcatatggtagttccatttttaattttgggaggacaaacctcctgctttccataatggctgtgctaacgtacagtcccattaatagtgtacaaagtgacccaaagtgtttttaatgaaattatgagatttactagcctgctggcacaagaacctgtttttctgttaacaatgcacacttttccttaaataagagaataaatggaaagtttgagcatatgaaatgacttttgtatattgttgaaatctcagtaattcagtttctgagtatatgcagcctatctttgtatgttggacaaacactggttggcaaactggcataggtcagaaaaagtgcccagatgcaacgttaaatattcacgtagggtctgtctcctgctctaaactaaaacccagttgaaggcagtgtcttaacccattaaattatttttattaaactgagcaatttagataaagatataagttagaaattaaaattaagctgatagatctaataataataatacgtatacctgcctttccttttattgataattattggaaggaataaggaaatatctttaggtatattaaaaatatgtgttgctaattttaaaaattcacatctctagtacagagataatgcacacaaaactttgttgaggagattgaacatggatcaaagttatgactaagagttttgtttgttttcctcatgaaaatgacctaatttattcttggtgagaaatctctagtagaaatgatgcttcttacaggccgggcaagcttatggtacaaatatccaaaaattttaattttaaggtatgagggattttgttttcactgttatgtcaaaatgtttctctcactggaactcttttaggcaaaataaattccaaattaaactataaaattatacctaataaagttcattaaagaaacataatgagaaatcacaacttcatatttaaccttccagtctatgagcatgatataactttatttactattaaaacaaatttcgttgaattttctattatgtgccacatttttacttaaaagataatctaggacaggtattatacttattggtggctcaattacttatatatcaaataaaggtaaaactagctctcttattttagtaaggatgaatgaatatttatctagatactactgtgtttaaaaattgttcaaataagggtagtgtagttcaagacgactaactagaagcatttcatgcctgcctcctccacttagaagaaccagagtaatgtatagacagtcacagtcgaattacattatccaagggaaaatcctggaatccaccagagaagtggcagaggacatcaaaaacagggaaggagaaggaaaagaggcagcctccctggctgggattggctgggagctgggagtgacttcccatgcacaaaggactgagttagggatttccagtcgtccacatctccatggcggaattcagcaatcctggccaagggagaagcactcaaccctatgaaactaacatagagagtcaggacaccattggacagaactactccgggaagggaactcctgctgggttccacacctttctgacacttaagcattttcaagcttgtcctctggaaattgtatgctgttcaaggacccagagacactgaaactggggcattacagaaactcaagctattgctgctgggacaggagatcgaaccaggagtgctcctgcaggtggggctagaaagtgagcaaggtttggtcagctgtggctgtgaagcaagcactgccaggatctgagacaaggatgcaagaggggcacaaattgccattggaacttgtttgcaagccagatgggagctccagcaaccagggtgagggggggtgtcgagcccctccaggactggagtgtgaaagggacatatgttcttccgccaccttcaactgacccaggctatgaccactcaagatggccctaccctcttcagtaatcctctgcctgggacccgacgattgctctgaccctgcccacaatgacgagtgcctgctgtcaacattgaggacctgagcacaaacccatctagctcagcttcacctcacctctcccgctctgagacagagcacatagcccagggtcctgcggattgctcgacccaattcactaccttgggcacctgagcacttcttctgggggcttgaggttggatctaaacttctggctgctactaccttgcctggcgcctacctgcaagtgccaactgtgggtccaaaggctgtcttgtccagcccattgcagccagcaccaacattaatgcacatcacttgggactcatagaatcatcttgcccatgctattgctattgtcaatgccatgctggctgcccaggggcctgaaaacccacacaattgcttgatccattggtgctactatgagcatccaaatgagcaacctgaaagcccaagaatcaacccactggtaactgccaacagagaagccagcatataccaccctggggcaaaaagatagatgctcagcccactgatgccaaagctggggacctgaagactctcccgctcagcatccctgtccctagcacaacttttaccatattctccactaataaccatgctccaactagccaaagaaatcacacatatcactaatgctgtttacagtcaaagaaatatacagaaagtacactactgcacatacacagaatcaaagccaaagcaccccaccaaacaagcaacgtagatacattttcaagaaatgtcttctattcgggactggctcatatctttttatctaactagatgtcagatcttgaaatccgtattctcaaagcaattctgccacttgatcgtattctcaagggccctgataggctcctttataaggaccaattctgttcctagagcttaactagaattaattgttcactgaaaaaaaaagttaattaagaaagcatttctttcctaatctcactcaaatctgcagaattatttgtaattaataatacaaaagctggccaaaaggagacttgtaaatagcgtaaagtggtgtcttatactaaacggtggaatgtttaggcagagaagctctttgaaattgtcagatgggctgggctcacaagcctgattcaaacaggctgtcagtctcctctctccccttaacactgtgcagcccaaacccctgggacccttgaacatctgagcagttttgtgctttgagccactttttgataaaaaaaaaggctccatttttccacattgtgattttcttaaagtagttcaatgttttatagtctcatagtagtagtgttgctttctaagctataacagttgattttattcttctactctgaaaaatcttgacttgtttgagtgtatattatatataaagggagccttaatggattggttttcataatttaatattttttgtatttgccgttgtataattgtttttaacagaaagcattaatgaattgagagtggaattcttagaaccaaagttattcttaataaaaatcaccacatgcttggaccatgaaaaaaaaaagaaatgtcctctatgaaagtaaattaaaaaataggaagaagctactgttatactagatgcacagattttaacataaggacacaggaaacatgaaacagcaaggaaaggaacacaagaattctgcagaaatagatcttaatcacaaagaaatttttgaaattcc

SEQ ID NO: 10674 - DNA, 867 bp, Homo sapiens
tcagctgaccacgttgcctcttgtggtgtaaacttgtaccagttttacggtccctctggccagtacacccatgaatttgatggagatgaggagttctacgtggacctggrgaggaaggagactgyctggygktkgcctgagttcagcaaatttrgaggttttgacccgcagkktgcactgasaaacatsgctgtgrcaaaacacaacttgaacatcatgattaaacgctacaactctaccgctgctaccaatggtatgcgtccaccattctgcctctctttacttaagctatccctccataccagggttcattattttcttcccaagaggtccccagatcttcttatggcaattgctgaaattttatcatctcccatctctaaaatcacatattcccatgtaatacaagggtctttccattatgcattcagcaaatccttctaggagaggtctcatcaacctcctactttattaaacatgcccacagagagaagggcacaggaataaagcagaggcaatgtgtcgttgctcccaagcagaaggtaaataagacctctttgactatcaggtggtgaaatgctggtaggagggctcttccaggatgtaatgcagaacttcagggcagagctattcacacttcacaccagtgctgtttcctcaccacagaggttcctgaggtcacagtgttttccaagtctcccgtgacactgggtcagcccaacaycctcatytgtcttgtggacaacatctttcctcctgtggtcaacatcacatggctgagcaatgggcagtcagtcacagaaggtgtttctgagaccagcttcctctccaagagtgatcattccttcttcaagatcagttacctcs

SEQ ID NO: 10675 - DNA, 189817 bp, Homo sapiens
  misc_feature (1)...(189817): n = A,T,C or G, or insertion/deletion polymorphism (see Tables 1-2)
acagatgtgcacacactcacagacacatacactcacatagacaatgcatacacacagaggcatacatgctcagaaatacccatacacacagatactcagacacactcagtcgctcacacagatgtgtgcacagtcacatgcagacagacatatacactcacaaatatatagccagacacacacagacacacatattcacagggagttgtttaatggaaacagagtttcagttttgcaagacagaaacattctggagatgggtcatacaataccatgaatagccttaacactactgaattgtaaactgaaaaatggttaagattataaattttatgtgtattttaccacaattaaaattttttttaagacagagatatttactgtaagaaggtgggtacattagttaaatctttctttcctaaggcgagaacagctttcttccatttgcctgccatgaggtgaggcagcccccagcaatccatcactgctcctcgggaaggtagattacaggtgatcgtagatccctggcaagagtgggctatgcccagggaagccaaagcaaagagaaaactcctgccatctgcacctgtccctggcatgggttttcatctttcctgaaagaagaaggaaaagaggctgtgggagacatggtcctgtcttagatcccacgccctattgtggtggcaactgcgatgatgctttataaattccttttaaaatgtcattgccagactttgtgaaaacgctcgtgaggctttgaaaaatatgtgaatggatacagagggccgcttgccttcccccactgctcactactgtggctagaacctgactacaaactgcccacccagcctcccttccatcctctcccccaggacacttccatctggagtggaaagttttctccagctcctacaggatgaagggcagtgcaggagaaagactctcccaagagacgaacttgggtcattcatgtcagagggtctggcatctttgaacaaggccagttgttatttatgtatctactcacctccctctggaattacatctataaccaacaaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagagaaaagtgtcaataccatagaaatgaaaactcagaattaaaggatcaaggtaaggggatccggaatccctcctcccacgtattttctgtttactcacaactcccaaagtttactacatatttctgagagacgccaggatcccagagtgatgtgtttaggaatttttaccctgcttcttggggaggcaatggggtgagcccttcagcttcagaagagtgagaaggtatgcccaggcccgtgcagccagagggagttcacgtctccttggaggtctcatgctgagctggtaaggccaagaaagtaggggcagaactggattacccttgtgacgttctcattggagtctcctcgtgctccaggcctattgacatctcatgtgagggactggccatgccatgatgaaagagcacagtgtgttgtggcagtcctggaactgtttgcccagagagcctttcctcaccctttccctgtatggatgcagtaaagagttaacatagcaaacctgaaactggcttagaaagccctacttgcaagcttggcccttgtctggcatctgggaacttggacttcaggagtcttcccactgttccctaactgacaagtggggctggctgggcctaaactgtacaaaaattgtggctcatgcttaacacctgcttccttcagggagtctggaaaatggctatgagctaggtagagggtacctatgtgaccagccccccataaacaccctgagcactgagcctctggtgagcatccctggcagatgacattatatcagtgttgtcacaactcattgccagggttggtaggcacagcccatgtgccttgattaggacaggacctttgggaacttctgcctggtcctccagactttgcccaagtgccttttctctgctgatttggatttgtatcttttcgtcatgatttatcgtgtagtatatatgatatatgtacatttgtatctgatcatagctacgtgggtggccgagtctggtgagtcctcctagtgaatcacagaacctgggggtagccttggggccccagcacaggagtggtggggctaactttgcaggcggtattttccagagtcctttgtcaactgattctagtggagttcagcaaaacggcagacaagggagggagagggagcgggaagaaagggacaagctaggatcattcttccctccctcttgacctcagacagtgtttcttggaattatgggatctaaagctcccaccagacaggaccacacggttccagtgcctgacctaccctcagtcctcccgctacaacgacaccaactcctctctgctgttgctaattgtggagttgattcaccttctcgtgtttggtttcttgtctcttctctcacctgtgtaaccaatcccctgccttaaattccttcttttagaaagacctaaagtggtttttgttttcctggatgaaccccgtctgttacatgccttaaatatttacatggctccacttccatgccaggcagggggcattcagaaataaaagacaccatcccatccttaaggacctcagagcctatgcacctgtggaagttgcatccctagcacagttcaagattcactgtgtgaccagaaacctttgttctgatgtctcagccatataaccatgaggaataccctgtaaaatgaatgggcttcaaccgcattctagggcttggtggcttagacacatttttatcgactttgtttagcacaaggaaagccattgcatttatgatgctcttgaggttagtggtttgggggagtcagaaagccaaccactgtgtgtgtatgttcacaaagccaataattagtctaaggccaaaagtgacaccgtggaggtggttgtgagggtgacaatcctgttctgaatgcacaactcaaccccaagtcccaggggtacctggcatctgcgtaacctcatctgaagggtgcaagggtggctgctcatcctccaaccccacatggatgagggtatcttggaattctagacactcagatttgatgtttgccaggagaactaccagaatatgatcgttaaggattgggggagggtttaaaaaatactgaggagacctgaaattgtatgaatgctgaggggaagcagtgctagacatctttagggtctttctctagcactcagcaagggatgtggcaaagacggcctttggatagttaagtggtcagcagcctctctccagggaactctggctggagtccctacctttttgtactctagtgcaggtacagccaaggaaacagaaaatgatcatgcagtgtgaggagcactacaacaaggcaaactccttgcaagacaactggggagtcagtggagggagactgggcagggaagaaagatggcagaggaagatgatagggaagaaagatggaagccaaatggcagaagcttagtgatgaagaggaggagaggagaaacaacagtggaaggcagggagggtagattggtgttgggggaaggttttttaaaaatactggagacctcaaattgtatggatgctgagggaaagagcagtgctagaggcagggtccagcttgtataggccttgtcagtttcagcttgcaatttatccaaaaagcaaagagaagtagccatataagggctttgtgcaaataatttgatttcngattttagccctgaaatgctcattctgactgcactgtagagaatggactggaaaggggtacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagtgatacatctcatgttagacatgatgagcgtgtgttgtcactgggatgtgacaaatgaggatagccagtaggcacttagatacgggaatctgcaattctggaaaagatcttggctaaagacccagatttgggaggtgtcaggatatagatggaatttgaaaactatgggagttcctcagacaatcaaggaatattgcgctgcactggaggaaaccacagagtgttcaatgtcaaggaggcctaggaaaaataccttcaaagacagagttcaatgcttccaaaaggtcaggtaaataagaactgaatcctgtcttttggcctgagcacaggccttggagaccgtgacctccactttcagtagaatgatgaggcggaagccagatggcagatacttagtgatgaaggggaggagaggaggagtaacagcaggagtggggacataggttgggggaggtttttaaaaaaatactgaagagacctgaaattgcatgaatgctgagaagacccactattagcaagcaggagcttgaagctgcaagaggaagagtacgtaagagtcacagcaaagccccggagaacaaggcaacgcagaagcctggtttggagatgcagagggaggagggacctttccaacttcagtaacaagaagaaagaggaaaagatagataaggttgcaggcaggttcatagattggtagcagaaaattgagagaatttctaaccaatggcatctttttttttcttctttataacattgggagattgagtggcagggtcagaaatttgaagacagtaaagaaggttagaaatagccatgtttgactgggtgcggtggctcacgcctgtaatcccaacactttgggaagccaaggagggtggatcacctgaggtcagaagttcgagaccagcctggccaacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaagaaagagtaaaagaaaaaaattaaaattttagggggaaaattttctaatttttgaacatgcactaaaatgattttcagagaaaaccaagtgttattttctaatctgcatggcattattaaagatgtttactcatcttccttggggctaggcatcccattcctgcaggaagtcttgtggttaggcggtggctgtggctctgggatgattcaggaatgcagaccatgccttatttgcacaggagggacacgttgctctcactgcatgcatggtcacaactgtctgtgtgacctgtctgtgggagggcagacccccctcctgccaagccacagtagcagctgacctgccaggcaaaagcattcctttgtaaaggaaaccctcccagaccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggaggggagcgcctgcaggtaagccaccgnccctgcaccctatgagccagggcccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctggggctccccccttctcccccttagcactgtgtctcccgacagcgcgccacactgttctgcacccctggcaatgccrcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgkgggtgtgcmtggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcctccatgtggctcaatttccaaagcagttcctacctcctcacccctaagtggatttacttatggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaangctttagaagacaacatttntctggacatgsttgtgtgcgtttattcttaaaagtgacttataatctcataaatctgtatgaaatgaacatagatacagcacatgcatataacaggaaacatttcttgcgaagatgctgctgtaggattatggagggtgggggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttctttttttttttttttctgaaggaccttgtaaagtcaaaaatgtcagaaacttccaggaccgcctttggaggcagaagagcagttccacccaataactctaatgcagcggaagatgacctgcccacagtggagcttcagggcktggtgccccggggcrtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccggcagctgacctcctctcagccctgtcagtggtgacaaggtccaggtgccagcactggtttggtgatacagacatcattcccctgggccatggcagggacattcagactcatgtccccgagtggcattgagcagggagtcttttttgtcaataacattcatgcaccaaaatctaattttactcctaagggtgttctgtgctgggtttcactggggataaacacctatttgctgggataggtgagcatggtcatgctggagctgtgtggtcgattcccctcattagaaggagaccaatgcctgaaagcccagattgatgcagctctccatatagcaaagggaaaggggaagtgcagtttatccagcaagccagacacttgcccaggtgttgtggactggtgtcattgtgttactgtcacactagatgatttgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcatancccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtgnctgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatatatatatatatatatatatatatatatatatatatatatatatatgcacacacacatagcagcacacaaaccatctgaacaaggaggtctatctcctggttaccttttgcatttcagatttatatttaattgttctaaaagcaggttttctggcactatatatcaagttttctccaagtcactaagggacgaaatttgctaagcgactaaaccttggaaagaacactcatttttaaaatgccatcttcatgcagttcacccagtggccactagtggcctctaagaggccttgtatccgcggttaccaatctgcggatgatgactttggctccaggaacaccagcnccaagttaaactcttgtctccatttttttcagtggccactcttccagttagcaagctgctcttgtaatactgactgagaaatgcagagaggcaagaagaggaaaaggggggaaatggcggstttttcatttctaatagttctgtagcagtgagtcctgcccatcactgtgtgtgatatatacagtgttctaaggtatactgagtgtatataacgcccttaagtcatggctttggtaacatttggttaagaattattttggtaaaatctgtattttaaaatgtataaactcatgtaagtttcctctcatacacaccatgatattcaagaaaaaaaaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatacctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtaataaagactgtgactgtgatttatgcaaattgcagtgaaataacagaaatcaatgtctagcggtgtggtggagtggggaagaggatgaggagggcttcctgatgcaaggatattggagccgagacttagaggatgagtatgagtgttcctgacaggcaagcgcatggaaaagtgtttgcagtagagggaacagtatattgcaagtgaggagggactaaaagatgaaagagaagatataagcctgggaaaagatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggtgtggtggtgggcgcctgtaatcccagctactcgggaggctgaggcaggagaatcgcttgaacctgggaggtggaggttgcagtgagccgagattgtgccattgcactccagcctgggcgacaagaccaagactctgtttcaaaaaaaaaaaaaaaaaaaagtgtaaggagaaaatggagaacaggagatatgtttggaagctgtagagatactccaggctagaagaggaatagaccagagggattttagcccctggaggtatggggctcatttctcttgttccagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaataaaccagtttctcatggatagcatttatgcttatagttcaataacaatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagacaaaaagtaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttcctcatgtcttttccatttgactacagtctggaacattatttctttaaactctcaacctctctgtgtagcttttaatcttccccttcttagccaagttttattttttttttatgaaatgtctttctttgtttaaatcattttaagacagactttttttgtttttgttttgagacggagtccggctctgtcgccaggctggagtgcagtggcgcgatctcggctcactgcaagctccacctcccgggttcaagcggttctcctgcctcagcctcccgagtagctgggactacaggcgcccaccaccactcccggctaattttttgtatttttagtagagacagggtttcaccgtgttagccaggatggtctcgatctcctgatctcgtgatctgcccctctcgcctcccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgatataatttaaaacaaytgataytatcagctgtcataagaaccaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaastatatattatatatgtaaacaatatatttttaaaamccaaactcatgggtttatagttttttcatagtgaaaacaaacaaatatatagtttgcttatatctattatatataaacagtatataatatataaagatataaataatatataatatataaatatatatttgtaatatattatttgtttatatccatcatataatataaacacatgtaatatatataatttatatgaacaatatataatatataaacaatatatgtttttatatattatatgtaaacaatatatgtttttatatattatatataaacatatatattcatgatatatatgtatgtttgtttacactatggaaaaactataaacccatgagctggggttttgtctttttttttttgacttaggttttctattctcaaaggcattaatcagcaccctttttctcaccctttgttatcaacatataagcaggctagaaagacagtattttattccaatgtgaaacaaaactgctgatctggaggtcttatgttataaattcccacatcataccttcaactatatatatgtcctgaaactagcatattttgagaataaaatggmaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacgatgatacttttttttttttaaaaagaagacagatgtttcctgcgaatcaagaggagaaatgctttctatttacctgtggaaattcaaagcaagcctgtctgctcagaagacaaggagtataaaatggcatgcttccctgggaaggctggaaggccactgctaaaaagcttcccagggacattctttaccttgtgacttccattgctcagattccagcctcgcaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttggtgtcagccactctataagataggtacttcattcccatattaaagataagaaaactgaggctcagatagattaaataacttttctgaggctgcacaataagtaagtagtgaagcatttccaaaaacatattctgaaaaatgcagatctccaaagaaaaaagtttccatagtcatttacatttggaaaccattgcccctctgagatatctgtggtatacatcagcatattaaagtctcacatgaatgcttcagtaaagaatcctgatcagctttggttaggccagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctcngcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgcctcaaaaaaaaaaaaaaaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggtatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtgkcaggagctggaatgacatscagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagcagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttawctgtttgcttgtttgtttttacataaatgatgcagaaataactgactctccaactggaagaaagtttaaaaattgaccctcatcttrtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttactttttatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcattcaggaagttacatgagagcctcaacttcatggctgccatagttgtaagacaggaagaaaaaagaacattgctggggaaataattctcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcacacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccrgtaccagccactgcaaaatcatgccaaaatgtaaagaccatcaagactaggaagaaactccatcaactaatgagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcaggagaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatatttaggaggcaaaatctgcaggacttgtgttggggagtctgtgaggggtggaagggaggagggtcaaggtcyacttccaggtggctggcttatgtgactatgatgacagatgctagcacttccaaatgagataaagaatgcctggaattccagagggaaaaaatcgagtgtggaaaatgctaatggaggtagtagcttcattgataactcattggcactgmtgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccyagggagcctccaccaaggagatggtggaggtatgaatatgcttctgtttgaattgatgagtgtgaattacttgagggactttcaggtaaacctgtccaatagataatatgagtctgaagcttcgggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctntactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtgttctctatgaacacctgtcatgtgagattctccttgggggaaaaaagttccatcrtcaaatayagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagaacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaacgtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacrgcaccaaagtatgttagcagcagtgaatccaratggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatnaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccyagcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatcnttaggcaaggatggtccaacctcaatacggtttctttacatccctgtgtttcagctacatccgtggtctcntgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccantaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggaccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacanggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacntttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagagggtgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttanaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaatggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctgtactcccagctacttgggaggctgaagtgggagaattgcttgagttcgggagttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaattcatcctccatgtgtatgaagataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcascacgcttggagcacatcagaatcacctggagggtcascacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactgnnnnnnnnnnnnnnnnnnnnaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcagcacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcacccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcsccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaangattcagcgctatggcctggtaactggaaagtaggtcaaaagagaggggtgagactgtcncccaagtgaaaaagatagcagaagataagaaggaaaactgtttccagaaattgtcaaaagacagccaggtgaacaagattgtggnccgangtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagtgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatyattaaattcatccttagccwatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaagcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaancatttgcttgtgcttcatagattgattccattccagtgttactagataggmaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccscaaattttcttggcccactcttttcttttttaactacccttcnattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcmcattggtcatatagactaatttgggtagaatttatatctttacattastgaatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatrcagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtccaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacnccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactggccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaantcattttcaattcatctagttttctattaatgttaaaaggttggaaattatattttaattagtgttagagangtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttattgtcaaggacatttttacttcatattttttgtcacatgtatccctacaggatcycatatatcgatattagacaagcayaatttcctgctttttaggatctgagactccwaggcagagagcataggagtagggactcataaagacaactgcgtaatttatcagctgaaaccacatatctctgggtattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttktttttttttaagtgttagcctagggtactgctaattagaaaagagtgttatcatttcatcaaaggaagggccactgagcttttacatagaaagattttatcagctgcaagttgattgtctagacacaaagtagcaaatggcatttctttaagatgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcayggaatctggtggtcacagggtactttcttggctccrgatgccttgctttgacttccatatgggatctccctgtgttcctyacccactgctccagtacccgtgttatcctgcctacctggctttgtgaacagcttccctgactccggagaattacatgcccagtgctcaggctycccygcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggyccaaatatgacaatctatagatagctaacaaggggaaaagtcatcaaggtgggcagcaaggaggtctggaaaagtgtcccaagcccagtcagggcactcttcgccagcttgcctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccagttagttgctatcctgcccagcaaayacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcctgtggctagcagttctttctaagnagactgaactggtaccagactcctcccttgatagtgtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttcnaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaagagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgactataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgcacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctancagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcagggcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgntactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgaattgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagagggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttcycatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcagaaaaaggcagaagcctccggtgttccttgcaacctttccaattytaacgcatatcaattagtaggagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaataccataaggtcaccttattcaccagggattttcatttctgttcattgaagatttttwaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcctcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatttgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcattcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactcagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttaacttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttgtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttgttgccygtgtactttggtttttttgttttttgtttttgctttttaacttgtatttttgtttcataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttygctggatacaaaattcttggcygataattgttttgtttgaagaggctgaagatagggttccaatcccttctagattgtagggtttctgctgagaaatttgctgttcatctgataggttttcttttataggttacctgatgcttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaayagcgcctattccggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttcagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggactacagtattagaagatgaacaatctttggtatcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtacgtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttccccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacakagcatccagtctttgctaacacttggtaraactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctsagattctgaattcctamcaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccgaagaaatagagggttacagtaaaaatatagagaaaaaagccattttcttttcagccaccacattttaaaaaaactaaaacagttaaaactaaaataataaataacaaaagatatatattgcttatttatcattgagaagttgtataaatatgcgtatttatttattattgagaattttataaatatatmcacttaatttttatcccagttatggaaggtattatagcaggtggtctcatattcatttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcatgcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaaaaaaaaagtcatgagttttgttttgttttattttcccatagtatcaaacaggataagattattttcttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatccgttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcagccagaaacagaatgagagtggcaatcgttttattgataagaccctgggtgaacagggctgaaaatcaagaaaggaaaatgggaacgggaggcccgtggcagctgccactgttgtttggggcattaagatcaagtcctttaaggagggggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcagggagggcatttggattaagtttaatcagtaggtacatatggcaagaaaggtattcagataatttgttatctattaaaatgaactaaaatgaatctgtggtgtcacccaccaatgcatgtcacaggagcaaattctggccaagacagcaaattccaccaaggacctactctgtaaattcctaacttcctattagtgggtttttaaaattgtattttcnggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacgatgccttggaataccmgcaagaattgttaccaattatttctctgcccatgataatgatgccaatttgcaaatggacatcttcctggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcatatgcctatactagttcctctctaccttgatatattaatattacagttaatagcagaagtattggagccaagcrttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgnaaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgngctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggctggggactcaggaacctcagaagggcagagcagggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtcagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatgctgttttggttactgtagccttgtagtatagtttgaagtcaggtagtgtgatgcctccagctttgttcttttggcttaggattgacttggcgatgcaggctctcttttggttccatatgaactttaaagtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatgcttattttcaaacattttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtcccagccaataagtggcagaacctgaattacaaacccaagggggctgaccccagagcccactctttttaaaatgacatccttattgactgggcgtggtggctcacacctataatcccagcactttgggaggccgatgcaggagkatcacttgagatcaggagtttgagaacagcctgaccaacacggtgataacctgtctctactaaaaatacaaaaaaattagctgggcgtggtggtgcatgcctgtaatccccgctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggcgaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcagagggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcaccccgccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgtcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttaatttgatatcaaaggatttcacaatcttatcctyacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggtacctagtaagttctgtttcgttagtcagcagaaaatggttaagattaaaactgttcaatgcactgattcaaatatctttgggtggccttgaagctgctcttagcagagggaaagagacatccagccatgtgagtgtcctgagggatgccaatgagaatgaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcaccccccaggaaaatagcgatggtaaaactgtgtcctccctctgggaacttgcttcattgctgatctttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctggcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacayygcccttcctctgtgcaatgcaggcatgtatcggtgtggccccgcctcggttcaagccatcaagcacggccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacatttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgcngtggcagtttacagaagcctttggagaccaagcttactggacttggaattttatcccctcgttttcactttgggatttgaagatttccacaaacctcccagctgtcatttgatagtttatgatgctacgagagcccctaatgaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcngaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggmacactgacacctyacacrgcagggtatwccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggayggagaacgactttgacgagctgagagamgaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaawgmaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctgaaagggaagcccatcagactaacagcggatctctcggcagaaactctacaagccagaagagagtgggggccaatattcaacattcttaaagaaaagaattttcaacccagaatttcatatycagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaatncccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcacgatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctgtgagaggtaggacttatcacaaggacagaggagggagaaaaatggttgcttcttagacantttattatctcagcctcaaataatctttatttaaagtactactaaatcaactagattcgcctttagaatattttcaaaacctgtttggccctatgatacgaatccaatgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacytgtgaaagacacgtcacatatgcaatttttcattgtagttttctttgctagcttgctttgggcagaattctcattcacgtggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagataatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgctcyatgcctgcaattggtttggtgctggcgattccagcagtgagcaggactcagttcctgtcctggtccgagtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagctgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagtaatatctgaaatgtaaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcctgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttnctgatgctcgaatttscctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagccaaagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttggggncaatggcaattgagtgagatagggaagaacggggcaggagccctcaagggtcagctcagcaaacagcaagtgggacaggcccangtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcayagcttatctctcagccaacatcaccttctacaccggggtccygaaggcaganttcaagaaggagacgttcgacrtgacgctggagcccttgtcctgtaagctaacaatggtgtggttctttgtgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgcgatgatcttggttcactgcaacctttgcctcctgggttcaagcaatcctcctgcctcagcctcccgagtagctgggattacaggcacatgccaccacgccaggcaaatttttgtatttttagtagagacgggrtttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgaaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaagaaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaacactatagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatcngcaaaggggaaaaacagcacacacaccccggggttcttgattcattcccctaacctttatttagtgcttgcaagtccaggttctgttttatgctggagacacagcaatgcctattctnactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaacttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccgctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagangaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattaattgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacaatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcaataggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgtaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgcgtgcttgtatgtgtgtgtgtgtgtgaatgaatgtcctgctcaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctcttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgagagtggaagataaatgtgggagcctctgtgctcctacttctcaggcccacagctgtagcttctgggggcatctgtggttgcatccatgagacgccttcctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttgggtaactactgggctccagacgctgttcttaaagcactttacatggttgcattttcaaccaccaacaaccccacaaggtaaagagtactggcatcactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctnttgcgcaggtttcatttatgagctcaaccctgaaccttccctgacagcagcnaggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttntattgttttgtgtttccttccacaaagsaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatcatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagagggyaggtggacggcagtatgtagagcagtgagaagcgtgccttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggattttactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtatcactgttgaccccggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccagcctcctgnnctctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctccatcccctcgtggctactttcacagaggattgtggccgtgggaccaaaccgtgggtgcccttagccaggatagatgatcgtaaactatgtctatgagtgagccctcctcatcgaaggtgttcatttccatctctctcttcaggacagctacagaacagtncacattttagaatgaaaatgaggagtcactggtaactgcggtacctaaaacataatttgctctgtgcatttcatgtttgctatttttttgaatcttaaaaagagacacacatgagaataaccaatctcacattccagtcctgtaatcccagtatgtttgggctactgattctctttttaaaagtggcatctntcatttttaaaagagaaaatcctagatagtgactcctattatcatcaagtaatatatatcaaggccccaaggctancttgtcacattttactctggcatagaaatctaattccttctctataaagtcaaaaagagagaggtgagttatagatgttttctaatttagttnagggtcaacttataatcctcgtcctcaactgatggtttagcgataacttaaaaggtgatgctgcaaatgattctttgctggatttcagaaaataaagaagctattccagcaaaaaaaaaagtttctatttttacctstattctgtcagggatcacagtatangtagttttgaagatgaawgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaartgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcntgtttaccaaagaatcagagtagcagctcattatcatgaattagtataaaggacaggaatgtcaatatcagtaagtgatatgtaacttgaaaaagcatactacgggttgatttttttaaaacagagagagatattttcaatagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctycagttacatttcccaagcagaacacastgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgtagagccagtctactggtatggraagggttcttaatctagggttcaygggcccctagaaaaccatgtatggacttcataggtctatagtrcatcccctaaaaatacatgccyatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacntggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgngaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgccyctctcctagttcccctgaanccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgsctcatttccatatattttctcccatattatatagtggctaaagnaacatggaatagtaatggctgtgttgtcatctggaagatccagacatccagtaaattccatttntgagccattgacttaatttaataaatatttactggacattggtattgaagtactaagtattggagttaaaagtgggctgaaatataaggtgaataagacaaactacccagagcattgctaccctaaaaagcatcaactgtaatgcattgggcctttgccatgtgccttgcaatatgtttgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttccttattttagtatccaggttcctcttcatgttcaacagtaaggactccatccttggcatatttcttgcgaatgtgtctaaaactaagaaggcacatgtgccctgaagcattttctacttcttaaactcaggaatcccctttgttccagcaggaaacttgatgcctatccagaagcaaagttcacttggccgccctcaccgtggaaacgtgttgccacaccaaatgaacatccccctcctgctgtcaaagagcagtcagtggccaccgctattgacctgagctctaattaggctggttttataatgaggaaaagagtgcgattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacarttsagtttaccaatcctttaaaagaaaccctgcgaaatgtctgggtacacctggatggtcctggagtaacaagaccaatgaagaagatgttccggtaaaccttgggttggggagaccgggcaggcagtgcagrgctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatccttaaagacaccctacgatgtagatactgctattatctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtagctctaacagtaaggaaacaggtttttctaccatttgatcctgccaatgatcctaattctgccatctggactgacagaaagtaaggcccatctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaatctttgaggtttattactttcatttctaccacagataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcytagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaayctttatctgagtgtacnggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagangcacagaggacaaaccatgggcagttgcagtttattgtaataataatctnatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttatctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggagacaagctagagttcagttgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggaygtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggcyccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcagnagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagytctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatacwgggggcaaaatcagaatggaatgctctggtctatataaccacatttctaagcctttgagactgttcctgagccttcagcactaacctatgagggtgagctggtcccctctatatatacatcatacttaactttaytaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgcatctgtgcagaagtgaatgcttttaattttcaatataacacactactaatcacaacttcttgagaaaccatccttcctccgcagtagacaacccaccctggataggaaaacaacaagcatttatcctctaaagaaaatgactctaacaggtgttaatgtcacagttttcttcacctctctctttctacattttattaactatattcactgaaggatcaagttgcatattagttcaaaaaccagcttccagaaactataaaatctctgtagatattttctcataaataatcttatgaaccattatggtgaatcagtggatagccagcatggagacctagcataacgaacacatgttatggtcttatgataatcacgtataggagatcctatattcatggcagacatcactgaacaattgtagctcagataagacctcagaatctttctcatttccaggtagcaactagcaattgattttaaactggcacacaatcaatagcttaccaatgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagggttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactactttaaagttcatatggaaccaaaagagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggattaaagacttaaacattagacctaaaaccataaaaaccctagaagaaaacctaggcaataccattcaggacataggcatggggaaggacttcatgtctaaaacaccaaaagcaatggcaacaaaagccaaaattgacaaatgggatctaatgaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcgaaaagtgggcaaaggacatgaacaggcacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactattggtgggactgtaaactagttcaaccattgtggaagtcagtgtggcgattcctcagggatctagaaccagaaataccatttgacccagccatcccattacttggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacactgcatattctcactcataggtgggaattgaacaatgagggcacatggacacaggaaggggaacatcacactccggggactgttgtggggtggggggatgggggagggatagcattgggagatatacctaatgctagatgacgagttagtgggcgcagcgcaccagcatggcacatgtatacatgtgtaactaacctgcacaatgcacacatgtaccctaaaacttataaataataataataaaaactgagaaaaaaaaacattaacaactggtgaatgtaagtgaaggatatgtgagtacttattgcactgctcttgcaaatctatagaactaaaattttaaaaaataaaaatttgcaaaataaaagaaagaaaaaaagaaactggcacgcaagatggaacctgtttgtcatgcttacccttagagccagcccattccctttgatagctaggatttcatacatattaatgctatggctctaagagttatgatttagcaatgataacaagcaatgtgtctcaggtagcagcaggactgtgagttctaactctccctgagtctctacctgtgctagtcctcagtgtttttaaacaaatccttattggtgtttgggacttcaaagacaaaagaggggaaacataagaaacataaatatttctgtttctcctgggggatatctcaaacaacctcaacaacaacacatataagatgatagatagatagatagatagatagatagatagatagatagatagatagatagatatagatagatatagatagattgttttgcaaatatttcacctcatcagccctgtgacagaagtaaatataactatctccataattaagaacctaattgagcctaggaagccatctatcatggcaaatcaatctcggggtggcagtgagcagtgaaacaactctggtttcagagtcaccatttgctgtacactgtttaaatcttttgttgcctccttagagttttaagaatgctggcttaagaccaacttcaggatgctttgaagagctgcagtagaacaacaaataaaaatatgtataaatttgtattagaaatgtcatgggaaattgagtttgtgctagactcattggcaatcaaaagtcacaaaatcccagggggaaagtcactgcctatgaacattcgtccaatgttattacaaagttaatcgtcagcgaacccaaccatcaattaattcaccttttcgacaatccagccatcccctgacatccagacaaccatctagccttccaagccatctatccatcctttttttccaacaatccacccgtgcacacatcaggtatcactttagagaacagggatgcaaagataaaaattccatggttcctgcccagaaagagttcataaagcagaggagtagcaagatatttaaacagataatccacaaccaaataatagagctatgcccagggtgccataggaatgaagacagaaagatgtctaaagaagccttcctcaatgtgcccaggaatcaaggaggaaaggttcagattgaatcttgaaaaaataataggtaagttggagaccatttaacaaagaggagctcgtgtaacaacatagagagaagaccatgaacatggcccccaactggcttgagatggagagatggtaagtgtccagtgagaagaggtggggccgaaaacgcaggaatgggtcagagttggagcacttcccgaaatgagaatttgtttattctcgtctgtattgtagagtagaactaagagaggctgctaggaacaaactagatacaaaactaaaagttatgcgtggctcaaggagtgacagggccaagaaagtagggggtggaatgccctaactcaggccagtgaagaaggtgtcagaatgggggtgtggccacagttggattcaaggaagggaaatgagacatacgaggctcaagtggataaagtgggagagatagcatgtagagacagagagctgtctatgtcagaaactatagaagtgtagacagacaagttccttctagggcagccaagtaaaatcaccatgagcaggtagcgctgaagacccagaatcttgcccctcaggtcatgcttatgtctgtctttgaggcaaaattctctccaacccagtatcgaaaagaaatgaactgcttctagagacattccttcacaccttaaggcaagttcgtccttctgttctcaccaccccaactcattcagactcaagtttgccttcccaagcaccttcctttctacataagaatgaaacaaacaaaaagccttttagtgtgtctgtaagaaattactttgtcgaaacaaacaaataaatgagaaacaaagcgcctcagttgcatcgggaaaagggacagggaaactgtgttcacctcaattgccaggaattatacacagcattttctagctctaaagacaatgaacatttttaaaagatacttggtaaactagctgttgatactactcatgaactcccattcattttcacactaatcattgttctaggacttacataattacctaagtaacgtttcaatagtcccaaaactaacataaggggtcctaatgagcatttcctattagtaaacagcatgtacctataaacgaagaggattctttcctctcttttctgatttgagcaagtttagacagtgggaaggtacaatatgaaaaatatgttaccaccagatttaggatttgttataaaggtggcagattttaaatgaccataaaatgattgtcactctttccattgagaaatggggaccacattccctctcctgcccttgattttaggtgggccgtgactgctttgaaagaatgtgataaaagcaatgctgccagttctcagctccaagccttggaaaactggcagtttccacttattttctcttgaaatcctcttcgtagaagccctgagcttctgcctaaaggctcaactactctgagactcccatgctggagaagccacgggtatacacacttcaaccctgctctgagctcagccttccagcgacctccgccaaggcaccagacctgataatgaggccatcctgggcgctccagatcagccc

SEQ ID NO: 10676 - DNA, 92834 bp, Homo sapiens
  misc_feature (1)...(92834): n = A,T,C or G, or insertion/deletion polymorphism (see Tables 1-2)
agatttgaggaggggtctgttgtgagccttctgagaaaggatttcctccttaataaaaagtgacatttagggaacatgcccttattctttggccagatgctgttgtgtattcatgtgatacttgaaactgtggctgccatctgtgactatgagtggacagtctaaggatgaaaccaatatgctgagaatgacacagtgaatgatagggaaaacccaggtcctcaatgatatgcagagtcctgaactcaccttggacttgccctgcctctttagttcttttaatatgacataaaaaatgtcttttttttgtttttttgagacagggtcttgctctgtcgcccaggctggagtgcactggcacgatcatagctcgctgtagcatcgaactcctgggctaaagcaaccctcctgcctcagcctcctaagtgattggtactacaggcatgagccaccacgcctgactaatttttgtattttaaaatatttatttatttatttatttatttatttatttatttatttattttgagatggagtctcgctctgtcagcaggctggagtgcaatggcrccatctcggctcactgcaacctccgcctcctaggttcaagcaattctcctgcctcagcctcccaagtagctggggactataggcgtgcaccaccacgcccagctaacttttgtatttttagtagagacagggtttcaccatgttggccaggatggtctccatctcttgaccttgtgatccgcccgcctcggcctcccaaagtgctgggattacaggtgggagccactgtgcctggcctattttttttaaagatggggcttctctgcattgcccaggctggtcttgaactcctggcctcaagcaaacctcccacctcagcttcccagagtgttgggattacaagcatgcaccactgcacccagacaataaatgtcattttaaaaactgttttttgttgaatgttctgcttctcaaagccagagtcatctgaactcaaacatgcagtatcatatgccaccttaactcctgccttctacccccaaaattcaccagaagtgaaagaactgaaagatttctgttaaaattttaaacatcagctggtcttggtattgtactgtaatgactatggaaagtgcttatagtattttattatatagtcacagactatttctgccacccttcacatgaaacagatcattaggtattcatgagaattatgaagacatctcttctcaatgtccctgttatttggacaaataacaaaactataaaaggaactgctgtactcctacagatgttttcattcatttggacataatagtttctgaatttaatttttataaaaaggaaaatatagccaaattctataattctcaaaagctgtcaataaaaatatattgaaaacttttcaagagaaaatcaattatacacatgatttttttaattaaaaaaataaaaaatgtagaaagtagaaatactacaggcatacctggttttgttgcactttgctttattgtgttttttacaaattggaggtgtatttgtctgttctcacactgctaataaagatatacccaagactgggtaatttatgaagaagaagagttggccgggcacggtggctcacacctgtaatcccagcactttgggagactgaggcaggtggatcacgaggtcaggagttcgagaccagtctgaccaacatgatgaaaccctgtctctactaaaaatacaaaaattacctgggtgtggtggcgtgcacctgtaatctcagctacacagaggctgaggcaggaaaatcgcttgagccctggaggcagagattgcagtgagctgagatcacatcccaaccccagtccccagcctctccctctccttgggcctccctatcccctgagacacagggatattgaaattaggccagttaataaccctacaatggcctctaggtgttcaaatgaaaggaagagtcacacgtctctcactttaaatcaaaagctagaaatgattatgcctagtgaggaaagcatgttcaaaagcccagacagtctgaaagctaggcttcttgtgccgagccgttagccaaggtgtgtatgcaaaggaaaagttcttgaggaaaattaaaagtgctactctagtgaatgcataagaaagctaattagccttaatgatgatatggagatacttttagtggtctgggtataagatctaaccagctataacattctcttaaactgaagtttattccagagcaaggcggagctctcttggattctgtgaaggctgagagagatgaagaagttgcagaagaaaagtttgatgctagcagagttcggttcatgaggtttaagaaaagaagccatctctataacataaaagaagtgcgagatgaagcagcaagtgctgatgcagaagctgcagcaagttatctggaagatctagctgggattgttgatgaaggtggctatgctgaacaacggattttccaggtagacaaaacaatcttatattgcaagaagatgccatctaagactttcataggtagagaggagaagtcaatgcatggcttcaaagcttcaaaggacaggctgactttcttgtaactggctattgcagctggtgattttaagttgaagccaatgcttatttactattctgaaaatcctagggcccttaagaattacgctaaatttactctgcttgtgctctataaatgaaataacaaagcctagatgacagctcgtctgttttcagcatggtttattgaacagtttcagcacatttttgggagtattgttcagaagacgtgattactttcaaaatattattactattgacaatgcacctggtcactcaagaagtctgatgaagctgtacaaggagattaatgttattttcacgcctgctaacacaacattcattctgcagcccatggatcaaggagtagttttgattttcaagtcatttaagaaatttcatggggctgtggctgccatagtgattcctctgatagacctgggcaaagtaaattgaaaactttatggaaaggattcaccattctagatcccactatggacattcacaattcatgggaggaggtaaaaatattgacataacaggagtttggaagaagctgattccaaccctcatggtttactttgaagggtttgagacttcagtggaggaaatacctgcagatatgttagaaatagcaagagaactagaattagaagtggaaactgaagatatgtctgaattgctgtgtctcatgataaaacttgaacggatgaagagttgcttcatatggataaacaaagtggtctttggagatggaatctcttcctggtgtagatgctgtgaacactgttaaaatatcaagaaaggatgtagaatattacataaacttagtggataaagcagtggcaaggtttgagaggatttttttattttttatttttttgagatggagtctcgctctgttgcccaggctggagggcagtggtgcgatctcagctcactacaacctctgcctcccaggttcaagcgattctgcctcagcctcctgagtagctgggactccaggtgcgtgccactatgcccagctaatttttgtagttttagtagagatggggtttcactatgttggcgaggctggtctcgaactcctgacctcgtgatctgcctgcctcggcctcccaaagtgctgggattacaggcttgagccatcacgctcggcgatttgagataattgactccaattctgaaagaagtttaacagtgggcaaaatgctatgaagcagcattacatgctacagagaaattgtgaaaggaagagtcaacctatggtgcaaacttcattgttgtctattttaaggaattgttacagccatccccaccttcagcaaccatcaccttgatcagttagcagccatcaaccctgaggtgagaccctcctccagcaaaaaagattacaacttgctgaagactcaggtgattgccagcatttttttttgcaataaagtatttttaaattaagatatgtacattgttttgttaaatataatgctattgcacgctttatagtatgaacataactttttttttttttttgagatgcagttcactcttgttgcccaggctggagtgcaatggcacgatctcggctcactgcaaccttcgcctcccaggttcaagcgatctcctgtctcagcctcccgagtagttgggattacaggcgcatgccaccacgcctggctaatttttgtatttttagtagagacagggtttcatcatattggtcaggctggtctcgaactcctgacctcaggtgatccgcctgccttggcttcctaaagtgctgggattacaggcgtgagccaccgctcccggcgaacataacttttatatttactgggaaaccaaacaattcatgtgactcacttaattttgatattccctttaagtgtcagtggtctggaaccaaacccacaatgtctctgaagtatctctatgtatttctacttagcttgttaaacagcaaacaagatgagaatttagaattttaattcccaggaccattttcttttaaatataggtccatatccataatatatattccataatataaagataatgaagaaagatattgttggaattcttctagtctgttttaggcttatggatagataaaaaggtgcaatattagttttcttctctcggaaaaaaaccagtattttccagaggatttcatggttctagaagtactacttctaaagcctgcttctctctgcagagctgcgaatgtcttttcagataagaaattctgcattccatttatcttcaggatgtatcctttgataagatttcaacagattaatgagcaactgaactgccatattttgaagtgggagaacagtttgcctgagtcaggtatccatccctttaggttctcgattggccctnggcccacggtgagtgagctctctttgcttggtgcatcatcgctccacctagttcaagttctggcggcttcctgattttgattctcttgggaaatgaggcctgctttagcctgaggctggctcaggaaggcaacctttcacctacttaaggaaaagttcacaggcaaactaaacaatatgttgggttaaaaaaagagaccaatcctactagtactgggtgagtgaaaatcttctctcttacagtacatgtagttctactacctgcactggatgctttctttcttatccttgtttagtgtctaaaacgagaaacaatggcaaactccttaaaatacagaaccactgtggattcctaagaacgttcaaaaacaataatttggagtaaactttattttttgaaaagaaatagcaaatttgcatggtgagtgcatttagaggaaaacgggttatatgctaggtcaagtgaggccaaaacaagagaaatgataatggataagctttgagtttttgaggctcttcttgccccaggcagttccaaaagccattttatttggcaggatttgacagcaatttctgcaagaacgggataactaatccagttaaaaacgaaaaagaatatgcatactatttcataatttatattgaaatttatacattacagcaataattgtgcgactgtaatttttttttttttttttttggtggaggggtgttttttcctggagggacggagctcctgcagaccctattgggctagccgctcctcccacgtcgctgccgcagatccccgctcccctcccccacccgcggtccgtccctcctggtcgaccccgttcccgcccccgccccgcgcagactgcagccaggtccggtccgcggcggctccgcggaatgacccgtagtaacctcgccccgccccgggccgccagcgccgcgctccccggcccgaattcgataggcccagccccgcacgcgccaccgctcgckggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggtgagtgcggcgccggttgtgggagcggcgggagccggttggcggcgcggcctccgcgtgcggttcggctgggcccgaggggctccccagcctcggggcctgggaccctgtcgtcggcgccgcacctgaccgctgggtgtgcgcgcgggcggcccgcggcaccaggagcagcggcgagcagggtgggaggcggcccgctggggtccgggaagcggctgacgtggggcctcggccctgagcccacgcgagccgggagctgcagcgcgaacggcgtggggcggcgctgaccaggcagggaggatgcactgcgtgcctcccggcgctgtggggcggggtggggaggccacccccttgaattaagagggctctgccgcggccccagcagtgcggtgtccgtggaaggagactcagccctgcgatttcggaaaacccttgtttggcggggcgggaggggctgttgctgcgtggggtgagaagaaactaggtgcgtgaggtgggtcgaccttggtgattggttctgggcactatcgtggtggtgggactgggattaagactgtcgtttggggtttgagagttgcagctttgcttttccccaagtgcgttttaatcatatactgttgataggttgggtaactcggggactgcttactaccagcagtcctgtggggtaggtgttatcaggctcgtttcacagatgaggagcccgaggcacaggttttcaaatggttttcgcaggaagtctgatactagaaagtgtgctctaagctgctgtataaaagatccctcgaaaatgaaaaggctggaggaatgtctttaaaattatatggaagctagaaaggcagtaggctttgtgaacgaaattatagctgaaaagaatgacaaatagctgacatttattgagcttttattacatgccacgcactgttnggagagctttatgtacagtgtcttcacactgttaacagtcctctggggtgggggttattcccattttacagcgggagaaactgcagattggacgacttagcttgcctcagatctcagctagtaagaagctgggattcagacaggcctgtgtaaatccagagctctgaaatctaagcactatattttgctgcctctccttggtggctggctgaatagtttccacagtggattttagtctgggtggccaggagagttgtagtttgatgataccttctttcatgtttatcaacctattttgtttccccaaatkagttctgagagttaagggtgctgatgagttgctcctgaaagtgtattagaagggtattataggggacaggtggtgtgacatgggaatcttttgcacagacttgattttgttttctggcatttttctgggcagttcctcacacttggggatgagtaagccttctaattgtcgcatgcgttttctctctagacttttcctggtttctcttttgtataaaaatattggttttgtaggatgacattgggtgtggggcagagtggtccattggacctaagggtcaaggtgacaagtcacctcgtatctttggatctcagttactgaatttgtaaggctttagactcagtgacttaaagcttaaatattctgagggtctaaaatgttctccttgaaggaagaaaggaagaatgggagaaatgaagaacgcacaaattataaggggaaaatcatcctctgtctggtttggggtgagaatcagatcttaaagcctcgaggtctgtttcatttgcttttgtgtttccctgctgtttggttccagttaagtgactgtttcattcctcatttgattaattgactcacctagagccatttaatttttgtgatatgtcaggcaccttattaggtgctgggaatacagctgtgaatagagggaaaaatagacaagaagcaaatggtcatacaaacggataggtggttgcaagtttgataggtacgatgaaggaaaagtattgtgtgaatgaggattatgagcaagattgtgatgtagatggaaatctagtctagggagctgttttttgaattgatrtggtgagattttgctagaggacagtcttgaaatctgagcctgcaattatgtacataatgcaagagtttgggaagttgtcagcaacaataattcttttcattgcacagtgtatttcatactcagaatgtcatcccggctctcattgcaagatacgaaaatgagataggcaactttacaagttgtcattctgtctgccttcagggtacttaaagcttaaatagtcctctaatactttctcccactcaaaatgaactgtaagggggagtaagactctttkatgtgagatttgggcttgaatattggatttagattttttttaggaaagctaggccaagggtgataggcttttaaaacaacgagcatcataatgactcaaaagtatccattgtagcatacgcttcacagggtcatttaacttaaaagtctcatcatcttaggagatcattttttgatggctggattgggaaatatagattgttaaaaatatataaatgtctcagttgaacatgtatgaagccaattcaaataatacattgcaatatatttacttaatggccatctgcatgcaaaacaccgtcctaggggtaccatgtggcataaataaaaaagatgaacttgccaaagttactgctttcaaagagatttcagttaatgtatactaatactcaaatttaaggtttttttttttcaaagtgctagcatatctcatctgatccttttaagagccatatatgataaacagaaatactgagaaaatggagataaaaaattgtcaggatatggtgataaatagtaaatggagtgggagaaagaggtgctaagtgattactaggtttcagacctatgcaactaaagaggtatgtgtgctattcactgagctggggcttaactggtagagaactaggttctggatatgggaagggcatgactttagttttggaagtgttcagctggagctgcctttgaggcctttattgaggtactggttttgtgctgagaattggggtggccatttaccgttttgaagacctccatgtagaggcaagagctcaaaccatgggtatgggtgagattgcctgtggggaggctatagaataagaagagraggaggcctgggatggagctgggcagaggaggttgagcttgtcaaggagacaagagtggccaggaaggtcagaggacagccagaaacagatgttcctgcaaggcgatgagtcagtactgtggaatgctcctatgagagaagaattgagaaccatcattgaatttagcaacatggaggtcactggtgacctttgaaagagatgctgatctgcaggtaggggtgggatggggagcagtgggaggtgaggaaaacggagacagaaactgtttccaataggtttgatttcagcatgtttaaatgctgatgggaaggctcagtggagagggagtggttgaatatagactagaaaagggtttgtgcagagttcctaaaaggatggggttgggatgggacccaaagtacaactgaggcctgtgtctttgctgggaggaggggacaccttccacagtaacagaatacaggcctgtaacctatggagtactaagcaaatgccaaaaattgtcaagaactgttaaatttctaaaaattagcccaattttagttgactcatgacagtcttttagaaaactttgttgcaagagcattgtgtgattgatttaaaatgtggctcagtcttaatttcatccctcaatagagtatatattttcatctgacttttgattgtaatttatttattttctgaaaaaggagacattgtaaatgttaaatcctgtggtgccttccttacatgtttatttttggtttcattagaaaaaagctttcagacggtttctgttttcctgacatcataggtgccttaattcttttaatttaaagtttagcttctgttattattggaatatgtttatttacgtatttttgatgtttcccattttgaagggtaaagaattggatgattcagtagtttcaactgatctgctaatttttgtttagaattgaagatacttaaataaccaaccttttggataagtggcctccaaatacagctttctgcttgtttgtgaaggtatttgttattaaggattcattcattcatgtatttacttagtgtctgttttgcaaggtactcggaatttggaaatgattgggcgagttcctgctcttaaggagctcacagttcaccacaggaaagaggtgtatgaacaaattacagcatggtggaacagaagaaggtatatgagcaaatatattacaggatggtataatcagtgcagcagtggaatctgctaggaaatagagaaaaagtgcagagcaggcacagagtagggaaggaaaaggggagacttctcagtggagatgatagctgaactaggttttccaagatgaactggagttttcccaggtcaacagggagccaggaaatagaatgttttaccttgattttggatcctctgtgtgtgtgtgtgtgtgtgtgtgtgtgtacacagatgtgtacgcattggagatgttataacgctaccaaagaatattgttagaaaaattaaaaattgcttatcttactatcctcatgttgattgctctagctgtgaaaagctgcacattttcccctgtcctgtcatggtcaacttttctgtctcctatttgatgcagaaagtaactgaacttaattatattatttggatacaaagcctagtttttgtttttctaaatgaatggtctttggaataaggataatagccaacacctttatagtatactgtggccaaatgctgttctaatttttatctcagccttgcaaaataggtacttttttttttttgagacggagtctcgctctgtccccctggctggagtgcagtggcaygatctcggctcactgtaagctccgcttcccgggttcacgccattctcctgcctcagcctcctgagtagctgggactacaggtgcccaccaccatgcccggctaattttttgtattttcggtagagatggggtttcaccatgttagtcaggatggtcttgatcttctgaccttgtgatccgcccgcctcgccctcccaaagtactgggattacaggctgggagctactgcgcrgactgcaaaataggttcttttatcattctaatttttacagctgaggaaactgaagcacagagcaatttaagtgacttgcacgattgtgtgctaaatgtgtgctggatttcatcccaggcactttggttccagagtccctgttcttaacctgggcgctgcatctcctctctggagtgacagtttgaagttcatgttaacctttgaaggcatgattgtgtagggaaaggagctgtgatgacatttaggggcagttttatgtctgttttaattacacaaagttgctgccccaaataaaactgccctgccccccccgccccccccccccccccccccccccgccccggggaaatcataaggaaattgagagaatttaactagaattttcttttttttctttttcttttttttttttgagacagagtcttgctctgtcacctatgctggagtgcagtggtgtgatctctgctcactgcaacctccgcctcccgggttcaagcaattctcctgccgcagcctcccgaggagctggaattacaagtacccaccaccacactcggctaatttttgtatttttggtagagatggggtttcaccatgttggccaggctggtctctaactcctgacctcgtgatctgcccatctcagcctcccaaagtactgggattgcagatgtgaaccaccatgcccggcctagaattttctttttggacttgaacataattcctcaggatgctttcccctttaaccttacttcgcaggaattgttattgactttttagattggaatataaaggaatttgggatcccatagtctgctaattccattttcttttcctgtcttttaactaaaatattgacgcactttctgtatgtttgaaaaatatttcataaaatttaatccacttaaagaaacccactcctttcccccaaatcttacagctaaccactgctctgaatttggtgtttattattcctatgtatttctgtacagctttattacacatgtgtgtttccttagacagtgtatagtattgttttgtgtattcttaaactttatatagatggtactgcatgtattcttgttcagcatactgtttattttatccccactcaaaatcacttakcagtgtggtttcatgaattgagtttcaactcaattcatcagtgtgggttcatgtagatttaggtcatttatttttactgtgacaagttagtacattttaggtctataccatatttatttcccctttgctctcttgatagacttttaggctgtttccattttttttgttattacaaacattattaccgttaagtattattgaacacaagtctttgttttaatttttgacactgtagttaacctgtgctcctttttctctgttcttcacatttttgtctcggccttcctctaatcgtttcattatttgagctaaggtaccattctttgtccattatacttaacagtacaaaactgtaatgggcacttttcctcgaaggctctttttagtaatctttactttagttaactttctttgcttttttttttttkaaataaaaatatcttaaaatatagaaatatcttgaacatattttacagatatatattattttacttgtaattccatgcatgactgcagggataattcacgtgtaccctttctcttgggaaacgtttctgtgttgatgtacatttgatttagctaattctgtattttagtgtttgtttcctttaaatattttcctctaaatgtagtgcacttttttcattgcagtttggtgggtaggaacatgagctcagagttaagattgcttggattggaatccgggctctactttttagctgtgtgtctttgggcagcgtatttaatttctatgtctcaatttcttcatctgtaaaatggagataatagaaatctacccgtagattgttgtgagattcaaatgaggtgtctggcatagtcattactcaatacatattagctatttttattagttttattttttgttagagtatgcagtattttctaagcctactcagtttgtggtgttgccttcttttttgaagcagcattttaacacagacatctatgcctcaaggaaatgtgtgatgttttataactgttagtggagattgggaagagatactgtaaactgtagcaaaccataagttgaggtacattaactagattgttatattttaatatcaataatttaggatttggttgggcatggtggcttatgcctttaatcccagcactttgggaggccgaggagggcggatcacctgaggtcaggagtttgagtccagcctggccaatgtggcatgagtccagcctggccaatgtggtgaaatcccgtctctactaaaaatacaaattagctgggtgtggtagcgggtgcctgtaatcccagctacttgggaggctgagacaggagaattgcttgaacctgggaagtggaggttgcagtgagccaagatcatgccattgcactccagcctgggcaacagagggagacgctgtctcaaaaaaaaaaaaaaaattaggatttatcgtgtttcaatttttttgaaatacgtataaagcacwttgaaagtgagttgacatggtgaaattctcagataattaccaagggtctactcttgttagttttaaataccttttgtaatatgaccctgataatgattcagatggtgtttctaagtatattatcctatgtcatcaaccttgtgttgttcagtggagaaggaaccattgccatccatgtatgtaaagcttcataggtaaatttgagcgagtgacttaacctttctcagccttccatttcaatttctgtaacataaagatttcaattcttacctcacaaggttatcatgacttatgttagttgcttccttcatctctctggctcccctgtcttctcttgtaacttcctttttttctgttttccctatgtatattctttcttcctctttatcccttctctgcccttcacaagtagttttttggtaaatggtaacaagacattctgaaccagtgtgtgagtgaacccattatattaataaaaatacacattatttaaaggggactaggaaatgttaattctgtaaggacaagaggatttaggccatatgaagttacagaggagatgctgtaaatgttaaatgagcagtataaaggacagagaggtcatgttttgccacagtagccagggaatggtcagctgagcaaaatgagactaatgttagatttgaagaaagatttgtgaggaaggtattcacataggatgtccagtgggcagtggagtttggaagattggcaaataaaactgagccatcaactgcttgggaggactcaggaagctgtgaggataaatcacatcccatggggaagaaaggcacatggacttggaggacaaaagcaattaagacctagcgtaacctctttatttattgattaaactctgaaagtagttgttgaatgaattaaaccttctaggaatagaaagggagaactagcagctagcaaatggagagaattgagtggctctgagttgttgcaggaggagctttgaaggtctggcccgagttgtttgtaaccctgccgttgagactggtggtgtggcattgtctgtgccatttagtctgactggacttctggtttttttttttttttggtctgtaatcctttcttgcttttgggggatggagagggatctgcttcatcactgttctttttacctccttttccccctcctttacttgactcaggatttttgttacctgtgccatatttatttcttaggtgtctttgactttatcagttagctttgtgcatttccccatgtattcattgatgtgtttactacctggaatttaatggggtgtttgcatgagtctcttcctcttttgacatctcaataagcaagattctcatggaaaccatctcagaggcagtgggcagtaaatagatggagtgaaagatgaggcagaactgtttctctgcattctatattgagatgtacaattgtttaacaaataattacaaaagaaaatgagtgccatgagagagtgccctaagggrtcagcggatgggtagagaagttcaggctggggctagggccagtggaggtttgggtatcagagaatgcctaatcaatttagatgctaagagataactaggctttgaatgtatgcagaagaataaaggacattccaggtagagctaacagggcaaaatgagcaaaggcagagaagacaggtaagggagacaaagaagtggatggaattgatttgtttgtagtgtgcgaagtagagagttggaaggtgagagttgaaaagtaagctgacttcaagttgtggagagtcttaagtacttggcagacgagtttggaattgttttttattccttcttttttttccccttttggacaatgaggagggaattgagattcttgaagagaggattgatgtgaaatacgggttataagggagtggcaacgtcacactggcaacatgaatgaaggatgcattgatggaggagggggagaggggactagagacagaggaatagttaaggatacagttgaattctgccaggtgacaggagtaaggacctgaactgataaagtaacacgtgagaaagggcaggaggcaggggatgacagaggaagcagaaccatcgggacttggcaactgactggatctttgcagggcaagggaagggaatattaccaaatgctttttaagttttgagtaagttctagaaatgggaagagtcagctttccatttgagttgggaaaggtgaaaagcagagtgacagtagaagatgtggaaaggagaattcagttaaaaaaatttatttttaaaaatgcgaagtgggatagctgggatctcctcaaagaaagccagatgaggggtcatctgggtaggcgatggtgagatcagggagtggcggaaagtgaacaaagttctgggcttagatgtttatagaatgaggtgagaagtcagtgaaagatgtgtaaagtgcttatcactaggggcccagtaggcattgtctagggaggcctcagctaaggctgggtctcacaaacatgtggcattggtcctggctgtataactctccagctggcagccttgtgagtaggagtgaagaaaatgcagtgaatctgcagggagcggttgtgttttagagctctaggatagcaagtgctcgggagtcctccaggaaggacatggttgtcacagaaacattggttcctgggactaggctttcaggggacaagagaagacacaagggagttggtggccaagatggagtgggagagcaggtctagtgggtgaggggttgtggggttactaacagcctattctcattctgttaatttttaaggcttgaattagttttctaatgataggagtcttgttgctttgggaccacagatgtgaatgttattattattatttttgcttctctgctttatctgtggcattactgctcttgtggcattccccccsacccccgactcccttgtttttggtgaacataatagtcaccgtaaaaaagatgtataattctagggaaaaacttaagtagggcaaatgctcaacagggaaaagttcataatttagaatacaggtgtgcctaaggttataaaatagataatagtactaagacaattaattttttgttttattttgagacggagtttcgctcttgttgctcaggctggagtgcagtggcacgatcttggctcactgcaatctccgtctcctgggttcaagtgattctcctgcctcagcctctcgagtagctgggattacaggtgcccaccaccacgcccggctaattttttgtatttttagtagagacagggttttaccatgttggccaggctggtcttgaactcctgacctcaggtgatcctcctgcctcggtcttccaaactgctgggattacaggtgctcctggccgacagttacatattttttatagaaagaaagtaaaagtatcttaggaaaatttaaataaattattattcttaacatctgtcatccatccatctgtttgtctatcggtgtgatggatgctcccaccaggtactttgctagtggacaccaaggatagaatgatgaataagacaaatacggcccttccctggtgcatagagtgggaaggtgaacattaagcagttccacagtaattatttaattacagttgcagtaggtcctgtgaaggcaaagttgtggggtgccgagggtggggaaccagagtaggctgtcttgagaggcttctctgaggaagtggcatccaactgatctaggagaagggggatggtagtggggcggtgtggtggtggggcaactgggccgctttctaggcagaggcttgaagcaatgtggggtggggtgggatggtgacttggctttggggaaaatccacaagaagggcaggagtttgtgcagaggtcttctgagatgaagctggatgcaaaaataaatgggccacagcatgcatgagacagaaataaaaataaagccgtctcttagaagcaatccattgagagtagactgggaagatgagggaacttggaggcttgactgtgccaactagttagcaatatctgtatcaagtcagtatgcttctttggtcctcagttactacaaaaagtttaaattttattattacaaaatttgcaaacagttaactttttatgatttgaattttatgattagcaatgttacagtttaccaaaattatcttcagcagtattaaaacatctataaatatatataacaatatacctgaccatatattatgttgattttggtattgttcgcctattaaggccaatgggaaacttttcagctagattggatattatttcataattccatagagttgtatgttttgaacagaaatatttttagtgtcttctctaagtttactattcaatttcttgtttaaaagatcataaattgacctagtgtttcaggcatgtcaatactgttgctatataaatttgtagaaattataatgaatttatatatttgctttaagtttttcttctaagaatgtgtgtttgatgagaaagtttggaaaatacgtaaaagcataaattctacattctagatatagccagtgctgaggtgctttcggtcctgatacctgtttgtgtgtatgttaacaaaagtggaaatatattgtgtgtaaatatttaacctacttctcatttatcatatcatgagcaattcccatgttattgaatgtttttgaaaatatttttagtggttgtataataatctactatatgtacataatgtactttaccatttcccaattattagatttgcatattttcattacccattattataaatagcaaatggaagttctcaagtaaatttgtttttcttcattaaatattcacagaagtggaattgtttggtcaaaaggtatgaaaaatttaaaggctcttaataaaaattacaattgcttcccagagaggttgtacttatatatctgtgccctttagtttgagtgtgtctttccattgcacctgtacttggatttatttttttatttttatttttttttgagacggagtctcactctgtcacccaggctggagtgcagtgacgtgatcttggctcactgcaacctccatctcccggattcaggtgattctcaatgcctcagcctcccgagtagctgggattacaggtgcgcaccaccacacccggctcatttttttgtatttttagtagagaccaggcttcactatgttggccagactggtcttgaactcctgacctcaggtgatccgtctgcctcggtctcccaaggtgctgggattacaggcgtgggccactgtgcccggccttgtacttccatttatatattgaaaaccagaagagagatgttgtttcatatgaataatattttgtataattaaaaaaatttcttggctgggcacagtggctaacgtctataatcccaggacttcgggaggctgaggaggaaggatcacttgcacccaggagtttgagaccagcctgggcagtatagggagacttggtctctataaaaataataaaaaatactaactgagttgggtgctgtggttccggctgcttgggaggattatttgagcctgggagttcaaggctgcagtgaaaactgtgatcaagccactgcactccaacatgtgacagagcaagagaccctgtctgaaaaaaaaaaaaattagcaacccgagtatttattttagttaaaccagtcttaatctagacctgatttaaataaaaagcaataattttgcttattggatatatcctgctgaaggatttggagaaagaatagaaattttatagatttacagtttttaaattacattggctcactactgtaatcccagtactcaggaggcagagatgggaggattgcttgaggccaggagttttgagacagcctgggcaacatagkgataacccgtctctaccaacaaaaaaaaaagatataaaagtaaaaatagaattgaagaattaaaaatcttcatttatgtgaaaatttgaatggagaggtgaagttaggaataattgtaaaaatttagcttttgatttacttttttttgcgttgtgtataacctgctaatgttaaggataatatatacaaagtgatcagaacagtgcctggcacgtattaaatgctcagtaaatgtacctattgttattgttactttaaaaatgtctccttccagctctctgaagattagctcatataatacagtgtctctcaaagtttttatcactgataaaactttatcactgatcttatcactgataaaatcaagaagattggggacggaaggaatgggatttttgtttttgaataaaaacctttggagtggtgggttggagggaggaatctcatatctattcgtcatgattcagatcaggataataatgagttgatctgtgtagtgccagttgaaatcttgatttttattcaatgaaataaaaaaattcattggtttggcttttcactgattgatttatatcccattctgtattccttttggttcctggaaaagaataggaataatttctgtaaatttgaccttattggtattaactttcatatggcaattttagaaagaagtgcctatggaagatgacttattggtgaggcttctttcctctttaattgcatgacgttatagcgcagaaatgatcacatctatgaacctagatggccttactgattgctgcttgacgggttgttgaatgagctgatattgaccagagtttctacccctcctcccctccccttttgggttgtccagttcagtgtcataagcacagacataattccttagcttattgctgggttttttttgatgatgtttctttttgtttttccctgttttaaaattttattcataaaatcagccaacatttattgaacatatactaggtaatactttgtaggtttcttgggattcatatttcaaagatgcatcattagagtgtttacctcgttgaagtagatagaaagtaaaacagtaaacatacaatccatagttaaaagtgctaatgtagatgtatgtgcaaagtgttttgggttcttagaggactgcaagtagatattagaagacttcataaaagaggtgacatttgagctagagtttggactgtttcaccagtataaaagtattgggattaataagcaggggaaggagcaatagtgtgtgatttgtaaatcataggagcagctttgattctggtacccattccctaccctcatgtgggatagcttttctcaacagatgtttgagcaagagctagttattgctttatggttttttttgttgttgttgtttgtttgtttttttgtttttttttgagacagaatctcagtcctaggctgaagtgccatggcacaatcatggctcactgcagcctcaacttccccagctcaagtgatcctcctacctcagcctcccaagtagctgggactacaggcgtgtgccaccatggccagccaattaaaaacatttttttttgtagacactagatctattttgtccaggctggtcttgaacgcctggactcaggcattcctcctgcctcagttacccaaactgttgggattacaggcatgagcaaccatacctggtcctactttatgactttaaaatattttctttatgcctatttaaattatagaatataaaatagtatttataaaagtatacatttattcatacccgctatgtatcacatactcggctagattctaggaaagcagagaaaaaaaaaaagtccttgcttcaagaagctcacagtctgttgtggggagacagaaaagcaaagttaaaatacagttgtaataagttacgttaatggtatgcctgaagtgttttggaagctcataggaaggacatctaacccagccttgatggaggaggggagataaacgatggaggtaaaaatagatggagagagttcattgaaaatctatattcctttacttctggatagagcatagtttttctgagttaggaggggattggagatgggacccaggggacataccaagcataaaggcatgggacaagaacacacatggggaatgcttggggaactgaaagggtgtgttacaggataagtcaattaacagtagagatcaggcagggggaggcctgatagattgagaaagatggtggagagctcaaggggattggagttctggatgaggtcaaaggattgaagtgaaagagttggtggaataggactggttatggttaagagtagttttggagttttgtacttgagagatggttttgtacttagattgtttagagggtgttttttaaaagttagttttgtgattttccttgtaatgaagaggtggagcagatgatagcccagatggaaagttccatgagggcaggatcagttgaatactcagggcctgtttatgtaaatctgaactttggtattgagaatgaaaagcatagcacattcgtagatttacttttttggtgagaaacatctatattggcatttgttgtttttattagatactaacctcagtgacggctacatatacacttatacctttataaatacctagttcagaaatgattttgtaggcatgtaacagtttctgttctttgcattgatgtttctggggagaatggtggacatagtgtaaaactggcatatgtaatgcctatatattatatactacatcatgtgttagattacatgctagaaatttggatggaacactacccagaattgtgagtcactatttgggaattgcccttgatgcatggataatttacccgtagacaattgggagctgtgtatttaagttaataaaatttctttgtattacatgatgccagagtacaggcatgttaattataggtgatcacagtttttgtttcttgttattaatttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatgaatcagtctctgcatccctgccacctagcacagtaatggacatgagatactgagtaagcatttattaaattgagttgaaagatttgaatatattaccagaaaatttttggaaggccaaaaatctcatatcagaatgaccagtatatacttattaatggaagctcaggaattcctgaagaatagcttttctgttggtaratatgtactaactggttgagtaatatatgctaatgtaatttaaaaaattatgtgattgtgaaggcaggaaagcgatggattgtttcaggccaggcccactgcttgctgtactttaatgtcattgctgcttatcgccttctctgcagccttgttgacactcctgamaacaagtgtttgtctttggcttctagggcactgtttcctgttcctttacctttcttgttggttcttctggcatctgcccttaatcctttatcctacaattgaatatactgtttctgaggaattctgtgttctatgaatagagtcaatgatgactgtgacctctgcatcttcagctgtttggagccccagccctgtatttctaacaatatagtgaatctctcttctggtctttcccacaaacttaacatccagccctatatttatgcgctcatatttgtgtctgttcttcttgtattcctcgttacacgccaccattctttcattctggaaatgtagactttaattttcagagcccttactctatacatcctacctgacaggtcctactaattttacctcagagaagcctgtacagttggtcctgtttcttctgtgtctactgccttaaattctgcacttcatcacttgggctgtggtaataaccacatacctggaatccctttcggtttattttctgtgttgacccaagtaatcattcttaaaaaaaacaacaacacacatttaggactgggaacagtgactcacacctgtaatttcgacactttgggaggccaaggcgggtrgatcacctgaggtcaggagttcaagactatcctggtcaacatgggtgaaaccctgtctctacaaaaaataccaaaattagccgggcatggtggcgggcgcttgtaatcccagctacgtgggaggctgaggcaggagaattgctggaacccaggaggtggagattgcagtgagcctagatggtgccactatactccagcctgggggacagagcgagactgtctcaaaaaaataaaataaaataaaaaacaaatttagttaaatgctttacttgaaaaccgatctcatgctatctacaacattttcattgctaactccccccrtatatttcctgtgttccagcgatctcaggctacttgtgattactcactgtatgctcacccatgcctccctgttaggcaggagtgaaggaggaataagagcctggagggatttattcagctttgtctgtgggtaattatactcatcctgcatcttgaaagatgagtttattttgacagtcctcttagctgcttctgtctctctccaattccataccccattccaagttttggacagaagagtatgattggaccagcacattcatgtttttgatacaggcttcactggtcacaggtctgctggatacctgtggatgcacacatttgccgtagtctgcggtgttggagatggggacagaacagtatcacatatgtgaaacagagccagtgcttcccttcccaacagtcgtaggccaggcaatgtggactgtgggttgacatcactggagactgtttcagaatcagaataaagaccaataataaaccttttttttttttttctatttatggaatatgggagctgtggaagagaggtattactaggctggttgtttgcttcagggatctgcttctcatctttccaggacttaattcagctactacctctgttaaaatttttctttgatgctgtgcaacttactgaataagattttacctgctgatctgtgatgtcactattgccatatacaaaagtcccatgactatttctggttttaaaattctgtattaacaattcgtgttttgatatggaatagggcaaatatgcattaaatatgctgtttctcaaagktttttcttctagataaatgttagaattaatatatcacataagcatacaaaacaaacacgtaagaaaaatcctagtaggattttcattgggattgcatttggtttatgggttaattttggcagaattacatttatcctttctactcaggagcaagtctgtcttttcatatattcagggtttttttgtgtgtgtctatcagtagcattttacatacacagacacccatatgtaaatatgaatgttatattacatgaagtattttaaacttgcgtttgctattgtgactatatttccgtttcaatttctaactggtgattaataatatataaaaaaactgtcaatttttggccgggcgcggtggctcatgcctgtaatcccagcactttgggaggccaaggtgggcggatcacgagatcaggagatcaagaccatcctggctaacacggtgaaaccctgtctctactaaaaataaaaaaaaaattagccaggcgtggtggtgggtgcctggagtcccagctactcaggaggctgagacaggagaatggcgtgaacccgggaggcggagcttrcagtgagcagagttcacgccactgcactccagcctgggtgacagagcgagactctgtctcccaaaaaaaaaaaaaacaaaaaaaaacctgtctatttttattatttacttggtatcgaagtatttttgtgaattctccctctggttggatatttttcaaatgattccttcagattttcttgtcagrcaggcacttatctgcacacaataatgattctgtctttttcagtattcataactgtcgtttrttttttcattgcattggctaaagtgcagtgctgttcagaagacatgccttgagagccgtaaatgtaagccatatatgtagttttacatttctagtaggcaattgatttcattacattgtttaatgtaatatattcaaaatcttatttcagtgtatatgttcaatataaaatttattaattaactattttatgttctttttttactactaggtctttggaatcccatgtgtattttacacttagatcacatctcagtttggactagccacgtttcaggtgtgcagtggcacttgcggttaccgcattggacagcatagagttagagccttcttgatatataataattatgatcatagttggccttgttgtcccttacttggttggaatttgcttttcagtatgatgtttaatgttgatttctaataaatatactgtttttaagtttaagcaattttgtttctgaataagatgttcctttaaaacttagtaattgatattcactccccgccccacccctgagatggagtttcactcttgtcgcccaggctggagtgcaatggtgcgatcttggtttactgcaacctccgcttccygggttcaagcgattctcctgcctcaccctcctaagtagctgggattacaggcatgcgccaccacccctagctaattttgtatttttagtagagatggggtttcaccatgttggctaggctggtcatgaactgacgtcaggtggtccacctgcccaaagtgctgggattataggtgtgagccattgcgcccggcctcacttttcttaaatacttaagaaaatgtatggtgatgctcacacctttcccctcctacttatgcctgttaaatatagaggatggtagtaataaagaattctcatggtgaagcatcttttcactcagagtaaacaaaccatgcttggttatggtgtatcattcttttaactcaactggattagatgtgctgacattttaggattttttccctcatattctttaaagagattgtcctatgtggtatgtcacgttttggaatcagcattatatcagctcttgtaaactaggtaacaaaacttcagatcattctggcttaacaaaattgttttaaaacttaaaggaatatatgcacatgattgaggactttttaaagtaatttcttagcaaaatgtatttgtggaatgtaaattttctaagtccttgaaagtctgaaaatttctttattctacttgcaattgattgggaaattagctgagagtagaattctaggttaaaactttcccttaaaacttttaaggccttgttcatagttgcctaccttcctgtgtttctgagacatctgatgccattatgattcttacttctttataacagygatctccaagctttttggcactagggacccagtttcgtggaagacagtttttccatggacaggggtcgaggaggcagtggggtgggggatagttttgggatgaaactgywccacctcagatcatcaggcattagattctcataaggagcggacaatctagaacccttgcatgccgaattcctgctcctgtgagaatctgatgcagctgctgttctgacaggaggcagagctcaggcggtaatacttgctcacctgctgttgcctacctgctgtcaggtctgtggcctgggggttgagaattcctgccttacaggaagggtgaccatatatcctgatttgtctggaatacctccagatcactgtttttttttttttttttttttgaagacagattctcgctctgtcgcccaggctggctggagtgcagtggcatgatcttggcttactgcaagctctgcctcctggcttcaagtgattccgctrcctcagcctcctgagtagctgggattacaggcagatgccaccatgcctggctaatttttggtatttttagtagcaatggggtttcrctgtgttagccaggatgggctcgatctcctgaccttgtgatctgcctgccttggctttccaaagtgctgggattacaggcatgagccaccacacctggcccaaatcacactttttaatagtacctccttttattctgatatgtatccttctttgttgatcagttatagaatcaccttatttgtaggtggtttgctttctgttttttttttttttctttttttctttttttgagacaaagttttgctcttgttgcccaggctggagtatagtggcaggatcttggctcactgcaacctccccctcccgggttcaagcgattctactgtgtcagtcagcctctctagtagctgggattacaggcatgcgccactatgcctggctaattttgtatttttagtagagatgggtttctccttattggtcatgctggtctcgaactcccgacctcaggtgatctgcctgcctcggcctcccaaagtgctgagattacaggcgtgagccaccntgcccagccagccttttgtttttttaggaagatttgaggatattcttatactctgagctttgagaatttacgtggctctgtctagaagtcagttattttttccctcattcatctgcccagtcctttcaaacngaagactagtatttatcagctctgggatattatattgcagtgtgctttaggaatttctgcttgcaaaatgcttcaggaatttttgcctctttgttctttttttctttttatttctggaactccttgtaatggaacttgaatctcttggattaatttaacaccttattttttaaaatgagaattaaattttctatattctnccccttgcttttgctcttctttrtctggaaaagagtctccacctcattttctgacacttgtattgactccttaatttcagctgctattaatttcaaagaactttttcttatttttattccttctgttaatatatagcattgcattcttgtttcatagatggcaatagcctctcttatgcctttgagaatattacatagacatattttaaaatttcccacatttcctacattgtctgtttccactgaggcactttttgtctgctrtttgtctctttctttgatagtgatggtttttcacaaatatctggtgattaagaactttatcttctgtctggattttgaatttttaaatggttttcctgtttctagtttctttttccacaaataaattctcaacatttggcaccaggtttaatattatgaaacagatccgagtatgtcatccccctgctaataaaagttagaagacttttaagagatctggataatgtttcaaccacttagggcagcaaacattcacagtggcagtgaggcatttgtcttctagggccactgcaacaaatcaccacagactgggaggcttagaacaacagaaatttattctattaatgttaatagagaccagaagttcaaatcagtgttactgggttgaaatcaaagtatcagcagagctttgaaggctccagggaagaacctgttccttgcctctttcagttctagtggctgctggcattccctattatcagtccaatctttcaggccagcatcttcaaatctctctgctccatcttcaygtcaccatctccttcatgtgtgtccaatctccttctgcctctctatttataaggacatttgtgagggcatttagggaccactgggtaatctagggtctttttccaaataaggtaacatttgtagatcctagggattagggcctgataaccttgaggtcctttattcagcttactacaactacttagagtcttctgaaatttctcttttcttgtacagttcccttcgcgtttacaaataattgttattantgcctgcagttattgtctgcttgaacaaaaatacatgcatcaactcagtttatagtgatttccttgaccttgtcttctccaccctagacaaaaggctgcaattgcctgttttcctaatgcagctgatgcacttctcatagtttttgccangttaaagtgatttgtcaggctctaccactgactaggaattttcttttttttcagtactatggtgtcattcttagaatgcaaagtgtcgggtctggagctgagtaaggcatttaataaatatttgttgaagagatttttaacatttattgagggccaattacatacctagtaggacctgtcaccttgggccatttaataaagtagggtaaagtaagcatggcacataagtttccccagggcatatttgtcaaaagggattgctgggtcataggagtctacattttcagcttttgctagatgctgccaaattgctctcttaactggctgtacttccgtaagagtgccaagatctatcttgtttgccatatctttgccaacacttgtgaatttttttcattaaaaaaattttaatgtaggaaatgatactgttttaatttgtatttccttgataattaatgaggttaaccatttttaataggtaataaacaatgtggaattttctgttaatatacatagcctgctttctcctgttgctcttttttatttatagaaattctacaactatggatatgaattatatatagcactgttctcttttacatgtgaggaaactggcacaagaaattattaataacaagaagatttctaagttatttcccccctggatgaatagatgcatgaccttgtctggagtcatagctaataagaaacagcagggattttgaacccagtagtatctgagtttaaggtctgtccttttttttttgagacagagtctcgctctgtcacccaggctggagtgcagtggcatgatctcggcttaacgcaacctctgcctcctgggttcaagtgattctcctgcctcagcctccagagtagctgggactatatgtgcangccaccacacctggctaatttttgtaattttagtggagttggggtttcatcttgttggtcaggctggtcttgaactcctgacctcaggtgatccacccgtgtcagcctcccaaagtgttgggattacaggcgtgagccaccatgcctgactttaaaaaaaaaagtttatttattattttactttaagttctgggatacatgtgcagaacgtgcaggtttacatgtatacgtaggtacacacgtggcwtgttggtttgctgcacctttcaacccatcatctaagttttaagccccacatgcattaggtatttgtcctaatgttctccctccccttaccccacccacctacaggcccaagtgtatgatgttcccctccctatatccatgtgttctcattcttcaactcccacttatgagtgagagaacgtgtggtgtttcttttctgttcctgtgttagtttgctgagaatggtggcttccagcttcatccatgtccctgcgaaggacatgaactcattcttttttatggctgcaaggtctgtccgtttttacaaaaattaataacaaattaaaagttaatgaagcagtggtatgttgaattaagtgattcaaaaaaacttagcttttagctctacttgttaatatattcttaaaaataactatataatgactgctaacctgtttgcttcgcaggtgatagagaaaatcattgaaaaaatttgaaagtgttttttaaaaacaatgtattaatatcaccacatatacatcttaatacttattctttatcatcatcatgagtaaatgaacgcagcctttatagtatactttttgagttttggaaataccttattttttataatagagtttattttttagagcagttttaggtgtacagmaaaattgagaggaaggtgcagagatttctcatataccccttcccctacacaggcatagcctccctctttatcaacatccccctacctccccagagtgctacattggttataactgatgaacctacattgacacatcgttatcacccagagtccatagtttacattagggttcactcttagtactgtaccctccgcaggttttaacaaatatatgatgacatgtatctaccgttataatacatacagaatagctttattgccctaaaagtccttttgtgctctgcctattcatcctcctctgtgctctaacctctggcaaccatggatccttttaccatctccatagctttgccttttccaatatgtcatatagttggaatcatacagtacatagcattttcagactgtctcctttcactttgtaatatgcatttaagtttccttcatgtcttgtcatggcttgatggctcatttcttttcaacactgactcattttccattgtctggatgtaccacagtttatatatccattactttgttgaaagatatgttgattgcttccagcttttggcaattatgaatcaaactgctatggacatgcatgtacaggtgtttttgtagacatattttcaactcttttgggtaaataccaagcactgtggttgctggatcatatatttggagtatgtttagttttatatgacactgtcaaacttccgtagtggctgtaccattttgcattcccaccagcaatgaatgagagttgctccacatccttgcaagcattgggtggtgttagtgttttgggttttgggcattcttactggtgtgtagtgtgtgtactatatgtttttgaagaaaagttacatgataaaaattttgtttgctagcgtgataggttggtgtttccagaaaaactcaccggaaacttttcatgtgaggtttagaagtaaaatasttccaggaaaaagttggcattcggctctgattaactagaatatgagtagtaatgcttgtcttttttatgtttgttttgacaggttttgacacaagggcgcatatcttcaaagcacctagtacctcctaccattgtcaactggtaaaatatttaattttttattacaatagatttcttttatttgttataaaataaatattaagttaaaaccaattatggctaaattgaccaaaaaattgtaattctcattttatgattatatatggaagatagttttatatttactttaattctgtataaatcaattgggacattaaaccatgtcattgagcagtattgtctatcttcctttccttaacttgaatttcactaagtatctgcaagggatttgaactcagtggcctctttattttggatagtttagcatgaattagaccattttaatatgtgatggtcatttaaaatttgtatgaatgttactgtaaatttctaactggacattttagtagagattgtagtttcaagggctttttgtcaacccatagaaggttctgcatggttattacagttgtcatggggcataagaaatatagcacaattttattctttctgtgtcatctgaagtgaattagagtttatgaaattttagggcaaaaatttaaggacgaaggtttttagcgttctgtgaaatgaaaaaattgagtaggactgctgtagggaatagtctatgttggtaaagtgctttgatgatgacgtaaaggcagtaagcattttatccattagaatcatgatagttgacatccttcttttcagaatctcatttcgaagtcttttttcatatcagttgaatttattaatcttaacatttttaactgattttaaaaggaaatcacacaagtaatatgtttattattaaaaactgtaagcaatgtaggagcatctaagtaaacaggaaactcctatgttaccctggttcttttgctagggattatcccttattttcatagagtgtatctttccagacgctttgtttgcgacgctttgtttgcgtatccaagattgccatcttttaatgaagtagatgtgatggaaaaaggaatatactttgtccactttaatagtacgcctcactttgttttagacatgtctgtgcctgcgtctctttgagggatatacgtgatcaaattaagagtgcttttgaagtgactaggtaaacccattgtaacacagtactcctctacaaatttcttttagtagttaatgggttatgggaactccaaactttgaattcttagctaagaatgcatcaagagagtttagcagatttacaataaaattgaaattgcaaagataattatgacatattaaatgatagattttaaataggtagacatttatagaaatgactgtaattactgttgaggatcagctaggtttgngtaggtgaagaagtggttttggagcttcagtgcatttatgtgtgctcagtagggtacttaggatatttgaggagggaaaaggccgtcagaaactgatgtgggagggtggtgcacaggaagaagtactatggtacagtgacaaagataactttgtcataattttgcctaaaaagagaaataagwctcgtagtcatgttatataggttaactgtgcgatgaagtaaagggaatgtcatgaactacttgggaaacccagtgtcttgaatcccgaaacttagaactcaaccttttcacgtttgggaattgcttatgttcagaagtcccatgatttaagagataatgtaaaaatggaagttaattcacatttgtacgtgtcctttgtgtgattgtcggattgaaacattttaaacttcttaagaaatgtagcgaagcaaatttggatttgtatgtgaaagtgacctagatgagaagtatggaaggagacggagacagcagcaagtttgctcctcccttggtttcagaggaaaatggtttttaagagctgggccagatgtttctcatagctacttaaggtggattccttttttctgtgtcttctgtttttaagtgtaatctggtttttgagcacttgcagaaaagctgcagaggccagggaatgacacagcagagaatggaggtgagagggaagacaactggtgatcttagttgctttgattttgaaatatgttgttcaggaatagcttttcttagtggtaaaataattgggaatttgtaggaagaagaaaatatgttgtaaagaatttaaagataaaaaagcaagtaatatttgaatacaacacaagactattgactaaaggaagtaatcggatgtttaaaccttatttttagctacttaacctttacatagtacaaatgaagacaatatgttaattgtgatgcaggttatttattctgtatatttccacaacatacttttaagttctaattatatgttattttccttttcttaactttgtttttttagctggtccatgcagactacagataagaaactgggcttttgggggtgggaaggggagtggaggaagagaaaaggaaacatctaagtaatcttactgaatgatatataaatcgttgaaattaaagaaaatatattctgggtagacttagcttgcaaaattattttaagctattgtacctcttataaatggaataagcattttaaaatcatcttgaaaatcttcagaacctttaattcttttacattctcaaaggttaaacataaccggaagagctgtcttctctcaaatatgcatactttgttcattagatttacttttgctaactttttttttgtatgtttggaactgttatatttttcctctggcctttgaattttctttaattttattttttatttcaccctgggggaaagagaggtgggtasatttgtttgtttgtttgtttatttttgagacagagtcttggtctgtggcccaggctgaggtgcagtggcgcaatcttggctcactgcaacctctgcctcccagactctggtgattcttgtgcctcagcctcccaagtagctgggattacaggtgcgtaccaccacacctggctaatttttatattttttaatagagacggggtttctccatgttggccaggctgaccttgaactcctggcctcaagtgatctgcccacttcagnctcccaaagtgttgggattacaggcgtgagccattgtacctggccgaaaagaggtatatttaaaagtgaatttgttacttcaactaacacaaccttcacttaaaaattaggctgtctgttcactctccttagtacaggttcatgtaatgccaaatgtagtacgtagctggattgagttggaattatgaagatcctcaaatattcatgagccaggttgatgtcattaagtaatccaatagttcatgttctcctgaaatacttatatagctggctttctcattaatcattttgtaggaaatgattggaataaataaggagtagtactgaaaagagtaaagaatcctattcagtattgtcttaatcagttttgggaaccctaggcatcagtagaatatagtcttaaaatcgatctagttgaactgcatcaatattaatggtgaacaaattaagatttagtgacctgctcaagatctcttagtaattggcagcagagctcagtctagtctagtgtatgtgtttatgcacatatgcatgtgtgtatatgtatttaaaatccctgttgtgtatctaactgaaaaagatatatattcctttgcctgatttctgtttcctgttgatttttatctagaagagggataaaagctgttttttaaagaaatagtgggtcttgatcagttttggggaaattgaggggactgtatttatagtttagggagagtactcaagagtcctactgttatttccgctatcatactaataggactgaaacaattttaaaattacactggataactgaaacttaaaaagttggctttgttaaactgctttttcatgtagatatattcatgggaaagacttgctataataaatgttcctccctctctcctttccaatgtttatctttaatgccaacatttcattttctgaggttaaaataaatataggctttatagttttcttaaaaataaaataccaaattattatttcctcataaaacttcctagttgtaaagtggaactttttatctaatccagatagtaatatgactaaaccttctaataatgtttttaattgatttcctgtccagaatcttttcgacaattttatttttgtattaaggaggttcttgcatggattaatgatctcgatttcagccctgtagtcattgcgatgtcatacattgcaactgtgtgggcatagttgaaatctttgaagttgttgaaagattgtgttagtatttgaggatttggagaggaaaaattctttgtctttactaaatacataagaaccactgtattacacataataagttagtctgtgtgttgttgatatttgtaagaatttaaaacaactgtcctacttttaggtctgctttttttcgggagggaggcagcaggatatatagtaagtaaatgttttaaaaccattctcttgaactaggtatctaggtatgtatttttattatgtgtttagctttggatgcctgagaagcaaacatgtttgtgagaaccagggtgcccctctaaaaaagaaactctttcccgatagtaaataatagtctctggttgcactttccattataactctgagagattaattctgggtaggaaatagttctttctgcccttcttgaccctggtttcctatttcataatacatgatttgcgtcattcatctgggactcttaagtctctgtagagtgtgtatgactgtcacctaacttttgtggaaaggagactctcaaaagtagtgtattaaaggatacttttttctccccaacaataagntattaactatagaatttattaagagagtatagggtcattaaaaagtttggacatgccttggagagacatgtaggttaatatcctaccttacctgctagctgtaagtgcctttggggacaatctatttgaaattgggttttgtgagaattaaatgagataacataaaaagttcccttcactgtgcttgtttgcctgcactcagaattgtttcccatttattgcaagcttggtgaaaaattccagccacatttcatactagcaaatacggattccttgatatccagcattgtgcaagccactcatttatacttcattagagataaaatgctaagccatattattattattgttatttgcagatatgaacagttgtatagtattggtgcctgagtgtggtaggctgaaagaaaaatacagaggaggaaatcagattgagtggtgggcaggattaactgagaagtaaattgtggcatatcaagatgcaccgtctgcagtattttctccttttctgtcctctcttccccctgtcctcatcctctgctgcctttgactttgtgggagcatttctaagtgttggggctctctgcctgctctgcaagttgagttttcagattccttttcatgatggtggtggatgtgaggggcataaaatgtctgcttgctctgtnagtagggtgtgaatataataccattgttgacttcttccctccttagacagtgtacatgtcttagattctgagagtgactcctgttttctttgttcagtccatgagttttgtggaggttaatttcacaggtctgccaattttgggttgagttaccatgttgtatctctcttgcgcctaagagattcttgaaaccccagatctaagcaggtagaaccatttgatacgttagtctgaaagtgatccctgtggcaacctacttttttcctgtttttctcttaggaaaacacgtcatctctgatagaagattttcttccttctcttttcttttctctttttcttccttctctcttctcttcttttctctcctctcccttcccccgctttccgcctcctttccctctccttcccttcccacctctccccatccctcctctgcctcttctcacctcacagggttgttttttctcacagggtttctttctttctgactttgtcttttcacaaagtcttgctctgttgctcaggctggagtgctttggtgtgatcacagcacaccacaacctcaacctctgggctggagagatcctcccacctcagcctccattgtagctgggactacagtcatgagccaccgctcccggcaagaagctttcatatgagcatttgtagcaatttttgttttgaaaaattgggagttgttacagggcatttgactatgatattaataatattatttaatagcaatttttaacataaaattttattttaacatccacttcataccttttggaagtatatcatttgaaagtgatttcctggctgatggttaagctccgttactttacttacatttgtttcataacacaagatctgaataacacaaaatcctgtctggtctccttttccttcagtctttccaagtcacctgtgttcttcctctcaaataatagaggtcatacagagaagagatcttccttgtgcttgatcattctgatttaaaacaattgctaattaaaatataagatgtaaataactctttgatctaatgcaactgaccattggcatagaacattttaaaaaacacatttcaagtgtttgaacctagctatttatcacacaattttatatttcaagattttgtttgctcatctttattgtataagtagtaataggtcattttcttttaatgctgttaaacttaattcatcttgttattttaattagcagttgtgagagtttagtgaagttgggagttgttaaattcttcatggtgaaagattaatggacttagacctgcatttaaatattcagggataatttcttaaaaaccttgacttgcctatatctttttctgtagtcaggcatgaagccaggcatgcccgtgtatacattcttctcagttggcaaggtatcatagaagttcttctaggtcaatgcatgtacatgtagcttacttttaatggctgcataatagtctgttcaatgggtatatatgtttttcaggcattctttgattaatgaatctttagatcattttctatttttggttttttgccactgaaacagtactgccatgtctcccaggtgtgtgtgtgtgtgtgtccaagttttatsttcagactatrttactactagttgcagttaactactcatccccaaatctgtaaatatgtcttcctgtgaccctgacactactctgtcgtgattcttagtgatttcaatatcgttctaacactgtggtcttattatttcatactccagcctgcctttgctattccttttccatgaccattcattctgccactctcctagatgactattttatactttctccttaattttctaataccttcctttctgcctccctcacatccaatgattttgcttattactctgagaaaatagaagcacccagaagaaaatcttctgcaagctcctattcctgcacatctgtgtccctgtttctcccaccctctctcctcctccagaggtgtggctctcttctgcataatactttcctctgctggttcatagctatcagtctgcagacaagctctactatttatgttaaaaacaaaagaacctcttttgtcctggcctgttaccattactttgttctttagagctctttctacttactgtctttctgccctttcttgaaccctcttcatttgagctttggtccttaacacttaagctcttttcaagtttaaggtcagtggagaccttcacattatcaaaaccagtgtttaactctcaggcttcctcttttatttcctcttttttggcttccctgttcatactctgtgcccattttccttgtgttgcttgacttttattttaatttataggcgctctttgtatattttgtcagcattttttcctggacacttgttttccttttgattcttttaaagttgtgtttcgtcatacagaaatgttaactcctctggattttgtaggaaaataactctataagaatcaatgagaattttgaaaaatgtgggtagtgaaggtcttaccagatatttaaagcagaagttctcaagcattagtgtacaaaaacctgcatggttgcattttaaaaatgaatctgtcacaggagttttcaatttttaggtattggggcagtaaggaacatagggaggcatatctgaggaatcttcattttaaatgacctctaaggtaattctgatatgattggtccatgggccacatttaagaaacattgcactttgggaggccgaggcgggcggatcacgaggtaggagatcgagaccatcccggctaacacagtgaaaccctgtctctactaaagatacaaaaacaaaattagccgggcgcagtggcgggcgcctgtagtcccagctactcgggaggctgaggcaggagaatggcgtgaacccgggaggcggagcttgcagtgagccgagattgcgccactgcactccagcctgggcaaaagagtgagactctgtctcaaaaaacaaaaacaaacaaacgaaaacaaaacaaaaaaagaagcattgctgtaaatttatatttggtataaaggggtattagcaaagtagtaggcaaatacatggcaggaacagaatggtgtttagaaacacattcaagtgtgaatgagaaattattaatgaagaggacattttgtctatttgagaaaagagtggtttatttaaaaatgctttaggcagtttatctgagaggaaagaatttagctttcaccgtcatacgatatagaaaaataaacactgttgaattaaagatctagatgtaaaaattaggtaaacactggaaaaaatacaggagacygatagtttaacctttggatagctgaggccttttaaaactagattggaaacctagaagctgtgaaagaaaaattgacagatttagctgttcaagtttacttttacttttgraagataatgttctaacacggtgaaatcccatctctactaaaaaatacaaaaattagctgggcgtggtggcaggcgactgtcgtcccagctactcaggaggctgaggcaggagaatcgcttgaacctgggaggcagagcttgcagtgagccgagatcgcatcactgctctccagccaggcaayggacgggactctctctcaaaaaagaataaaaaaataaataaataaaaagagaaagataatgttacaggacaggggtcctgatctaaacctgaagggaaggttctcggatcttgcgcaagaaagaattcagggcgagtccatagtgcaaaatagaggcaagtttattaagaacataaagtggcgcaagaatagctactccatagacagagtaggatgctcctgaaagtaagaggaggaacgcgcccaccctgggtacagtgctggtatacatgggaagatgtgctctgctacagggtttgtgataaaggaataattttcttaattactatattaagataacattgcaaaaatcaatgttatctttaaagcaaaattaggaatgcctttgttctscagatatcgggatatctggacactcccaagtctggatctgttttttaaacattattaatttgttcccttaactggaaacacccggaggctcggaatgcctaattttctgggaatgcagcccagcaagtcccagcctcattttcctagccctcaccaaagacggagtcgctctggttcaaacgcctctgacagtaatactcattctaaggtgtagcaacataaagtatctatgactagttctaaagattttttagagccacctagcaaataagatgcggttgtccaaatttgttactttacttaatttatctagaacattttagaaaaattaaatggcttaattgaatgtggctggtatcactaggctgcatttgacgcccttgaatacttgctctgtggctctcccctcccttggcttttgcaacactgtcctctccattttcttattggtttcctcagtggtactttctccttctcggccccatggattggtttcttttcaaagttttctgtccttgagcttgatcttgtagatttcctatgtgttctgtttgggcattctcatccttctctttatggctccaaaatgtgtgcctctagctctggcctctctgaagtttcacagtttgtgtatatttggatgactcacaggaatcttaaacccgtattttcaagactgtatttattttctttctaccaaccatccaaccactgaccacctattttacttcttgtatttctgtcttggtggaaggcaccaagatcattttctctccttgtattgttacagctctaattcatgacttaattctatattgtattcagatacagaattcgttgttgggaaggactggggaaacagctgtaacatttgccaccctcagaagctgctggtcctgtgtcacaccaccttagcctcttgatngaggaaggtaaagaattactttcactgatttttatctaatttctttgccttttgtttctgctgccttcacattgtcttctacagatagttattttctaaacctgcatttgtgtacattagaatgcaaactaagttcttttcaaagggcacaacagttcaacttcgtctcctcccggccctgctcttctggtttattttttgttgcttgaacaaaagacaaactttttggtgcttggtcaatctgtgtggtgccataacttctaaagctccatccctactcccactcccctacaccatcttcacttgtcctcagccttttaagatcacaaaaaattgccatttgatccaagaagatttctcagaaaatgccagaactagtctctaccttttactgtactcttcctgaagcaccattaacacttgattgatacttacctttaggttatatgatcaatttgagttaactttttgtatggtgtaaggaagggttacaacttttgcttgttagttatttcagtaccatttgttgaaaagactgttctttccccattaaattttctcaccaccccattgaaattcagttgtccataatataaggatttatttctggattcttaaattgactccattgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttatwcagctgagatcttttttaagctaaccttagatttaatgaactagttatttaggtccaaaagaaaaggctgggcatggtgrcccacgcctgtaatcccagcactttgggaggccaaggtgggcggatcacaaggtcaagagatcgagaccatcctggccaacatggtgaaaccccatctttactaaaaatacaaaaattagctgggcgtgatggagcacgcctgtagtctcagctactcgggaggctgaggcaggagaatcacttgaacccggaggcgaaggttgtagtgarccgagatcgcgccactgcactccagcctgggtgacagagtgagactcggtctcaaaaaaaaaaaaaaaaaaaaaaaaaatggaactcaaatattgttgaggtagcaaatattctatcatctgaaacctcagtggtaaacacaatacccaaatttaacatatttttgttacttgttaaatacatgcgtgtaaatatattcacttaagtaaactaagtggacaaaattaggtaagtcttttttcatatccaacttatttaacttgatacactttccagctttcaacataattgcaaatttttataatcttgtaagataatgttatgtaattcaacttgtcagtattattctagtgctattagctatattaattacataaagacattgytgtaaggggactcaaaaattcataggtttgggtagaaaatgagaactagacagtgatttcatcactataaatttagttgttacttagcgtcccctgaggctaatgtatggcagatccctgtagccataaattgcattctgggctttaagggattaaaatataattcaaatccttcaataaaatcataccattcacaccattacctttgaaaataaatacttggaattctagtacataccttagatcttgtttgtacatgccattcaatttattataatgctttaaaaaagatattgatgcaggattcttgctccttagttcagctaaatccaggttcttgtctcatgaccagaaaaaaattaggcatgtggacacattgaaggatgaggagggcggaatttattaagcaaaaggaaagctcagcaaagagaggggtcctgcaggcaggtttctacctcacaaattgaataccagggccaccacacaggagctgaagagtgcagacttctcctctgcatgaggcacaaattcctggtggctccaccctagggcattattcagaaagaatcagtcaggaaacggtgggcaaactgggacagactttctccctctgggtcacgggtttcaacctggaccagcagtccagtctttcagccttcaggttgctttaggcttgaaggtgaggtttcgccggggactctaccctatctgcctaggtatttgtctgcctccagcctctatcaatatggtactacaaatagaaggaagaaaaaaaagtcaaatcacaccttaggaaattacagcctagtagcatcagtaaaaatggtactgttagtcatgtcatgaaatagacgtaaaattgaaggttgattttctttttttttttgagatgaggtctggcttcgtggcccaggccggagtgcagtggcrtgatcttaacttatcgcacttttcatctcctggtctcaagtcatcctcccacttgattccgcctcttgagtagctggtactacaagtgtgtgccaccatacctggctaacttttgtagtttttgtagagacagggcttcgtcatgtttcccaggctggtctcaaacttctgagctcaagtgatccatttgtcctggcctcccaaagtcctgggattacagttgtgagccaccatgctggcctgtttttcaattattgattgctttcaagttggaaagtgcattgtgaaacactcaaagatgttgctgggattatttagttcttttgatactatataaataaatgacagagtaacaccatagttatatgattggaactcaagaaatattaaatgataggattgaaaagagttatatgagtcatttgtccagaatttataaaatttttttctgtatcccaatggaataaatttaaactatgtatattctctgaaatagtcttccagtttgcccaacatgcttgctctcctgactagatattagctaaaaattaacaaaacagtcttttctcctgttactgtgtggtaaagatgtaaaaccctttttgccagcagggctgccctctactggactatttaaggtattcagtgagcaggtcaatatgactattttacaagaaggtaacacagtgggtataaatgtaaacatcccatatcccaaacaaactgaagttccctgaatagttaaaaaaaaaagccctttaataaacttttaccattaaaacaattatggtcggctgggcgcggtggctcacgcctgtaatcccagtactttgggaggccgaggcgggcggatcacctgaggtcaggagttcgagaccagcctcaacatggagaaaccccgtctctactaaaaatacaaaattagccgggcgtgatggtgcatgcctgtaatcccagctactcgggagtctgaggcaggagaattgcttgaacctgggaggcggaggttgcagtgagccgagatcgcaccattgcactccagcctgggcaacaagagcgaaactccatctcaaaaaacaaaacaaaacaaaacaaaaaaacaattatggtcattttgagaactggtagtgaagtttatatggtcttagtctccatttcaaccttggaggcagatctgtggcaatgagaatagtaatgtataggaacggtgggtctgctctgatgtcagtcttttatgatgatttgtatattaatacaaatcacgtttttgtgagtccattcatgctgtggatgttttcttaggcattagcataggtcatagtggacacatactgaataggtcatatctgttaaggctcttgctacaaagcatcaaaacttttcagaactatttcctctgtgaaaattcattttaagtagcaagttgtttttttctgtggttcattcccatgcctgagatttgcagtaatgtagaactagtttaccatcactgctgaaacactcatagaaggttccaaattcctggtccagggaaagagcaaaagcctgactcacataaataaacaactgaggttgcaagtttaaggaacttttttgatgaagtcaaggagtctttggatggttcgagttcactctactgcctgcttctttgttttcataataggaacatgtcccacagcctttagtaggatgtcagaattttcttgatgttgccagcaggatcctgtgtcccaggaaactacagtggaataaggggggtctgaggtgcttgctttggggagacctctagagtaagtcctttgctgccagcagcagttaagggaggtagctgtgacattgtcttcagcttctgccatcttgttaggtcccaggtgagattttgaaaaggattgttcaggggtggtaagagctcaaacaggcctgcctcagcctcacgataagccactgcatctggctaatttttttatatatgttttttgagacagggtcttgctttgttgcccaagctggagtgcagtggcaggatcacagctcattgcagcctcgatctccctaggctgaggtgatcctcccatctcagtctcccgagtagcagggactacaagtgtgcaccaccacaccctgctaatttttctcttttttgtagagatgaggttttactatattgccccggctggtcttgaactgctgggctcaagcaatccgcctgccttggcctcccaaagtgctgggattacaggcatgagccaccatgtctggccatgatattatttttaattcaaaaacaaacatgcaaaattaaattttagtgagagaacttagttggataacatctttcttctgggttattagggtatgtttattctttgcaactctgatgttctaggtgtagcaagaccgtttgttttcattttgccattttcctgtacagaaagctttaatgtctccccatgacctttatggcaaaaaccaaattccctcgaccagtctttggattactacacaatacattgtcaaagaaaatagcctggaatggtgaacagagcctgaggctcagttgggagtcctgacttctcatcagctgtgcatgagcaaatttggaggtgttccttaacttgtaaaatcgatttggatttttggtattttaagcatgatttcctttagttctttttttttttttccagagtgctagaattcagtcttttagttctttgaacatatttataatagctgctttgctgtcttgtctactaagtctgacatctgggccttcaaggacaatttctgctgcctgcttttcccttctttctgtgtgtcatacttttctgtttatttgcatgcctcatgattttgtgttgtaaactgggcattttagatagtattttgtagcaactcggaatactgattttccctcccctcttccagggctgctgcttgttgtgttgtttccttatttgttaactgacttggctgagctattacactgaggtttgtttattctgcacagtgtaccctcagatgtttctcctcaagagggtacacttgggcacgcacatagtcaccctggactgcccttcttgagagatgatagccgattttcagcagggctttctttaactctcagatctccttgttaagcttctgctttcattggtatcaccacccagcaactattcttcactaattgctaactgattgctttattgttttggacaaagctttgggccataaatttccccacttgtgatccagttaaattaagatgccctttgtataggggttgtgtttgatggcagtctttgaggcttgtcatgtcaaaaaggaggattcttaggtatctctttccctggttctctgtgaaacttctacagtagttggttagtctttcacttgctgctgtcacagaactaccagcctcattttttttttttttttagatggaatcttgctctgttgctgggctggagtgcagtggcgctatctctgctcactgcaatctccgcctcccaggttcaagcgattctcctgcctcagcctcccgagtagctgggactacaggcgtgtaccatcacgcccagctaatttttgtatttttagtagagacggggtttcactgtgttggccaggatggtctcgatctcctgattttgtgttctgtcctccctggcctcccaaagtactgggcagcctcatcataattgcttaccaccaatgtctgtgttgtttttgacagtgccattaggcatgaacttttccattctttgttctaaatatagtcggtcttagaaattgctaaggggctctgtgttcttacagcctgcttctccagcctgtgcagaacctttgtgccattgttctggagctggggctggggacagcagcttgattttcttatagttatatctgttctgtgagtggtctactaggccatcaatgtacccatcagtcttctctgtttggagcttcttggcctgcatggaacctctgctttacaagaggtgaggcaaagatgatctgtgcttggtgtccttggcctgatgcatctggggtagagcttctgccctaagaatggggactggatgaaagagaaaggattcttcagttctctcatctatctacacttgcctggaatagaatttctgcaacacagagctaggggtaggaggtgaaaaatgctggctgcttgcgtcacttgggaagaaatcgtagtcctggatttggagctgggtagggttaactagttactagttagcttcagttttgtttcttcaagaatgatggccggatgtggtggctaacacctgtaatcccagcactttgggaggctcaggtgggagaattgcttgaagccaggagtttgagaccagctggggcagcatcatgagagcctgtctctacaaaaaaaattttgaaaaattagctgagtgtggtcacacatgcctgtagtcccaactgtttgggaggctgaggagagagaatcgcttgagtccaagagtttgaggctgcagtgagctataatcttgtactgtactctatyctgggtgagatcctgtctttaaaaaaaaaaaaaaaaaggtattattacccacctgccacacaatggctgttcccctctgcccggagtgctctttcttacccaaataggcacatggtacgctctctcttccttatgagtctctgttcagatatcacttagctgtagcacctctccaacgttgccccagtcactttctattttccttacctgggtttattttcctcataacatttatcaccatctggcacgtacacatgcatgcatgcatacctacatatttgcttgtctacctctcccagtgaacgtgtaggttgcacgagagcgggaacttaggccgttttgtttactgttactttcgcagtgcttagaacgatatctaacatagtggattttcaataaatctgatgaatgcaaagtacagaatgaccaaagtatactgctttcttgcgtcatagtttaacctaacttgaaaactatctgtagagccattgtggaaaatgaattttttgtgtttgcaaactccagttgcttgttgctgactagagtgagaatggggctcacagggaaggaatgtggtgattatttggcagtggctgctggggctgtgagagaggatggatgtgttgtatttgtaaagtacttgccatccctaatgcagtgagatgctaaagcacaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaaytctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggtaagatgatctttcattgcctttgaattctttcgaataaaatatcctgttagaaatgaagtaaagggcaagcacagcctgcctccattagaattcgctgttgaaggagaagcagtgtaggaagggggctagactaccttctaatttcttcctgtacttaccagcactgatatgttctgagttttcagaaggacatcgcaacccagtggtgtggagctcttccccagtgtctaccagggtttggaatgtctagggcagttttgagtatgaaaccatactccctgtctctagagcagctgggtgctggaaatggctccaggttttggggtgggacctgctgtgttaaatgtggcttagatgtgggttgcagtgagtgcttcatgtctttgtactttggctgtggcagttgcatggttcttaaaacatttcttttcagaaatatggagaaacctgccattgttgatttgaaacaacgggcaagatgttcttagaggcagtgtaacagcgattaagagcctggactccagacccagactataggtctgaatcttggctttgccacttaactggctttctgaccctggaaaagtaggttaactaattcgcctcagtttctttttctgtaatatgaagataatgatcattactgacactcaagagccaagctgttctaagagctttacatatatcatcttaagactcacagttaccctatgagttagttgttattattttcactttacagatgacagcactgaggcacagatagttaggtaacctaccccagggacactacagctagggaagctgggactggaatccaggccttctggctccagaactcataccctccattcttcactgatcacagctttcatgcttgtgaggattgagtgtgtgtgtatatatctgcaatgtgcttagaacaatttgtggcacttaatgtaaatgctctagcttttattattagattactattatcttgagaattcaatgaggaaaattatagtagaaaattcaatgaggaaaattagatcatggaatagtgtgtttcactggtagtatagaaatggcgtgagaatgccgtttatgaacttggatatgtgacttccttatgagcagttcttgaaactctagtaagttaaaaattgaagataaagtattttttagagggggtacagtgaagtgatgtgtagttggttgataatttggttaggtaataggtttaatatcttttaaccatttccagctactttgatccccaactggctttttttcctgtcagttacaaggaaaccgtcaactcttgaaggagagtccaaataactgcaactatggaatgaaaaactcagagctcctcttttactggagggccagagggatgttgcttaacctcctctrtatatggcccattaattttgccacttaaacaaatttcatacatcattttcctcaaaacatgaaggagatgccaagcaagttgatgtcagtaattcctagaaactaaaaacattttaactngacaacagaatatgtaaatttcctcacgtttaaatagagtagttgtgtatcttgttttatctgaaaccatcctgatttatacttgttgctgtgacattaatagtgcccccttacagtctcaaaagtgccctagtttggatagttatgtggtcaccttatttttaagacatattccctatttcttttgcagacttagaaaaaactgaatttttttctatttaagatctcgctgaagttaatagcacatttctagaaattgaaatcatgagttaagcatgtttgatttttcttttccagcctatggattgtaatttccaaaacattttatcataatgaagtttgcttttgtcatatttacatatctggcactgcctttttttttttctttttttttgagatggagtttcactcttgttgcccaggctggagtgcaatggtgccgtctcagctcaccgcaacgtccgccttctgggttcaagtgattgtcctggctcagcctcccgagtagttgggattacaggcatgcgccaccacgtccggctaattttgtgtttttagtagagacaaggtttctccatgttggtcaggctggtctygaactcccagcctcaggtgatccgcccacctcggcctcccaaagtgctgggattacaggcatgagccacagcgcccaaccagcacagctttttatggcactctgttcttgagtctgtttttgagaaatggggtagttatgagaaggtactgaaaacagtacatttttatgtgcaaaagttttctacttttctatctgcttatagattcatttttttgtctttgatatgctatttgaattcaaaggttggattctcttttagtctaagcatatatacagaagtcttatgtttcaggaagcttcgtttttctccggtatcccacacatattttattcattttaatgtggctagtattgtctttcagtcgtcattcggtatgtacagcagcaaactagttctcaattgtgtaaaaagaagaaaagcttatgtggtgaatatgaaatttcttcctaattcgtgtatcagtataactggacaaaataaaatcctagagctatgatagttgtttcctaaatgtgcgtgtgtaagtgtatgtggctctttcctgcttatcttaaccatagtgcctttgtattcaatgattattcaacaaagtatgaagtatttgaactcataaaagttaggtgagacagactgttttttagcaactttttctgtctatagttcattactgtgaagttttatttagttagtaaaaggaggttttgaatttctatatgtcagaagatctgcctactagcatttgctatgaaattggcatttgtggttcatcaaactttgttcagaaggctgtgtctagactgtgtcttgggaacatgttatagttttctttaggttcattgggaaagtagaattaatttttagattttgcatataataaatgaaacaagtagtttctcttggccatactcaagaagaaagtgtgcagtgtcgctggttagctgaggctttagtttctgttcattctgtgttgcagctgtggcagtgatctgcagactgcagagtgggtatctcagctgcatgttaaacatgctaggcctttttcgttttcccctctcttggtttcttgttacacccattgcattgcatcagtagcagcatctgcctagggtgttgaaaaggggaactttcacaactggtgggttaagctgtgtactttctgctattagtgcctgctagctgatcaagctcagtgaagtgtgtcttcattaaatagtttccatatttgaagataatcttcaactggaaaagaaaacgaatgttgtagcaatatttaaaatattttttgagtaagacttttggggattaaccccagaatgttgtatctgatatggttgaaggaaagatgcacaagccttatttcaaattaatgaactttgaagctttgtttccatcttatcccaacagtctattttgaggtcctgaggggaggatgagtggatgaaaaaaggcagtggcgatgaccctgctctcgttgtgtccaaggtagagtagccaccagcttcactacgaccagattcttccttgggggacagaaaaacaaaaggcacttggttgcttggcaggccttttcagggtccttttaagtttcatatggttttataaaactgtagcagagttaagagctggaacctgtgtcagcatcacctgattccagtgttcccagcagtaaatgcattgcactaacgtcgtcttgaaatgaacagtgaaatgatttcaggacaacrttaaaatacatgtatacctgaaatagaacaaagctgcaaagactaaaaatagaaacagaaaagagtacaagctggctcatatactttgtgagccatcagaaacacttgattttttcttagatattttataaaaataagaagagaatgagggattatgtaatatggtgcttagagaagacttcactatgacattccttctaaattgatccaaaaagataatagaaacactcatttatgtccttgtaagttgacttagctttcttttcctctttcttaatgccgtcttttgtgttatttcttagtcacatttttttaccctgtttgtgtatgtgtataaaacttattttctgatttattaggacatttgcatcatgctatatgtaacaaattatggtcagtctcttggctgggatttgtgggttggttattatattactcttctcttagtttccccttccaaactgtccctctcctttcatcctatttattaaaggcactgctgcataccaaattgttgaagccaaaaaatcaggggtgtctgatttacatcccttacagcctccccccgccttttttttagcaggcctccttgcttccacacttgcccccaactgtaattcactcacacacagcataaaaatgatttttcacaattgttaatcaggccaccttactcacctgcttaataagacccggacttctttctacagtgcagttgaagcattgtgattttatgcttaatctctggaatgagtttgcctgggttcatattctagtcccattacttattagttacatgattttgaacaagttatatttactctacatctccatattctcatgtgtaaaatagggataataatagtaacagttttttacaggtatggtaagagtttaataagttaacacttgccgtgtccttagcatgtagtaagcactaataaaggttagttaccctcrttatcattatcatgattattacaactatccagatctcttgaatatttttactctgtggctcccctcagaataattttttcatagtgatcttcagttgcagagagaatggttaaatgaagccaggtgtactttactgaagaagacaggaatgtgtgtaattttgaaatatttctaaatagtgaaagtaaaacaagtcctagtgcttaaagaggttttcagtaggagacaagattaccacctgtaagtagagagaaggaagggtggaaggtgtgtgtgtacgtgtgtgtgtgtgtgtgtgtgtgtgtgtgtgtgtgtgtgtgtattttgagacagggtctcactcttgcccaggctggagtgtagtggtatgatcatagctctctgcagccttgagttcctggggtcaggtgatccttttgcctcagcctcctaggtagctgggacaacaggcatgtactgcacgtctggctaatttttacacttttttagacatggggtcttgctgtgttgcccaggctggtctcgaattcctggcctcaaatgagttgcctgtctcagccttccaaagtgttgagattacaggcatgagccagtgcacctgcccagaggaggctatttgaatagagagaaggtttcagaggtatttcagagggtgagaaaacgaatagaccagggatgtatgataggattgcttcagggtgttgaggtcctagatttaataaggttggctgttctgcagcagtgttcaatgatattggcaaggaataaatagtttaatcttgtcttgggctagccatagggacaaagttaggattagaaacttttccagcacaaatcagatacaatatagagtgggtagtgtcctctaaatgtaatatttatgaaaaacataattactagatgattcagtggtttaaagaattaaaatcatgagattcagatttcgttttatattttattttttacatatgtggaaatcttacgctcatttgattcctttgccacatggtggcatcattgcatgagtttacatatttagattatatatcaaacaccttttcagaacacacatagtctttgaaatttataaatcctgtcacttacatattagaatctggaaggtagtgcattcttaacctttagagtgtaaaattcttaataattataatccagttcctgcacattttggccaagttgtcatctgtcttctaaccctcacagagctccttttgaagtcattggagctccctgtgctgagcatttcatgggggtaaagagcaaggtgagagtttgggaccagtaaagtaaataagtaccatcttaaatgcagttgctttatccatcaaaataaaaatttatttcttaaatgcgtaattgcatgggacactagatggcagcatttatccttttccgtttttatccaacctcttctagaaatttcttaaatgtttacatttataaaatgaacatggtcagatgattttaaggtgtttgagatgtatattactgacacagccatgtttgggaattaattacctatatatttttgcagagagaggagctttttatacagtccgtatgtaattagggatttatggttttgtctaagttgaggaaaatttctaaagacaatatgttaaaaaacttcaaaagggagtttttactaatgcatatttggtattaccagcacttacgataaacagataaaatattgaaaacctggcggtgccagtaagcatttaaggcttgaatagagggactttgaataatataactagtccacctggttatgtaaacagaaacttgtttactttgcttttgcttatccagagtttggtatggcaattcaagttcagcaatcataaagatttctgttagcttggatagagaaagtttctgtgaatcattttataccgtctgatactgacatttaggaattcctaaatagagagaaattaaaattttggcatctgcggtacttggtactaggctaaatattaagttaacacctacatcatttaaatagatgaaatttataagtagattattagtgtatgaccatttggccaggcagttgacctttacgagcctatcaaactctcaatatttttgaaaaccaaaaataaagccaaaaaaccccccagttacaatataagatttgagttgttatagaagatgtcacaaaatagctaatttttaaaatagatttttcactcaaactcagtttctggctttttattaaaaaaataattctatgcaaacgtaactttctggttcatcataacatttggacgatattctggtttcttctgtaaattattattttgattacattaaaaaawttttttttgttttatcaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcgtatgtagactttcttatcttctggaagaatgaacttaactgatatttattgaaatactttactctgaagaggttaaaattctgatgttaattttcacccagtgtccagttagtggagaactctgttgtgacttggaatttttggtttattttggaaaataaatcaattatatgacaaattgtaccaatcagtgttgcagtgaggcttgaacctcttcatgggagactttcaggtcttgagaactagacctacacttaggggccgttgttccaataccatttctcaggaatcctctttagaagttactgtcaattttgttctgtcacctctatcagtaacaacagttgacctccgaaacacttccatactgaaacctggtgaacttcaaggtgcaggttaaacaatagagttttcatattgtaattatctgaatggtaattgtggtggctcagtctgtgagatagttctggaagcataagttcagaggtctcggtgccaaaatgtgacagtaatttgtggatgtttagtctcatccttcagatgaaacagaaaatacactttcaccagatttcttgctgtaaattcctccaccttttctttttcttttttttgagatggagtctcactctgtcgccaggctggagtgcagtggcacagtctcaggttactgcagcctctgcctcccgggttcaagcaattctcctgccttagcctctcgagtagctgggactgcaggcgcatgccgccatgcccggctaattttttgtatttttagtagagatggggtttcaccctgttggccaggatggtcttgatctcctgaccttgtgatccgcccacctcggcctcccagagtgctgggaatataaacgtgagccaccgtgctaggcctcctacaccttttcttttaaacaaacattccatttttgttgtcacaggtttggatttacattgtttcttttgaggagctttaaaagaattattttcaaagtcattttgtgtatcttttttgagttaggcagaaagtaaataaaaatctacactattcatgttatgtaatttcagcatttctgagaatgtttgtctttagatatttttgcttgagaataaacggtactgccacttgtttgtgctcttttcttgacatacacngtaaatctgacattcagtgtgncatcctatttgtatatgttctttttcacattgtaaagccaagtggccaacaattaagaatttgaagtcttagaaatcagttataattccttcacaatgtggtagtcccagagtaacatctgtaagtgaaacaaaataaaaatttaaatatcttcatctttaaaaattggaaatcttggggcatttaggggaggatgagtaggtgtaatgttgattagtatgataagataactttaaaaaacataacacttatagactgtggatttaacagtttagggctcctaatgcgttattatgattcatctccacattcagagactttacatttgtagttaaatgtttgaatatttgactggctgctgcttttccttttagttgttacattatatgccactctaggaggtccagccattgttcatgcattaaatgaaacagaggtgaccaacatcattactagtaaagaactcttacaaacaaagttgaaggtgaggackctagttactttctaactgtctgatactttagaattttcagtgtcatgagccctattattgatacttagttcttttatgacttttaagtccttaatctttgtggacttttatgaatatcatactttattttttcctttagaaaataaaaagtagattttgtatatattcatgtataagtaatccagagttataaattgttaagatgcctatgtttaaattgaagaaattacgactactttttctcttattgtgctcatctattttctagtttacttttagtaaatttgtaattttgaagggttatattttaaactagtaatttttattttacttctgaagcattaagtaattacaagttttcagaattgtttgraagttaaaaagggagacttttaattatattacagtaaaaagaggtttctttggtctctagacaactcccagaaatatctgggctattctatatgggggaaggaggagaaaattcacatgtaaacttgttcaaaaagaaaattttgaacaagtttgcatgtgaattttctcctccttcccccatatatttttatgtagtctcttgaaaatatgaggggcttctggtttctctacagtttaggcaacctgtgtttacatgcccgttttataaggcagtacccttcttgatcagggttttaccaaaggccaagggtacacacagtgaatctaatgctataaaataataatttaaattcagaccaatacttaatcatctgtaaaaagtgatattatgccagtgtaccctttcttctttcttttttgaggcaagaaattacttaatgattcaccgaatatggtaaactagtattcttattcgctaagctgcttgaaaaataatgaacgtgatgaatgttggtgtatttctaggatatagtttctttggtcccacgcctgcggcacatcatcactgttgatggaaagccaccracctggtccgagttccccaagggcatcattgtgcataccatggctgcagtggaggccctgggagccaaggccagcatgggtatgttacacttttctaattccttacctgtgctttctggtgaccacattctccagaatkatgccaaagttttgattctgaggttagctcaaatgacacatcagttttctaacatcagttaggaaaacaggtccctctaggtatactktcatcttgtctttaaagaaagttttaaggaaaaatataaacattaattattaatgttttaaaggtagtatttatttgaaatttaaaatattttacwttcagttttcatttcttttttatggtgatagttttgggtggtttaaagttagtttataaataatgacatttatcttgtcctatgtgaattacctgtaagtgttaacagagtggctaaacctggaggcctccttttactccctgttccagttcttccctttcctgaggtgaaaaccttaccctccaactagcacacctaggcatggtgactctacaagttcctattctcaaaaaagcgtcagaaaatgttagctagtgtactagtgtttagagatactgcaaaagctgctgggatgctgggactgcatttcctctgtagttggaaacctagtaattagatgtaagcattcactcaactcaaattttaggcacctggaatttgagtggtagtgggatatttagatgcagatatattgtggacagtggtgtgtaaaagtctagtactcgagttatgtttggacttagagatttggaagctagaagcagttaggttttaattatagctgtgggagtagggggtgaggtcaccaacagggaatggtggcttcagaggctactaaggactagtcagagaggaaagaagaaaatatctagtagtatgtggttcctggaagccaagggaaaggagatcttggtgagtcatcagcaggatcaggggctgcatgcagaggtcagatgacacaaggattgtaatttccaagaagtggtggtgttggagaagggtgctgtgcattgaaggagtgaagggctgatttggaagtaaagacttccaagtgtaaacattatttaagaaatgtatcttgactgacaggagaggaagggtattctattgggagtacatttaaataattttttcacactcatttagaagttcacatgtagagtagttctgggagtggttcagacatatcagcaatgccaaccatgacctatttctctttgttcttctgctgtgccacctctatagcttctcagctgttgtccttaggctggtactcttctgatttcaaatggttcacrtcgtgttttaatgcaggactctgagtgtaaccaagttagtcaccattctgaagcagtgaatagtttttagcaaacacctagatactcwagtccaaagctacctttatttcttagttgaattactgggataatcttgtctccctgataccttttttccccttgtaaagttagttagccacacagcagccaaagtgatcttttttttcacagataataacatactcctgttcaaaacaacattgctttacatccagaacgtaatccagagttcttcccgtggcctttgaggtcctrtgtgtggtccctgatagccacttgaccattgtttcttgccactcttcctcttgctcactctgttccagccacactccttgctggtctttagatatgctgagcacattcctacctttgggtctttgcatttgcttatttccttctaattagaacactcttctcccagttccagggtttccatggctcccttcctcactttattcaggcctttgctaaacgaaactctacagagacggtctccaggcttttccatccaaatagcntctattgtcatcttctcaccttgtcttgcttcagttttcttcataggttaatctgtttgtatatctcaatagaatatatctcccatacgtgcagggacttgatctattttgttgatctcagtataactaatatttgttgaattgagttaaattaactcaatttgattgagttatttatttgatgataatgaaaagaaattgttgatacagctgaatctcatgaaagtgtatgtgtgtgttttttctcttcaatgcagaaaaccaacctcatagcaaaccattgccctcagatattgcagtaatcatgtacacaagtggatccacaggacttccaaagggagtcatgatctcacatagtaacattattgctggtataactgggatggcagaaaggattccagaactagggtatgtcatagtaaagtaacattgagtagttaagtatttatgtctgttataatgttagcatttgtgtcattttattaatatatggctaaattagtccctcagagtctgtttgtagtaggcatttccttaaaaaataaaaaaggacattaaaattaatggcaaaatagttatagttgtgaggttgaaaatatatcatatagatatattttaaaaagtacagaacttaaatttgtatagttgtaaatcctttgttttaatcagcttgtatttgctgctgtagttttttttatatctaaatacaattcaggtgaacaggtaacttaatttatccactaagtatttgttgagcttcagtattcggtctctgatttttcttgttaatacaaactccagtggtagcagtggaaggtagagtggagtgggaaagagactgatggaggaaaccagatggaagtttgagggactgtcaaggaaacattgccagagatgcaattggtattctgatgaccgatagggtacagtggttggatatttttgatgcttttatgcacagaaattacaaacatacacgcacacacacactcacgtaattgctatggtactgaacttggggatggaggaatgtctcttacgtatgcatacatttcagaaaaaattaagtgcaacaattttcttacaggtttgcctcagttaccttctatattttggttatgggggcagctcttgaagtatatacaaatacttacacattttctgtatattaagatctaatttattacgtaatccaattcccacaacaagagtcttatctgtaaaatttctggcagatagttgtggattctactttaactcttctggttggcaacccactagatgtaaagaccatttcctccttggatgatttcttctgttcttcaraagaaccctgtattattatttgtttaagccactgtttcttgtgcctcagtactttgcttcagcaacgcttataattcctgagtgcttttaagtaggacgggaaacagcattccttcctgcaagtgtgcgcctccttgcttttgggttgagctgtaattctttttccctcccatccccagcatctgcctatcctctgttttcacctgtctctctctctctctctctcacaaacacatacacacttgaccagcaaattgatgccctggggcccttccatgtgccttcaagcttgctcccattatagggcacttttggcatagacgacacctgacttttgtttctgacgtctcccttttcttttagagaggaagatgtctacattggatatttgcctctggcccatgttctagaattaagtgctgagcttgtctgtctttctcacggatgccgcattggttactcttcaccacagactttagcagatcaggtaagttcartgtctgtgacttgaaatactaaaaaatcatagtgaattgtaatgcatttttttcagtcagtatgacagtatattgcgagagcgatggttcattttaaaatgagctttagccttttaagtgcttcttagactrtaagtacattaaaataatttataataggctttttgatctaagaataccattgaattttaaaaataaggatcactttatatggatcactttttcttattttgtagtcttcaaaaattaaaaaaggaagcaaaggggatacatccatgttgaaaccaacactgatggcagcagttccggtaagaagtgaccyttatttaatattgagtattaaagaagtatcacccgctacaaagcattagtgctagtgaaaaatatattgttgacaaggtagtttatgtaggatttattccttattgattataaatattgccttaggcgctatgggatttcttcagtcttgttttagcttgctttcttatttactaagcactcaacttaatttcagcttctgtgtgtaattatcaacttgtttgcctaaataccttcttgttaaaataaaaattattttcatgatatctgttggtgaattcattgacacttgaagcctattgagagctaggagggaaagtgtgagatcacctccttttaagcaagctgtatagttacctcctgagtcctcagggaaagtctggcctaaacaccaaacaaagtgacagagaagctggtgcagctttgaatgacttaagaggggctgttcatccttacataatataggggcctgggaataagacaagggaaatggggcagcagtgattttctggctccttataacataggctgagtttgtttggaaatgatgggaattattgtcgggtacctaaatgcttacgtcaagaataattacatagttacttcaaagtcaaatataaataatcagtagtttcgtagtttctttctataattatagtttctttagtatccaacttaaattcttagttcacttaaaaatgacgtaraatttaaagttgtggaggaaacattattttaagtcattaaagtatacttcacagtaatggacctagcaagcaaaatgcagcacagacaaggaaaacttcctggtgcaatatcgaaagtcaaatagccaaacaaaaacncccaaacgttgcatggtctttttgtgagcaaagaatgtggtactgtatatttttataagataaagttaggacattttgaaaaaccatttcagacggttgttcgtttattttgtgagtaggttttagttcagaattagtaagataagcaaagcaatataaagaatatcttacaatttatatgagtatctagatatatttctgcttttaaaaattatttttgtggaaactttatttttaaactaattgtggttcgattttaaaagtttgatcttgataggatacatctttttgaaaaattcacaaaaggttttttccttcttgctgaatcacatccacagttgaagagtacttcttttaaaatgvcttaatattgctagaaatgttaatctaatgctaagtgaatatgtaaggcagctgttattattaactatgttaaactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcracaggtaagtaaagactctctacctccttctttctcctcttgataatttaatcatttagttcacattaatagcccaattaattgagatagttataagaaagaaatatatttcataaagtcaagagaactctttaaaaaaaatccatcccaggccaggcgcggtggctcatgcctgtaatcccagcactttgggaggccgaggcaggtggatcatgaggtcaggagatcgagaccatcctggctaacacagtgaaaccccgtctctactaaaaacacaaaaagaaattagcggggcttggtggcgggcgcctgtaatcccagctactcaggaggctgaggcaggagaatggtgcgaacccaggaggcggagcttgcagtgagccaagattgcgccactgcacgatctgtctgcctgggcgacagagcgagaatccgtctcaaaaaaaaaaaaaaatccatcctggctgaacacggtggctcactcctgtaatcccagtgctttgggaggccaaggcgggcagatcacctgaggtcaggaattcaagaccagcctggccaacgtgacaaaaccacatctctactaaaattacaaaaattagccagagtggtggcatgtgcctgtagtctcagctgttagggaggctgaagcaggagaattgcttgaactccctcgggaggcagaggttgcagtgagccgagatcgtgccactgcactccagcctgggtgacagagtgcgagactcttgtctcaaaaaaaaaaaaaaaaaaaaaatccatcttgacatgggaggattgcttgaggccaggaaatcaagaccagcctgggcaacatagcaagattccttctctgcttagctgggcatggtgtcatatatctgtaatcccagctacttcagggactgaagtaggaggattgtttgggcccccagtgggaggattatttgggcctgggagcaatgactgcaccactgcacaccaccctgggtgaaagtgagactctgtctctttaaaagacaagcaaacaaaaaacctttgtaatagtatgagcagtttaaaaaacctgcaatgtcattaaaagtgtgttttcacttaagattttgctatttgtgagtttatattttctgtgaacacttagggagttttaattattttgagaaatagtttctcttttgcttttatatttatttcagtatgaatataattaaatgttttgtatttaaagctttaaatgatcagttttgttccagcttgtatttgtgtagtgttaatagagtacatagatttatgatttgatcataaaatagcttagaagttagaaaatggaagtatgacattcaaagtattttttatggtaatattaatatagttttcagatgcttcacataatttagaactttgtaagtttttttcctgccttacgttagttatttcttcagtgagttgtaaagtcggccctctgtatcaacaggttccacatctttagattcaaccaaccgtggatcaaaagtattctggggaaaaaacaataaaatataacagtggaaaagaaaatacagtataacaactatttacaatgaatttatattgtattaggtattataagtaatctagagataatttaaagtattttggaggatgtgtgtaggctttatgcaaatactatgccgttttatataagggacttaggcatctgagggttttggtatccagaggactggatgccaagggataactgtaaaagctgatttgaaaagtctgttaataccatttttaaaaaattgtcaccgtgtagtcttcaccttttgcaaagatttttttttttaagtactacctctcctttttgatcaaggcagtatgcaatctttgtattagtgtattttcagaaacatcaattagatgtttaacttgtttccttttttaaatgcttcacagataatttactagattatttttaacaaacaattcaaagcttgaattagtgaaacttcaaaaacagattgtggtatacaaattatacacatttctaataaagtacattaaagcaaaaattaatttgattttaatacatttcataaagatgatagaattgttcagtattaatatatgataaatattttatgtaaataatgatataaaagtggccataagcaagggttttcctgtcactatacaaaactaaacctgacaattcaaattcgaatatcacttgaaaagctcttaagaggaaataataaattctttaccttgttgaacttcaaaaaattaacatttggggctcaagagactctccaaattggctgtgtgaccttggataagtaacttaatctcaaaatctctcatatcaaaactgggggattagtttaagtgatttggaaaatcccattcagttttaaaatcctgtggttctctaatttttttctttagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcatygatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagttctggtctagggaatattattaccagagtttatcatgtggttgtgtttgaggaggagatctaccaactaatcagcagttctgagatgaatcgcatagggcctcatgcgtcccttttatgggagaaagttattttgctttccggtacaggatacagctgtgcttctcctactttgtatttgccatatacggatagatacaaaacctcatgactgatttttccctatttattttgagtggctctgtataccattttcatgtattacttcatttttctgtttttcagttatgttctctgttttcgtatatttttggaagctagttctaagtcatgttttgtaggaaataagcaatcttaaatacatgcataggggatttctttcttctgaggatccttaatttcttctatttttaagattcaaattgaatgattaatcagtaacagtttatgttttaaataaaagtctttaaaatgttaaatatcagcctttcatttctgatatttggtctttgaagaggaaacataatgcaatagtaattcataatagtggagggttctttcctcacatccttgaaagccaccagtcttattcttcagcctggctcttgagctattgctgtattaattttaaatagggtgtgatagcataagctgatggaagcctgcagagatctcactttgaaatggtgatacattacatgggaaaagattagagaggtgttttatactgcacatcggtgaggcctaataagaaagtagaatagacgtaaaccattgttttcatcatcctttaagacagggatttcanactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagytggggatayctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactawtaagtgaataatgtcaataaattaggagtgatcataactttattttgcagaagtaaaattataaaatttattttatgaaattgtggatttttgaatgatttttttcttttttttctgagggcttcaaccttgtattattagaaggaaattttcactgcaattccatagaagtctgtttattctcatgccatttaaaataatggtcacttaaaaatttatttgatcctgttaaaatatacaaattatctgtgttttattgggatgcacctttcctctacattaagtaaagataaagattctggccgggcgcagtggctcactcctgtaatcccagcactttgggaggccaagacgggcggatcatggggtcaggagttcgagaccagcctgaccaacatggtgaaaccgtctctactaaaaatacaaaaattagccaggcgtggtggtgcgtgcctgtaattccagctactcgggaggctgaggcaggagaatcacttgaacccgggaggtggaggttgcagtgagccaagattgcgccactgcactctagcctgggtgacagagcgaaactctcatctccaaaataaataaataaagaaagattctaaggcttggatgtcttttagctatctttagcagaattagtgggaatatttaataaatttaggcttggagtcattttgaaattatctataagaataaatcttaatatgtagtaactcactttttttttttttttttttttgacacggagttttgctcttgttgcccaggctggagtgcagtgtcaatggtttcggctcactgcaacctccacctcctgggttcaagtgattctcctgcctcagcctccctaatagctgggatttcaggtgtgcgccaccatgcccgactaattttttgtatttttagtagaggtggggtttcaccatgttggccaggctgacctcaaactcctgacctcaggcgatccaccctccttggcctcccaaagtgttgtgattacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattggtaagtcatctaatatttttttgaaaatgaatgtttctgaaatagtttacacaagaagcacaatatatttagaggaggcgctgaataatataaatctttatgtaatcttagtttgggttgttgcatcactcctggaatataaaatattacggactgtggaatttatgaggcctgacatgttatgagttctcaaagatggttcagcagcagtggtattttaaattactcttagataaccttcagtcattgtttcctgcctgtgtttctgacatctagagattagtggatggagctctcacagtctgaactgcacccttgccttgcccaggagaatagaggaaagccaggcagctcaagtactatgactcatatgggttgaaaaataccttattctgcttctccttttaggttctttttttttaaaagttaatggcatttcagttagccgtgtgtggtgtctttgtcgggcacctgtaatcccagctacttgggaggccgaggcaggagaatggcatgaacccgggaggcagagcttgcagcaagcggagatcgcgacactgcactccaacctgggcaacagagcaagactctgtctaaaaaaaaaaaaaaagttaatggcatttctatccctgtcttgctaactagaaacctgggaggagactcaagactgttctcttcagtcagcttcccatgcctattttatatcccactagtttattttatgagctatgtctcaaaatcatactcttctctctttgtctctcttacttgatcattggtcaggcctgtaccttctgccaccctctcccaataatttctctgttgccatgtttacccccttaaacacaccctctcactgccaccatgtaattactaaacatggatcttactggcsacaaccatttaatgtctcctagaagctcagttcagggtgcccctgttaacattgttcccctcttcaccttcatcgtcagttgttttcctcctcctccttgatgcagctgaaattagagctgatgttcttctggcttttgccagtgttgttgcacctgacctctcacttttcccttaggactcggctcaagcagctgagcatagtgactcaggcctgtaatcccagctactcgggaggctgaggtgggagtatcacaggagcccaggaggccgtgattgtgccactgcactccagtatgagcaacagagtgagaccctgtctcaaaatctcaaaaccaaccaaccawccaaccctcagctcaggcctcacttgcaagaattttttccaaatccccaggttggagagtcttaacacttagcgctaccattgtagtaccaaygtattgaagtaatacgtttttgcattatgcatgtctccagataggttgtgaacttgcagatggcattgaatatcttcttcacctgcctggtactaatggataccagaaataaacctgttcagaagaacatacttgaagccctgctaatggagtccattaagtagaagttaattgtttttctttctttctttttttgagatgtagtcttgctctgtcgcccaggctggagtgcagtggcaccatctcagctcactgcaacctctgtctcctgggttcacgcaattctcctgcctcagcctcctgagtagctgggattacrggtgtgcgccaccacgcccagctagttttcgtatttttagtagagtcggggtttcaccatgttggccaggctggtctcgaactcctgacctcaagtgatgtgcccgcctcggcctcccgaagtgctgggattacaggcatgagccactggacctggcctgtttttcttttaaaagcatgtatttagcagtacaaaaattagggcctaattttaatatgtgcttttaatttcagcataaccattaatgcttaattttgcaaagttttaaataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacaggtaagaacgtggaattcatactacttttacttaaaatatttgatgtccatagacatttcctacctgtatggaccttctttgtaaaaatgttccgagaactcttcctatctgttacttgtgggaatggcctccttctcattgcngccattagctgactcttttccttgtaaggcttcccctgatctttctctctgtccctgttttctgctttacgtctcactgcagtgtcccatggagggaggtgaagaaaataaaaccttccttcctgctgccttggtacccctacctacctgtccctcagcaggggaagcttcacagaactactccagaggaatggggagtaaagaagtggcagtgaggagtgtgctgcttacttactcctgctctacacttgagcctgctcggcactccaggcaggtcttggggctcctatgtaagctgtgttaagctgcagcctaaacacacagcctccccacctcatgatgatgaagaggcagctgggnacctgtctacgacagttgacatgaattattatgggaaaataaaatctgttatcaggaaaactaatttagaaacagatgttgggggtacagcccaagttagaaatgaattgcatttatttataaatgattctggtctttagccatttagtattttctttagtgatgatacagatctggatttattcatgtgatagtaaccagaagcatcttcttcctgatgttactattttatggccttcaaaaaagtatttgccttcgttgggcatagtcagagttcctctatcaatacaaattctgatgataacaaaagaaaaaaaagaatatattcacatcattttgattcgttgctgaatttttaagatagtttttaatttatgttaaattttagttttttaaaacacatgctatgaaatactgatagggtttaaaggtgaatattctaatatttgtaactttcttttaaaatgtgtacatggcagtattcataacagtttttcatagttgaaattcatcatgaaatgtcagattgaagtttatttagcaacgarctctgccaaagcattggaaaatattatgaatcaaacagtaaaactggcggttgcatgaaatggatatgccagtgccaagtatggcacatgcattttaaaaaaaatgaggagttatttactacttgtcactgtaataataactgcagtcaacacagttnaccattttgttccttatctgttatcctttctatatttcagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcaggtgagtattcggttaaactgatactaaaaactgagatgggaagagagtacttacatgcwttcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttktctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtctaataaaaacatctgtgtcttttgagttgttgtgtcaagcataaaacaagcgtgaattattttttattttatttatttttttaagagacagggtctcttctgttgcccgaaccagaatgcagtggcagtcatagcttactgcagccttgaactcccaggctcaagcgattcttcccttcagcctcccaagtagccgggactaccagtgcatgccactatgcctagctaattaaaaaaaatttttttgttgttttgttttgttgttgagatgaggcctcactatgttggccaggccagtcttgaactcctaggctgcagcgatcctcccaacttagcttcctgagtacctgggactacaagcatgtgtcaccatgccaggctccagcatttactttttagtctcttcacatttcagtaatgtcagattccacacagtcttttaagtcagccctgtggtacatgccttattggttttgctcatagtgtatattcctttggaaaccactcctgaaatatttttaatctttgaagactgaaaccttgtgtattatttctatgtttacttttacaggttagagttaatacatctttttttactcccaaggcactttatgtctttaattttgcatatttctttcttttattgtagtaaaaatctcataacgttcaatttactatcttaacattttaagtgtacaattcagtaatgttaagtgtatttacattattgcacaactgatctttataactatttcatcttgcaaaacggagacactatacccattacactaattccccttccctctctcccccttccctccacctttttactttatgtttctaaaattttgattacttgwggtacttcatacatgtggaatcatacggtatttattcttttgtgactgtcttatttagtgtatcttcagggtttattcatattgtaccatgtgataggatttttcttttttaggttgcgtaatactccattgtatgtatattgcacattttctttatccattcatctgtgtttggacatttgggttgtttctaccttttgggtattgtgaataatgctgtgatgaacayagatgtgcaaatatggctttgagattctgctttgaattattttggatatatacccagaaatgagattgttagatcctatggcaattattaatactatatttaattttttcaggaaactccatactgtgttccttaatgactattgatttacattcccaccaacggtattaagggtttccatttctccacatcctcaccaacatttgtatatttttttctamtatccattctaacagatgtgaagtgatatctcattgtggttttgatttgcatttctctttttattagttatgttgggcatcttatatatacttgttggccatttacatatcttctgcagaaaattgtcgattcaagtcctttgcccattttaaaatcagaattctgcaccctcccccccccaccccacccccgtagttaagttgtacaagtttcttacaaattctgaacatgtattagtctgttctcacactgctataaagacatacctgagactgggtaatttataaaggaaagaggtttaattgactcacagttctgcatggctcggggaggcctcagaaaacttactgtacatttgtggcagaaggggagagagggaagcaaagggacatcttacatggcggcaggcgagagagcaaatgaagagagagagagagaaagcgaagggggaagagcccctaaaaccatcagatcttgtgaggtctcactcaccatcacgagaacaacatggagaaaccgcacccatgatccagtcacctcccaccaggttccccccttgacatgtcgggattatggggaatataatttgagatgagatttgggtggggacccagaactaaaccttatcaggacattgcatttatttgtgtcttttaaaatttcttttagtaacattttgtagttttcagggtacaagtctttcacctccttggttaggtttattcctaagtatttcctcctttttgatgctacattaaatggtattttcttaatttctttttcagaacagttattgttagtgtatagacatgcaattgatttttcgtgttgattttttttatcctgcaactttgctggaatctttattagttatgaaggttgtgtgtgtgtctttagagttttctacatataacttttctttttgatcttctgattgttctattcataaatgaaagtggagtattgaagtctcctactattattgtattgctttctatttcttcccctagttatgtcagtgtttgcttcatatatttagaaacactcaagttacgcgtatatttgtaattgttatatcatcctggagaattgactcttttatcattatattgtaattaatgtccttctttgtctattgtgacaatttttgtcttaaagtctgttttatttaagtatggccatcccctttaggttcttattttcatggaatatctatttccatccttcastttaggttacgcatgcccttggatctaatgtatgtttcttgtggatggcatatacttgagtcttgttttatattcagttggtcaatctgtatcttttaattgggcatttaatttacatttcaggtcattattgatatgaaagacttttcatacctatttccattttgttaactattttctgtatatcttgtagcttttcctctcttgctgccttcttttgttttgttgattttttgtgtgtataattacattctttgattcccttgtcttttatctttgtgtatgttctatagacattttctttgtggttgtcaatacagttacataaaacatcttaaaattattaacagtatattttagtttgataacagcttaatcttccgtctcatataaaaacttgactcctttgtaactctgctcctccctcaaaaaagacctttttattgtgtagtcattaatatagattcataattactttttatgtctttgttttttaaattctatacagatttaaatgtgacttatacacctatatcaaattactttcagaattctgtatttgcctatgtatttacctttaccaaggagtattgtagtttcttatggttttgtgttactgtttgttttcattttgctttaacttgaagtactcctatcattattttttgtaggactggtctagtggtgataaaccccctctactgttgtttatcaaggagtcttaatttttcccttattttcgaaggacaggtttaggttacagtattcttggttgacaattttttttctttcagtattttgaatactactattttctaacctgccagttttctgctgataaatgatagttcaatgagagcttctttgtatgtgatgagtcatttttctcttgctgctttcaagattttttgtgacttttgacagcttgattacgagtgtgttttggtgtagttctcttcctagtggagtgttttgagctgcttgaatttatactcccatttctcttctcagatacaggaaggttttggccatgatttcttcaaataggctttctgctcctttctgtcttctttttctgaactcctataatgagcatttttccacttgatggtgtcccattcattccttaggttctcttcatttttacatttttcctctcttagtaatttcagaagtcctgtcttggagttcatagattcttttttctacctggtcaagttgctgtcgatcctctagtgaatttttcaatccatttattgtatttggttccagaatttctatttggttcttcattttaaaaaaatttctttcatttatactttcattttgttcatgcgttgttttcttgttttttttcaggtgtctgtctgtactctcttgtaattcattgagcattcttatgacggttattttgaatttggtaattcatctatttccatgtctttctggggtttatttctggagatttaatttgatcttttgatagcctgtgtttttctatttctttgtatgtctttatttttgttgggatgtcagcatttgaaaaatcagctacctttctctgtcttacagtctgcttttgtattgagaggactttgtccagtcagccctactacggattctagagccagccatcttaagccttttccgaggctgtgtcctttttgagtttgtggggtacaatctaattgaagaggtttgctggtttctactcaggagctccctctggtgtctgtctgtgatattgtggcctcactggtgctgtagttggccatggtactggagctctacctagtgtctgtgatactgcagcctctggtkcatgttaatctttgttcttgacagctcccaacctggtgccctgttcctgttatttagattcaggaaagacagaagcaagtttcttgcaccccagaagtcagaatattggatgtgtgttccactcctcttagggatttcttccctattactttgtactgtgctgaggggagggtctctggcaagcgaatgccttgcatttttctaccagcctttgatgcggttggtttccttctgtcccggagtgtaggaacttcttaagtggtttctgggtttcttacacaggcaataaataggcccatatagcattgttaaatccatgtttctgtaggggaaggagggactgcgttttcctatattgtcatcttgctgacatcactccttaacacatttctttcatgtatcatatggctagctgtttacccatttccctttgttagattgcatgctacttgaaagcagaaacttgtcatttttttgcatttttaaaagaatgtttagtaaagcactttacatgtagtaatagttttttaatatttgttgaacgaatgcttagaaaaataagtcagtcctactgacgacatacggtttttcaaaactacatctgccccttaatctcctttamatgttttcctttcttcccttcctttctcccttcatttgctgctatcatgaatctccttagtattaggcaatatgttagtaacacaatagtgagcaagcattctgtatccacatagcttgtagggaatatcctggttcaatgacataatttgtcttaaactttattattttttaatttctgaagtaaatgtgctctgcataataaattcaaggaaaacaaataggcataaaggaaaaggtgaatttccccatttcctttctcctggataccaggctctagaggtgtggagtttatagcttggtatgtatccttctcctcacatctaggtgcatataagtttatgcagcctgtgctggaacttgtcttttttttttttttttttaacctaacaataggcatttatgcagcatataatgaagtttcagtcagtgacagacacagactgcatatatgacagtggtcacgtaagattataatgtatttttactgccttttctatgtttagatacacttaaatacacaaatacttaactattgtgttacaattacctatggtattcagtacaataacgtgctgtgygggtgtgtagcctaggagccgtaggctagataatgcagcctagatgtatatatagtaggctataccatcgacattcgtgtaagatrtgctatgatgttcccatgatggcaaaactgccaagtgtgtgatgcatttctcagaacatatccctgtcattaagagatgcgtgactatattggataccctattagatacctgtctaaatgtaattttttttttttttaaatgagrtggggtttcgctctgttgcccaggctggagtgcagtagcacgatcatagctcactgcatcttcagatctcctgggctcaagtcatcctcccacctcagcctcctgagtaactggtactacaagcgtatgccactatacccagcttatattttttatttctattaaaaaatatttttaagttacttattttagagacaaggtctcgctatgttaccgaggctggccttgaattcctggcctcaagcgatcctcctgcctgagctttcagagttactgggattacaggcatgagccatcatgcctggctctaactcgttttcaatgacagaatatrtattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttytttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgarcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctatyrcaaagtctccttttagtctagataatcattatttcattttaaaattagtgtttttcktagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtrtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttttttttttttttttttttggttttggtttttaagaaaagctgttcctgtaaaagtgaaactttcattgacattcctgaaatacttgaagaaggagtttggggaattttccatcctgacctaacaacctaaccaaaggaaaactttttattctagaaattctgttaataatctatttcctagcctttttatattctaactttcccctaacccttcccgaattcctcctttccattcctcctttttggttctgactgcccagaagatatactgtcagcattttaaattccaaaatattcatacagcataaaatcttgaatagaggtggtaaattgaaatttggcatcaaaattaatggggtagaatctacaatgtggcagaaatatctaaactttgtgccaacatttaatccaataattgtgggaggaagagttgtatcatgctgtgtttcagaaactaacctccctcacccaccccatctttgactgccagtcaatatttgtgggtatatgtaactttatcatagcatacttttgtctctgtgtgtaatcctgtaacaaaaccagttaaagctttctttacataaacatttggcatctttgtgtgttttgcattaacttagacagttgtgcctaatttctcttcattaactttgctcaggttattcttttaaacattggtaacaatatttctaccacaccaaatatgcaaatgattttaggatgaggctggtctatagtgtcatggaatggtttttatggcataacgtgaaaccggttatatgcagatctatagtctgatttatgtaataatattatcttcaatctgataaaatctgcctctgatttcctcctaattagttggtccacatgcaagcatatagtctgcaaggncctgtccatttcagaatcgcctctgtaaaccagatgccttaacatggtgcatgcatggcccccagaggaggtgttcagtaactggttttgagtgaatttgaagtgttaacgaaattattataacagtgcatacgtatcctctaatgttacatgcctatttctggtttggattttccaaaatgcttttcagcaaacccttccccattagtgtctttatttagtgattttgaattgtgttccctttggtgggattcattcaaaagcaacttcctgcatttggtgatttttttcttagattcattctcatttgtttgtgaagaaaggttgttctgtgtgggttttttgttattctataaaaaagtgacttttctgcgtggattacttttatagaaacaaggtttgtctcccatatgaatgttttgatgctgaaagtttttccatgttagtgcacttacagtttttctctctggaatgtaccctctcatgttgagagagcgaagagctatagctacaggttttcccacaccgtctgcctttgtaggtttcttcccagtgtgagttctttcgtgtttaatccaggcgagctacaagggaaaaattctccacattgaccacatttgtggagtttctccagtattaattctttactggttactaaacgacgctttttgcttaagatttcccctccttctttatattcgtaggtttttggttttttaacttacatgaactctcacatgttgaacaaaggaggagcagtctttagagattttagatactttatgttcacaggatttctcacctgtatgatttttctcatgttgattaaggcagtagttctcaaactttctggtttcaggacctctttatgttctgaaataaattattgagaactccagaatgtttgtttatgtggcttatatctatcagtatttctttgtaaagggtttgtattttatcatgaaacatgtagaagtaaatcattcactttgatttttcttcatgaccataatcatattaagaatacaaaaggtataagagagtggcacaggatgagggtttattaggagggctgtatgtatgccttccccacccctgactcccaagaaaaaagattatagctatcagaagaacatagctttgcaagatttgttctgtgataaaggcaaaattccacatttttcctcaaaatagaaatgaaaaacaactatgttgtccaaataatttgatgccccaactttcaaaatgtttatgtatagaagcctatagctccaacgcgctgcctagccctgccactttgtcaaccccatggccatattctgggccctgttatcgctcagaaggcccttgtctggaatctgggaaaaggaggatgttgaagacttaaaagtcctaatgcctttaatgggggcctggaaggatggggcttcaggcctggcgggaaaggaatggtgttgtgtgggaaggtgctcacatataaaacatccagctctaacaacccagcaatgtgctgtcctcaaagctcccaaccccgctgtgagtcaccccatctgaggacctccatgagtggccagggcacagtcccttattctgctagatgctctgcctgccctgtataatacctctctgctcagccttagcactaacgccatcctcactccagtcctctcttggtttgaatgttttggatgtcttgagagcattggggcaagaactccgagaattttttttctgttttcttttttttttttttttgagacagtgtctcactctgtggccgagactggagtacagtggtacgatctcagctcactacaacctccatctcccggttcaagtgattctcctgcctcagcctcctgagtagctgggattacaggcacctgccaccacacccagctaatgttatatttttagtagagacgggatttcaccatgttagctaggctgttctcgaactccggacctcaggtgatccacccgccttggcctcccaaagtgctgggattacaggcgtgagccaccgctcccggccttagaattcttttaaacgtttccacaaatgtaagaaaagatggctttttggtagccatggtcaaaaatagccacccaaatctgtttttaccctgttcagcacatcagcagttcacctcatgtaggaaagtgagatgcaccagaggcttaaaaaagttcctatggtttgcccactaattccacatctaggaatctgaccttagaaaatactcaagagacgcgggttgagatttcttcaggaagaccttcattgtgaagttgtttatagcaatccatcaattggaaacaagtgcactaaagtaagatatcaggtaaatattagacactatccacttgatcatagaggcacaaaaaatgtttatacagctttttatattgtgaggaggacttcatactatgaattttatgggggaagaaagtaggaatcaaaatttagtaggcactttatgtcataatgtgtgtgtgtgtgtgttgtgtatatatttcatagagaaaagtctagaaagaaatgtgcaatcattggccaaaaattgtaattgacatttttctcttcatactttcaaaattctttacattggctttacttactcctacaataaaaagtcaagcttgtgtaaagaagcctagcttaaaatatggaccataagctttaaaattttttatcttagcaaaattatcaattgttaagaaaaaatatttgaagctatcttaagtgttctagtaaagaagaaactagaaacccttttattttctaatcccattcatatttatatattttttgaaagctcccttcaactatacccttgtttatcaatcttgttctgtttgttccagctttataacgtgatatatgggtatctgtgcctgtcttctgtatgtgcattttttttctggtaattctgcccatgttctgcatatctttattttcatgttcttaatccttttatttactgcttcatgactcaattttaatttttctgtaactgaattatgtaggaccttggcccctaaatagctcttttcaagaagattttcttcttgtgtgtccaatagatttgctatgccctttctcctcctcctgttaaatgtaaaactttattagtatcaatatctgatatagtttggttgtgtccccacccaaatctcatcttgaattgtatctcctacaattcccacatgttgcgggagggacctggtgggagatcattgaatcatgggggcagttcccccatactgttatcgtgatagtgaataagtctcacgagatctgatgatttataaggggtttcccctttcacttggctctcattctctcttgcctcccaccatataagatgtgccttttgccttccaccatgattgtgaggcctccctagccatgtggaactgagagtccatgaaacttatttttctttgtaaattacccagtctccagtatgtctttatcagcagcgtgaaaatggactaatacaatatcatattgtatatttttctgtagatcatccattttaaaaagaggagatgatttgctaatttttaaaaacagctcctataagaaaagggaaattcagaaagatgcttttcttctatcttttccctgaaagttgcccagttcttctttgccttttggttgttttattggctgattctagctctgggtctggtgtcagtgttgacctgtgatccctcatcagggccagtgctgagacctgtggatgattgcaccagacgtcctttacagaccaggcttgagtctccctgctattgtgatttttttttaagcttatttggaatgttagacaaacaggtgtaaaaataccatattagtttttgaaagatttgcttatttagcataacatgaatttatgctcattataaaatttctagtaatttggagatatagactaaaaatggaaatcctccctatatacacagggtttttagaaaacatataatgaattaaattttgtctctcctcccaaatgtatatgttgaagtcctgatctctagtacctcagaatgtcagtaaatttggagatagggccttgaataaggtgattaagttaatatgaggtcattaatgtggcccctaatccaatatgactagagtccttgcacaaggagatcaggacacagatctccacagagtgaagagtgtgggatgccaacccaaaaagagaggtctcaaaagataccagccctgctgacaccttgatcttgtccttctagccaacagaattgtgagaaagtgaatttctgttgctcaaaccacctagtctgtgattttgttatggcagccctagcacactaatacagaccgcagttagatcctggtctagattctataacttgccttttttattgtgagcatacattggacatcttcctgtgtcagtacatatataatggacctgattcataaataaccttgttaacggcgaggcaatattccacagaatgggtgtatcacaatgtaaaccattctctcattgttaggcacttaggttatttcagtttttaccattagaatcagtgtgacaacacaaagcttttactcccatttttgtgcttaagaggaagctcatctacaggacagctttctaacaggaatggctaggtagatcaaaccttagcagttttgtaaactatccaattgttatttggttttgagtgtgtgtgtgtgtgtgtgtgtatgtacatatatatctcctgacttctcagataaatttaaattcctgaggaatgggtgttttagtgattctttgtatcctccaagtctagtgtcatatgactttcttctaagagattctgagtgaatgttgggtatactatcattttcattaattagccttttatcatcaattagctaaaatgtgggaaagaaggggaaacatggtgtgtagtgtgacccaggcaggtcccgtccctctgagcctttgtagacactgtgttagttttcttttctcccttttttttctttttgaaataaggtcttgctttgtcacccaggctggaatgcagtggtgtgatcatggctcaag

SEQ ID NO: 10677 - DNA, 96539 bp, Homo sapiens
  misc_feature (1)...(96539): n = A,T,C or G, or insertion/deletion polymorphism (see Tables 1-2)
ttgtttttttattcttttttcttttgtctcttctgactgtgtattttcaaatagcctgtcttcaagctctctaattctttcttctgctcgatcaattctgctattaagatactctgatgcattcttcatcagctgtgtagcctggggttggtgaggcgggacaaagagggagaggtgcaagcactcttagcttccccagctggtatcttaataggtcacacgtcccaccctccaactcaatctactggctttgagcccagctcaataccaggacttgcataagaattgcagttcttgtggcctaaactgcccctcaagttcacttagggccccagtgcctccagcccacagtggcaagccttgccagaactcaagctccaattgctggaatgggcaattaccctctgccttgggccggtccaaatgccccctccatgggcaggcatcagctgagtacagctcagtttgctttctgctgtgatggggcagcactgagtctaatgcaaagcctcatgaccgctgtgctccccctctctgaagcacagagattctctccaacagggagctgctgctggggaatgggggaggagacagggatggcatcagcaatttaagactgtctttcctaccctctttggtgcctctttcagtcatgtgaaatcaaagccaggcactgagagtgctcccttgatttttggttcctatgaagattactccctttgtgtagacagttgtcaagctaggtgttcctgagaaggaatgattggcagagccttctattcggctatctcactccgcccctcccctggaatcactttttaaaatgtttgtcagttgcacgttacattgcttgaataagatttgtaggtaatattgccttagcatggctgctttcctcacagggatggagcttaaaactttcctaaagccccctctagtgacaaacagcaaattattatccattatttcatacctccaagctctaaatacctccaagctctaaagttccattttctcatttagttattagatgaatcaattgctacattatttcaattagagaatgactgagaaatagttaatagctcaaattctcaagcattcttaaatcactgaaacctaagcaattttgttttgagactgaggtcagcacagtgcacatttaactctataattttactctgccctcatacatataatttttaaggattccctaaatttccttcatttttgtctttcaggaactttaagggttaaaatatgttcgcaataactcaataaatagaaaaatgttgttttgaactttggcttcttgttgttttcactgtatttactggaacattttctaaacacacaaatataaattccaggaatcctctgaattatgaaactaagggtcatccataaagacatagattaaatatataataataacataatgcttaaaataataatatataataaaacagaataaacaataaactatatattatttgcataactataggttatggtattaaaatatatagtttatttcacttatataaaattgaaatatattgtatatttcaaatatataaaagcccatttccaaagggcttagagctcatccaataagacaggcctaattaaaccattaaaagaagaagtcatattcctaataaagggaattaacgagataaatttttaaaaggctatgaatatttatttcaactgagcacaaatcttagttttgaggttcctgtaagctaatacaaaaaaagaaacccagtaattgattagttcatgccaattcattaagggaaacaaagtatttccgtctaaaacacacatatgggtcaggcacagtggctcatgcctgtaatcccagaactttaggaggctatggcaggtggatcactttaggcctggagtttcagaccagcctggccaacatggcaaaaccctgtctctactaaaaatacaaaaattagccaggcatggtggctcacgcctgtaatccagcactttgggaggctgaggcgggtggattgcctgagctcaggagttcaagaccagcctgagcaacacagcgaaaccccgtctctactaaaatacaaaagaaattagctgggtgtggtggcatgcacctgtagtcccaattactcggcaggctgaggcaggaggattgcttgaatccgggaggcggaggttgcagtgagtcaagatcacaccaccgcactccgcctgagcgatggagcgagatttcgtctctacaaaaataaataaataaataaacaaacaaaaacacatatgcagatttctaaatgtcaataacaagattatagcattggaataatttcagaacatgaaattcaggtgtaaacatatatattcaacaaaaggtcttcagaatgcctactctccaaggccattgcagctggtgatgattttcccaatagaagggtgtttcttgggagctcaccctataataaactcataccagctgtatccatcacccatgatcatgaattatttcctgggaatagcaaccagaaagaatcttctctcttgtttacatacatagagccaaagcaaaggacaaattaaattgcacttaggataacatgttcattgctaaaatttgagagacatagaccctattatgcacacattcttgaaataattggaacaaaatattgaaagggaaataatgaaatagatggcttcagacaaagttgggtaccagacaatatggtctccagaagtttctcccattctgctgccctctccagatcacgcacccccccgttctacttgaaaacaaaatctacttgtcatcctaaagtctacttttctaagaggagctggtatcaccttccctgagtcaagtcactgtgttgcttatcccaagggtgtttgccttgggttccttgtttctaattcaatttaacaaatgcttactggaggcctattatatgcaaagtatttgctagctgccagtagtgaaataaaggccttcatgatcttagaaatggatttcaggcaataatgagtacctaggaaggagtttttgttctctgcatgatatgatttggctctgtgtccccctccaaatttcatgttgaactgtaatccccatgttgggggaggtacctagtgagaggtaattggatcatgggggtggattttccccttgtcgttctcatgatagtgagttctcatgagatatgtttgttaaaacatgtgtagcactttcctcttcgctctctctccctcctactctgccatgtgaagaagctacttgcttcccctttgcccttccaccatgatagtgtttcctgaggcctccccagccatgctttctgtacagcctatggaactgtgagtcaattaaacctcttttcttcataaattacccagtctcaggtagttctttacagtaatgtgagaatgaactaatagactgcataacatctgactccctgcccctgtatccttccaaattacttttgttgttggggccacagagccatcacacacacttcaacatgcctccaattttgaatcattgtctgcctaccctgggttttaggaaaacaggggttcaagcgttattataaccgggtttctgatttatttctccttccttgttacagagtttctgacttactccctcaagcctgaattccctgatacccagctctgctgagataggaatctcagaagagagaaagctaacatttattgaatacattcttttatttgccaggcactgttaattcttttaactataaaattagtagcatcattttttcatcccaagcaacagagaggtagactgttgatgaaaagagtcaaactctgtaaaatatttttagagatttattctgagccaaatatgagtgaccctcaggaggtcctgagaacatgtgcccaaagtggttgaggtgcagcttggttttatacattttagggaggcatgagacatcaatcaaataagaaatacattggtttggttcagaaaggtgggacaactcaatgagtatgtaaatttaaacatttcctggttgacaattggttgagtttatctgaaggcctgggatcaataaaaaggaaatgttggggttaagataaaagattgtggagaccaagtttattgtgcagaggaagctctcagtatagcagacctcagagagagagcagattgtaaaatttgtcttgtcggacctaaaagggtgcctggctcttagttggttatctcctggatttggaaaggaaagaaggaaaacaaaggggaaaagagattctctatagaatgtggttttttcccacaagagattttgcagggcaatttcaagatatggcaaggaaatatatcttggggttaaatattttgatttttttttccttgtctcataatattatgccagaatcagattggaaagtaagtcatggtatatagagtcaaataaaacccatctgataagaatttatggtttctagggcatgactccctagacaccttagataggaatttgggcaagataaaaaaattagagcttagtcctcaactctacagaagaaaatgacatttacccaggaatgggcattgcaataggaatatgcgtgccatggcaaactgtttgcatattcaaggaattaaaggaaaaaaaagtttttttaaaaaataaaaaaaggagaggattacataattgttttgaggtaattagccttggctccaagcatcaataacaagggtgatgtcagttcaaggttggacagacaattgctggacagatgtcctcatagaagtatctttttgggtaaggtggaggtctttgtgcaaggttgtggttttcgcagtattttgtgatagttttattatcaggcattcatggatgagaactctccttcatggccttctccagttccacttgtcaggttttctaacacatgtgactctatttttgattctgacaactttcacaatctacattagaaaagagaaaactggggctcagaaagttttagaaactaattcaagatcaagctggtaagtagcaaaaaatttagaattaagttctacatatctggttccaaaaccaggactcttttcattacagcagtggttctcaacagagttgcgattttgccccccagggaatatttcacaatgtctggagacatttatgactgtcaggattggaggtggagtgggtggggtctgcttctgagaagctacttgcttctagtgaacggaggacagggatgctacaaaacagttcatagggacagcacccccacaacagagaattatacaaccagcccaaaatgtcaatggacatttgggctgagaagtcttacatgacagaatgcttcctaccctgatctgacgttatttccaaggattcaaaggtaactgcttcaaaattaaacaaattatagaaagccatcaataaatcaaccccttattcatgttgcagctctcttccattataaataaaaatggattgaaacttacgataaaagggaggcagggacaggagcggggaagcttggcgagcagaaaggaaattcaaacttattattaaggttaagaattaagatgtaaatatgtagatgtttttcacccctaggattttcactaatccaaaagttcacggactgctttgaaatttaattatttggaactggttaaatgttaccctgacctcagctaacatttgtgtttcacttttctccgggacccaggggacgtggatgccagatgagtccacctcctctccctgctcttcccgcagggacagagcctgccaggtgctggtgactcggatcctgacaggaggtcgctctgcggaagactggcaggatcccagagcaacagactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcnacggtttccctgctgctgcagcccccgtcggctcctyttttccagtcctccactgccggggctgggcccggccgcgggaaggaccgaaggggatacagcgtgtccctgcggcggctgcaagaggactaagcatgnatggcagccggagaggtaaagggcagctgtcaggggctaccgccgcctcgcccctcgctccaggcggcgctcccagcctcgggtccgggcagctgagtgcaaggccgccccttgggcgcttcctacccctggctgagtcgccagtgttgcctggagctgcccaggcctgcgcaaaggaagagggagagcctgcttgccagcctcgcaggtccgcttctttgccctgaatttgtcgccctgacaccaggggcccctgtctcctgaactcagggtcgtgcagcctttaaaacctcagtagctcccaggcagaggaaccaggtttggtctttggagtcagacctccccgggccccaaatcaaacccctctgctctccatggagacgaccctcagttttcttatctcttgaacgtgagggtcaaatacccaggccatggagttcttgaggattaaatgcagataatatagagaagatcctggcgcatttgaagtggtcagtaaatacgaaatctcccagtaacgaactacctcccccaaagctactgagtaacccagggtttctgtaactttctgtgaataggaatcccctcagggtcatgttaaaatgcagattatgattcagtaggtcccttgggggtggctgagattttgcatttataataaattccaagtaatgcggtgttgctggtcagcggactgcagttttagcagcaatccgtactcaccatatacacctgttctctactgatttcttgagtcaggtggacatcatgtggtggggttgggggtggggaaatacaatcttaaatatctacaaatcggcccaaaccaaataatttgcattttcacactttctgagccagtatcattctttcctcgagtcaaatgaggcaatctttatagactccccgcccctcccaattcagtgtttttatctatttaaaagactgcctttaaaccaagctgctagatgattccttgatgtctttctttgaatgagtctgcctttattatatagtcattgatcaaaataagtgctactccgaatgtaggagataactattcattgatcagcaaactattctgacacttcaccaacctaggtttcagaaaaagcaaatcaaaacgctttatgatcttaagaaattttgcatataaactaacattaaacccttgctatgtactaggaactatttccaaattatctcatttaatgtacaaaaataccttgataggcattagccttatttcatagtgaagaaactaaagcaaaagatcacaaataacttgccaagatcacagcggcagaacaggatttgaatctaggtgaagaatataaatctgaagccaatgcatttacttactatcccatggtagggatgggcagggggaaaggataaatgtaacatttagagtatggtagatttagtaagttgtcagtatttgtttattgaattattttaaaaattgggttcatgccaaatgtaaaaaggtttatatttttacaacttgcacaatttaattagcttcatttttaggaaataatatatgataatgtcaaatactgttattttgaatttttaaaataaatgtaatcaccaaataaccagggcagtcagctttcatgtactgtaaattaataggaaaccataaataattttagacacagctaaaataattgagaataaatttcttagatttcattaggaggtgcttttagttatttcagagcataaaatattaaaacatctaaagaaaaattatcttttgtcatgctcttactgtaatcacgttttagacattcttttgtaaggcaagccttctaaatggtggtatagtacagcaccagactgaaaaacsgttagtcttgtttgtaatctttgtttcctactaactaactaggtaatcttcagcatgtcactgtacgtccctgggcctcagttatttataaaatgggggcttggactaggtatatataaggcatggtttccagcttcctatgggggaaggtgaagaaaagattgagaataacaaactgccattcactctaatatcaatgacctttaggaaggagaggagacaacctattagtatattactgaaagtaacttgaaaaaaaattttttcccagcactctgggaggctgaggcaggtggatcacttgaggtcaggagtttgagaccagcctgggcaacagaattaaaccctgtctccaccaaaaaatacaaaaattagccaggcatggtggcgtgcgcctgtagtcccagctactcgggaggctaaggcaggagaatcacttgaacctgggagggggaggttgcagtgagccaagatcatgccactgccctccagcctgggcaacagagcaagactccatctcaaaaaaaaaattgttttgatctgttggtctcatagagacacttatcaatggtagatttccaaacctttggttttccagagaaaccttgccacaagaaacactttcatctttcctcactggactttcttctggctattttaatcaaattgtgtaggaaaatgggctgctctcatataccagtgaatttcaccactaagaccttcaatctcattgacaagattttagtcctaatagttagagaatgatgttcttttccttggcatttggtttgaggctacttctccatgcccctttggctcattctgggtccagtccagtcaggagatagaaaccatacagtgatttttatacaaggaaaagttaaagaattgttatactttcataaaagagtaactataagatgtaaggggctgggcgtgtcagctcatgcctgtaatctcagcattttaggaggctgaggcaggagcatcacttgaggtcagtggtttgtaatcagcctgggtaacatagcaagaccctgtctctagtatataaaacaaattaatgaattaattaaaaagataagaaaactgtatttggtacctagaattacgggaaagtactcaaagaaggacaatttgaaagagagtttctcccaaagactggggttcagacctcattagagaaggcgtgattgtgcacttgcccaaagcttcatcaccgaggagtgatatcggaggcttcacattccatgggaaatagactttgataaattgcttagccaagtcactaaacaaacaagtgaacaacaatgaaaacaagctcaggagaggattctgtatctagagttgctgcaatatattacctaaaatgttaacttttcaacaaaaagaaattgcaagtcatgcaaaaaaacaaaaacaaaaaaacaggaaaatgtgacctatacacaggacacaaaggaggaaccagaaactatgagagggtagatgaattaaatcgtcttatttctcccctcaattctgttaggtttttttttttcctttctctttcttttttcttttttcgagacagggtcttattctgttacccagactggagtgcattgcagcctcctgggctcaatcatcctcccatctcagcctcctgtgtagctgggactacaggcacacaccaccacacccagctaattttgtatttttttgtgcagttagagtttcgccatgttgtccaggctggtctttgaacttctgggcttaggtgatcagcctgcctcagtctcccaaagtgctgggattacaagcacgagccattgtgctcagccctaattctgtcatttttaatatgacatgtatctataggaatattagaaaccaatgagtatatgccttggtgtacgtctgatggtaaatagacaagggaacatagacatcaaggaacatctaaattccatgtttgttcttatcaccatcttatgctaaagagcagctggattgattcctggggccaaatattaaccaccttgttcacagctgtcacttacagatgggtggggaagcatttctatccagagcattatcactaggttccagccttttttcattctcttttcatcctttcacacttctctgggtatacctgtttttcctttttctgtgacctatagtgaaacatacatagaatagaatggaatttggagggaataaactacatacagctgagatatcttcttggtctgtttcacatgatttagtagcttagaacatggttcaagtactgagcagtttatattggtcaagatagtgtaatgattaagacccaggaaacagactgcttgggttcagatcccaaatctgtcacattcttgtgtaatctttggcaaattacaagtttaacctctgtgcttcaattaccctcatctataaagtagggagaattatagtattgtaaggattaaatgaatttataccagcaaagtgcttggagcactgcctggcagggttaccactcaataaattagccttttgactacaaatgaagaaatcaactcatactggtttaagctaaaatgggaatttttttttttttttggctaatgtaaagaaacgtctagggaaggaagagcttcaaacatggttggcctcaggtactcaaatgatgtcaccaagaaatcgctttctatcttggttccacttgactgtgtaggcttcattctcagacaggttcctttataaggttcaggatggccaccagcaatacagggcttgcttagacccttcactgggtttagcaagcccagtgaaatgaaagtacctttcctaatagttcctgtcaaaggcccaggattgtgtatctcatgttgggacttggatcgcatagcattgctgacgctgtcaacacagctgtccacatttgggttttatgcctaaccctgacagtggggtcagctctatttgaaccacctgggctaagagtaagggaagagtcgcccaaaggaaagttgagttgtcatttccaggtgaagaggcattgaattctggacaagaaaaaagtcacagttctttctatctggagaaatgaggtttttctgagagtttgttggtattttttcttatgtttaggtcttaccctccttctttcttggtagaagctatgctcatttcatgactatcttttttcccagttcagatggcatcaccttgacttgtattgtcctaaatatttttttccttcctgcactctgacctgtgacatagaaagagcttcatagatattctgacctcagtttgtttttctgttttaatctattctgacaagctttgttctctggtcttagattttagttctcctagctcgatacttcttttttctatatttagtcatccatatatcttctagactttctatgtgtcctccttgttatagcttttaacagcccacctgatagcaaactagccntcttaccctcttaaaacatctctgtttgggggataaagcatttatattttgcatattaaattacatttaatgctgtaactcagacttcctgttttggagattactactaaaaacgcaatcaccttttaggaaagaaattattttgtgataaatttattatttaaaaaatattgaatattgttgtttttgtaaaagttgtgtttcatttatcctaatttatgatttttttttcttgttaaaagtcagagcaacctctgtccttcccagatatggtccaccgtgcctatttaaaggacacttgagcaccaaaagtaatggtaagtgaggtgcttaaaayggcagctttgttagaagattgtctgagtgtttcctttactggcaaattatatgacatgatggaaaaattgtttcatttgacgaatatttgaacttcatattattaattttaatgaaatataggcgttcttgagattagagaattttggagtctatgatttcaaactattattgtgccctggatgtggacttggctgtctcctgctcccagctgctacagcagcccagctctacttttgccaggaaactaccctgatttaaggcatacctgccttgttaaaatggtgagtagcaggtattaaagacgcaagcactgaaaaggaaaagctgtgcagagaaaaagagcacttgaataatacatttcctattaggagcaaaggcctatgggcctctttatccaactggatttctgggtgctgtgatatttttatattttaaagctttcaaggtacatttttaaggtaggttttaaaataaatttttgtaattataccttagaagtataagtctatgtccttaggcaaaataattaaagccttattttccttatttacaggaaaaatctttgatactgttacctccaaatgtggtggaaggatctcattttcagttgcctcacttatttctttgtattacagtgtattttttaaagtttatgattgtggctatgtatgtatgtaacatatatatgtatgtaacatagccataatgataaactttaaaaactaaattttaaataaaaagttaaaactagatttaaaatatacatacatagaaatcaggataaagaacaatatgtaaagtttgctaactttcttttaaagaatatatatatagagctggtataggtatggtggttttaagtatgaggctgccttggytcacatggaagctgcatcctttatcagcagtgtaaccttgaagatgtaactcatatctctgtgcctcagttttcacttcgattaaatgataataataatgactagataagtttatacatataaagagtttagaacaatgcatggtaaatggcatttattcagtaaatatttttagtagtggcatcaagctcgtaattattgcataggcttgtattatgcacagagtctctggaaggatgcatttaaacagtaacatagtatatttctgggaagggagactaaaggtcagggtagagaaatcrcttctttttcaaactccatatgccattttagctgttgaatttttttaaccacattgcgtgtattacttctcaaaaactgtttttaatgtttaaaaaagctttgcctatatttatattttatacttgtgtgtaagtgcttaactatttctaagatttcttttaaacagtttgaatgaggaccaaggagtttaatgtcatggaatttctttgcgattacacttgttataagatagttttagtacttcaaaaagaatgtagtaaactggtatgtagatcttgttttcaggtttaagttagaaatttgcttcttggaatataatttttgtatgtagggttttgggatttggtagtcattgaatttctgaaattccgttgattragtattaacaatggtaactaattaagcaagcagctaaacatccttagttagaagattgagagctgtcaaaaaaaaaatagttctgtaaatgtaatgacagatcatatcctagaatctcttccccagagtctcaggcttgtaaaattttattctcaggaaggtttgaacccaaatggtcaatagctcattggcattatcagtgcaagattaaagcttcacatcacaatgtcatatatcaatatctctggttgaatttcagaacwttttataagaatgagttaaakaatcagtgccttgtttatctcatgatttttatattagttttaaatatataatgattatgttttaatttttagctttttgcactgactcctcttctctcagactaagcactctccagctggtcaagaatcacatggctgttcactataataaaatcctttcagccaaaggtaaaaatgtgcaaatgtgaactctctgtactcaatttaaacctccagcttcacttctcattaaaatatatctatagcaaaaatgaataccttatatatatgagaggatttgtatttgtttggtttagtgtgatacaaactattgactctaggtacttagcaaattcatacccatttttgttaactatatttgaaatctatatattgcctattttatttcgttttttatctctattgctaataatattttgttagatattgcttttaatatgaaaatatataatctgcttttttgtttacacatctatggaagttgcacaaagaagatgctatttttctgtttaatttttttcttttgtcagctttattgagataaaacttacattataaaatgcattgattataatgtgtacagataaatattttgaaaaatgaacacatttgtataaatactactacaaccatgctgtaaaacaggaatcagctaactacaccgttcaggccaaaccctcctaccacctgtttctgtacagcccatgaactaagaatggtgttcatatttttaaatggtagcaaaaaatttaaaaaaaagtattttgtgacctgaaattcaaatgtagttatccatagacaaacaatcattttcaatcttttacatattgtctgtggcagcttttacactaaaaagcagagttgaccagttgtaacagactgtatcaccctgcaaatcctgaagcatttrctacctggccctttgtagaaaaaatttgccaacccttgatatagaaaaagtccattacctcaaagagttccccctagtcctttgccgtcagtcccctcctgacaaatccctggcaaccactgatctgctctttcgcctatagttttaccttttctataagttcatagaaatggaatcatgtatcgttttgggtctggcttttttcagttatcttaatgatcttgagactaattcacactgttctgtgtaccaccatttattcttttgtattgttaaggagtatttcatttaatgaatagaccacaatttgtttatgattcaccagttgttaaacatttggattgttttgactcacttttggccattaggaataaagctgctataaacattcacatataattttggcgcatgtgtttacgtttcactcgggtaaatttatgtgtcaggagtagaactgtgaggtaatatattaagtataagtttaattttataagaaactacagttttccagagtgaatataccatttacatttccattacttctgcacccttaccaacccttggcgttgacagtccttttttaaccattctagtgaatatgaaatagtatcacttcatagttttagtttgcatttccctgatttctagtgatgttgccttattacttcccatctgtatatcttctttggtgaaatgactgttcaaatcttttacccattattaaaaatgggttgtttgtctctttagtattaagttgtgagtttctttatatacagattctatatcagatatatgttttgcagatatttttttcccaatctgtagctggtgttttcattttcttgttaaaattcgtattctggagaaatttttagacttacataaacatttaaaaattgtatagggagttaccatataccctgtactctgctcttccactaatgttaaaaatcttaaaaaccgtggtatagttatcaaaaccaggaaatcaatattgatgcaatcccattaactacagaccttatttgaatttcaccaatttttgactaatgtcttttaaatttttattttctcatttaaatagctaaagtttttaaattttagtttatattttatgatgcttatatttttaaatgactaaaaaaacaaaagaaaaatattttgtgacatgaaaatcgtgaagtcgtttagttttttagttttataaactaaacaggttatttcataacctgttcaagaaatatttgcctaaccttaggtcactcagaatttcttaatatgttttcttctagaagttttaaagttttagcccttacatttaaatttgcgatccattttgagttagtttttgtatatggtgtgatataagggttttgaggttttttgtttgttttgtttttttgcctcttcatatccaaatttcccagtaccatttgttgaagaggttatcttttctctatttaattgtcctagtactttttgaaagtcagttgaccatatgtgtgggtctgtttctggacttaactccttggttctgttgatctatatgtctatctttaagccccatgccacactgccttaattattgtagcattacagtaagtcttgaaatcaggtagtgtaagtcttccattttgcttttttttccccaagcttgttttgggactacattataagtatgttaagtctgtttcattttgagtagtttatattgctatgtcttcaagttcactagtattttcttctgcagtattgaatgagttattaatcccaacagtgtatttttaatcaaggatcttgtgttttccatcgctagaagtatgataaacagctgcaaggtctggaacattttgtgatttccacatttggtatttgtcatttataaatactgacaatattattaaactattacctttctctttcagctgcagtagactgctcggttccagtaagcrtgagtaccagcataaagtgtaagtaatttttggacattattacctttttaaaaaaaaattaaggtaaatatacataacataaaatttactgtcttaaccatttttaagtgtccagttcaatattaagtacattaatattgtggtacaatgataactactacctccagaactctctttatactgcaaaactgaaattcctgtgccacataaacaataatttcctcccataggccctggaaaccaacattcttttctatcactatgaatttgactactgtcaccattgtacttactatctctatgaatctattttaggtaccttatataagtggaatcatatcgtgtttgttctgttgtgactggcttatttcacctagcatgatgttctcaaggttcacccatattgtaatgagtcagaatctcctttttaaaggctgaataaaattccattctgtgtatataccacattttacttatgcattcgtcagttgatggacacttgagttacagtcaccttttggctgttgtgaataaactatactgctatggacatgagtatacaaatacctcttcaagaccctccttttaaagattttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaagcaatcctcccacctcagcctcccaacagcctcccaagtaggtgggactacaggcgcaagccaccacgcacagctaattttgccacagcctttttacatagagacagggttttaccatgttgcccaggcttgtctcaaactcctgagctcaagtgatccacctgactcagtcccccaaagtgctgggattataggcgtgagccactgcacccagtgaccatattgctttctatagcagctgcaccattttccattatgactaatgatgctcaagtattcagatttccccatgtcctccccaacacttgctttttcctatttgtttaatagtagccatactaaaaggtgttgacacattgccttttgagaaagcatttctaacttaaaaattatccaaaaatacccaggcacagtggctcacacctatgggagacagaggcaagtggatcacttgagcccaggcatttaagagtagcctaggcaacatggtgaaaccctgtctcttcaaaaaatacaaaaattagctggatgtggtggcatgcaactctggtcccagctactcaggaggctaaggtgggaagattacttgagccagggaggtcaaggctgcagtaagccatgatcatgccactgcactctggcctaggtgacagggagatgctgtctcaagaaaaaaaaaaaaaaaggaaaaagaaaacccataatgttgacacaggatatatagaatccttatatatctaccctttgaccaggttatcttcatttttaaatcatcagaccaaaaatttgaaaaccctgtttaaaaatttctgaagaataccatttgaaacctttgtttttgatttcaattaagaaatgtatactttatgggaggccgaggcaggcrgatcacgaggtcaggagatcgagaccaacctggctaacagggtgaaaccccgtctctactaaaaaacaaaaaattagctgggtgtggtggtgggcacctgtagtcccagctactctggaggctgaggcaggagaatggcgtgaacccgggaggtggagcttgcagtgagcagagatcgcatcactgcactccagcctgggcgagagagcaagacaccgtctcaaaaaaaaaaaagaaatgtatcctttaaaaataggcaaaaaacatggctgtcacagcctttgattgtcgtattaatcatataaaaatcagtgttatacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacagggatgaaattggaaatcatcattctcagtaaactatcacaagaccaaaaaactaaacaccgcatattctcactcataggtgagaattgaacaatgagatcacatggacacaggaaggggaacatcacactctggggactgttgtggggtggggggaggggggagggatagcattgggagatatacctaatgctagatgacgagttagtgggtgcrgcgcaccagcgtggcacatgtatacatatgtaactaacctgcacaatgtgcacatgtaccctaaaacttaaagtataataataaaatttttaaaaaaagataaaaaaaaatcagtgttataaattttaagtttagtgttttctaagtttctaagttttctaagttaatatttgaatttatgtagagtttgagaacatttctacattaaaaaagtaaatatcagccaggygcagtggctcatgcctgtaatcccagcactttgggaggctgaggcgggcggatcacgaggtcaggagatcgagactatcctggctaacacggtgaaaccctgtctctactaaaagtacaaaaaattagctgggcatggtggcaggcgcctgtagtcccagctgctcgggaggctgaggcaggagaatggcgtgaacccaggaggcggagcttgcagtgagccgagatgatgccactgcactccagcctgggcaacagtgcaagactccgtctcaaaaaaaaaaaaaaagaaaaaaaagtaaatatcaacctaaggttaattcatgctaaatgataaatgaataaaagcatacatagggaaatgccttttgggtgcaatctaggaaagatcacaaacagtaggaatggttaactcatctctgcttgtatatcttagttgaagagatagaaggtaggggagaaagtaactaccagctataggtcatagctacaaacacagtgtctgtctcaggccttgtgcttgacactttgtattctcccttttctattctttttatgtttgcaacaaaccttcgtgtaggctgtcatatttttgaaggaaaattagattcaaataattttaaaggaggaaaaaaggcatgttaggcaagagtagagacttcttagtacatatttttaaagaccagtttggtcgctacatacaagttatatgggcaagtcattttacctctgaccttccttttttgtgaaatgaaaggtaattagatgatttctaaggacccttccagatttttaatttctgtgctttacatttttttcttctgtatcatattagtaacttttttgtagcacaaaactggttcagtgtttacatgctttaaatatctggatcatttgaattaagttggttgggattacaggcgtgagccaccgcgcctggccttaaaatgatctctagagacaatgacagccattatataatttttaaagggtcaacttaacaggaagatgtaacaattatctacatacccaacatcagaactcctaaatatatcatgcaattgtggacaaatctgagggagaaattgactttaatacaataatagaagacttcaataatccactttcaatagtggatacatattataagacccagacagaaatcatttaaaccgctgacttgaacaacataatagaccaaaggaatttaacagatatatacagacctttataccctattgaagaatacgcactcctcaagtgcacatgaaaccttcttcagaatagatctcatattaggccataaaatcagacgtaacatatttaagaagataaaaatcatttcaagtatctttttcaaccagaatggaataaaactaataattaatagctgtaagaaaatgggaaattcacaaatacatggcaactaaacaacacattcttgaacaagtattgagtcaaagaagaaataaaaacagaattttgatatcttgaggcaaaggaaaacaaaaccacaatataccaaaacttacagaatgcagcaaaattagtactaagagagtggtttatagtgatgaatacttacattaaaagaggggatctcaaacaactcaactgtatacctcaaggaactagaaaaagaagaataaactaagcccacctcggtaaatccctagaaacatacaaccttcaaaaactgaatcaagaagaaatatcctgaatagactaatagaaaaaaggagattgaatcagtaatcaaaaacttcccaacagaggccacatgtggtggctcatgcctgtaatcccagcactttgggaggccaagacaggcagatcacttgaggtcaggagttcaagaccctctggccaacatggtgaaaccccgactctactaaaaaatacaaaaaattagccagatgtggtgttgcacacctgtaatcccagctactcaggaggctgaggcaggagaatcacttgaatccaggaggtggaggttgcagtgagctgagatcatgcccctgcactccagcctgggtgacagaatgggataaaatctcaaaaaaataaaattaaaaattaaaaaaaacttcccaacaaagaatagcccaggaccagatatcttcataggtaaatctaccaaatattcaaagaaaggatagcaccagtccttcttaaacttttataaaaatagaagtgggaatacctccaaactcattttatgaggctagcaccaccctgatgccaaaaccaaacaaagacaacacaagaaaagaaagctacaggccaatatatctgattgatataagtgcagaaatcttcagtaaaataccagcaaactgaattcaattgcatgttaaaagagtcaaacaccatgaccaagtcagatttatccctgggatacaaaggtggttcaacatatgcaaatcaaccaatgtgatataccacagtaacatagtgaaagattaaaaaccacacaatcatctcaatacatgcagaaaaaccatttgacaaaattcagcatccattcatgataaactctctcaacaaaataggaatagaaggaacttacttcaacagcatgaaagctatatatgaaaatctcacaggtaacatgatgcttaatgaagaaaaacaaagcttttcctctaagatctggtataaggcaaggattcctcacttttgccacttctgtttaacatagtattggaagtcctagccagagcaattagacaagaaaaagaaataaaaggcatacgaattagaaagaaagcagtagagctgggtgtggtggttcactcctgtaattgcaatactttgggggaccaaggtggagagatcacttgaggccaggagtggccagcctgggcaacatagtaagaccatgcctctacaaaataaaaaaactaaaaattaaccaggcatggtgacacatacctgtagtcctagctacattggaggctgaggcagtaggatcacttgagcccaggaattcaaggtcacagtgggctttgaccgtgccactgaattccagcttgggcagcagagaaagaccctgtctcaaaaaaaaaaaaaaaaaaaaaaaaaagtaaggttacttctgtttgtgatgacatgatatatatgtagaataccctaatgcccaataaaaaagaactgttgcaataaattcaatatagttttaggatacaaaattaatgtacaaaaaccagtggcatttctgtacacaaacaactgtctgaaaaggaaattaagaaaacaatgccatttgcaacagcaacagaaaggataaaatgcttaggaataaccttaaacaaaaaggttgaaaacttgtacactgaaaactataaaacatcaataaaggaaattttagaagacacagataaatggaagacatccatatttatgaattggaataattaatattgttataatttttgtactacccaaagtagtctataaattcactgcaatccctatagaaatcccaaagacattctttacagaaatagaacaaacaatcgtaaaattcatgtgggaccacaaaagaccacaaataaaacaatcttgagcaagaaaaacaaggctggagaaatcacactttctaaatttcaaaatatatttcaaagctacaataatcaaaacagtatggaactggcaaaaaaaacacataccagaccaatggaaaagaatggagaacccagaaataaatccatgtgtttatagtcaacttatcttcaaaagggtaccaaacacacacagtggggaaaggatagtgtcatcaatgaatgactctgggaaacctggatagtcccatgcagaaggatgaaaatggactcttaaaccatagacaaaaatcaactcatacaaaaatcagctcaaaatggatttaaaaacttaaatataaggtcctaatccataaaactactagaagagaacatagaaaaaaagcttcttggctttagtctgggcaataatatttttggatatgactctgaaagccaggcaacaaaagcaaaaatagacaagtggaattcaccaaactcaaaagcttttgtacagcaaaggaaacaatcgacagagtgcataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataagtgtatgaaaaggtgcttaacattactaattatcagggaaatgcaaatcaaaaccttaatgagatatcactcacacctgtgagaatggctatcaaaaagacaacatgtaacaagtgttggcaaggatgtggaggaaagggaacacttgtgcactgttgctaggaatgtaagttggtacagccattaggcaaatcaatatagaggctcctcgagaaattgaaaatagaactaccatacgattaagcaatcccacttctgaatatatatccaaaggaaatgaaatcagtatgtcaaggagatatctgttctcccatgtttgttacagcattatagcaaatagtcaagatatagaaacaacctaaatgttgacagatgaatggataaagaaaatgtggtatgtgtataaagaaatactacacacacatacacacaacccacaccacatttataacatacacagacacatgcaaaacccacaccacatagcctttaaaaagaaggaaatcctgtcatttctgtcatttgtgacaacacagatgaacctgagggttcattttagcttccacatataagtgagatcacgtggtacttgcctgtgtctggattattaaacatgtgtatgtgcaatctaaagtgggcaacctcagagaggcagagagtagaatggaagttgccaggggctacaggaaggaggaaatggggagatgttggtcaaagagtacaaagttttagttaatgcaagttgagtaagttctggagatctaatgtacagcattaattagagttaacagtactgtataatatacttgaaatttgctaagacagtacatctgtgttctcaccacaaaaaaaagaaaaagtagcaactatgttaggtgatagatgtattaattatcttgattatgatcattcacaatgtatatcagaatatcaaattaaatgcctgaaacatatacagtttgtctgctataccttaacaaagctgaaaaaattattacctaagcaacctgatatatatataaacttaaatagaatggccatctggtcatgactggaaagaatatattaaccagatatatttggttaatgtattgactggaccaaaagaaaaggcatatcttgttataagatagaaagactctatataatgcaaatatattgatacatactttttaaagtattgatactttttaaagtaatttctaaattcaatgtgagctcaattaagatgccaaaaatcagtattgttcatacactacttgacaaaatgttccaaaattaacctacatatatatgagaaaatagccagaaataatctgaacatgaatagaaaagagtagtagagtagccctactaagtatttaaaagtattttaggtcaggcgttgtggctcacgcctgtaatcccagcactttgggaggccaagacgggaggatcacttgaggtcatgagttcgagaccagcctggccaacataatgaaacccgttctctactaaaaatacagaaattagccaggtgtggtggcatgcacctgtagttccagctactcgggaggctgagacatgagaatcacttgaacccgggagggggaggttgcagtgagccaagatcatgccattgcactccagcctgggcaacaagagtgaaactctgtctcaaaaaaaataaagtcaaaatcacaaatttaaaatggtcatttaatttattttgctagagtaacaaaataacatttaatttagtttgctagagtttattcattgatttattcagcatatatttattgggcccctgctatgtgctagacattgttctaagggctgggactaaagaggtgaacaggacaaatttcctgcttttgtagagtttacattgtagttggagaagacaaacaataagcaaatacaaataaataaagaatatgtcatatggtaataaatgcaatggaaaaaaaatgactgagagtcccttggaggagaagcccttgctgataaggtgacaattgagcagagacctgaaagaattaaggaagaggcatgtggctatctggggaaaaagcaatccagacagaggaaacagcaagtttaaaagccttgaaatggtgtcatgattggtgttttcaaaaaacagcaaggagggctgtgtagctagtatggaataagccaactgaagagtaatagatgaagtcactgagatgggacagagggatgcagagaataaaaggcagtggccattgcaaagactttggccttcactctgaatgaaattgcaagccattggagggtcttgaagagaggagtagcagggctacttttacttttaaaagcatccctttggcttcatagttgggaatagtctgaagcagaatgactagttagaaracagtaaataatccagatgagaaataatggtgactgggaccagagtggttgcagtggagagagattgaaataatcagattctggaaacatttcaaatgtgtgtccatagtatttactgatgggttggatgtagatgtagtgtgagagagaaaagaggattgggtcaaaaatgacttccaagacttagaacctctcagccaaaaggatggagttatgatttactgaagtgagcaataccataggaaaagattgagaggagaaagcaaagcagtagttcagtgttggtcattacatttgaaataaatgcctattacatagccagttggcaacccttaggaggcagttggagtgcaagtctggaattcaagagacaatttcaggatagagctaaaaatgtgggatttgacagcatatagggggtatttaaagaattgcttgcactttttgtttttaaaatgtagatttagctagtgcttatttatccatggtattttctgcttttagtcaattaaggcaggaatttttcctttttgctacataaaccaaattgtgatggcttagagtaattgcaaatattataatcaccaagttaagtgtaattaataatcattcttcattatatatgatttttcattataatgaatttggcttagaaacaggctttctagacacataaaaagagaagtctctggatttgagccatctctgtttttataagctactctgtacttttctgtcatagcagactactgacttgatcagttcctaacctggaatatagtttattgaattatttaaataatttaatttttatagaagttttattgaaaaataatttacatactataagattcactgattttttactaaatttacagaattgtgcaaccacaaaccaattttagaacattttcatcattttatgaagatcccttgtacccatttgcagccacgctgcaaattcctacccctagccccaggcaaccactaatctactttttttttttttttagcattctattttttgttattgggaaaagaagaaattctattaaataaatatatttacaaatcaaaatgatctttaatcaatttgtaactagtttccacaattgcatttgtatacagtttctttagagaagaaaaatattgactaaaaaatgtccaggtgttctttttttattattattattatacgttaagttctgggatacatgtgcagaacatgcaggtttgttacataggtatacatgtgccatggtggtttgctgcacccatcaacctgtcatctacattaggtatttctcctaatactatcccttccccagtcccccaacaggccccagtgtgtgatgttcccctcctggtgtccatgtgttcttattgttcagctcccacttatgagtgagaacatgcagtgtttggttttctgttcctgtgttagtttgctgagaatgatagtttccagcttcatccatgttcctgcaaaggacatgaactcattcttttttatggctgcatagtattctatggtgtatatgtgccacattttctttatccagaaagaaatatacccattgatgggcatttgtgttggttccaagtctttggtattgtgaacagtgctgcaataaacatatgtgtgcatgtgtctttatagtagaatgagttataatcctttgggtatatacccagtaatgggattcctgggtcaaatggtatctctggtcctagatccttgaggaattgccacacggtcttccacaatggttgaactaatttacagtcccactaacagtgtaaaagcgttcatatttctccacatcatgtctagcatctgttgtttcctgactttttaatgatcgctattctaactggcatgagatggtatctcattgtggttttgatttgcatttctctaatgaccagtgatgattagctttttttcatgtttgttggccacatcagtgtcttcttttgaaaagtgtctgttcatatccttcgcccactttttgatagggttggttttttcttgtaaatttaagttccttgtggattctggatattagccctttgtcagatggatagattgcaaaatttttctcccattttgtgggttgtttgtccactctgatgacggtttcttttgctgtgcagaagctctttagtttaattagatcccatttgtcaattttggcttttgttgccattgcttttggtgttttagtcatgaagtctgtgcacatgcctatgtcctgaatggtattgcctaggttttcttctagggtttttatggttttaggtcttacatttaagtctttaatccatcttgagttaatttttgtataaggtgtaaggaaggggtccagtttcagttttctgcatatggctagccagttttcccaacactgtttgttaaatagggactcctttccccattgcttatttttctcagatttgtcaaagatcagatggttgtagatgtgtggcgttacttctgagacctctgttctattccattggtctatatatgtgttttggtaccagtatcatgctgttttggttactgtagccttgcagtatagtttgaagtcaggtagtgtgatgcctccagctttgttcttttggcttaggattgtcttggatatacgggccctttttttggttccatatgaaatttaaaatagtttttttctaattctgtgaagaaagtcaatggtagtttgatggggatagcactgagtctataaattactttggacagtgtggccattttcacaatattgattcttcctatccatgagcatgtaatggttttccatttgtttgtgtcctctcttatttccttgagcagtggtttgtagttctctttgaagaggtccttcacatcccttttaagttctattcttaggtattttattctctttgtagcaattgtgaatgggagttcactcatgatttggctgtctgtctgttgttggtgtatagaaatgcttgtgattttttgcacattgattttgtatcctgagactttgctgaagttacttatcagcttaaggagattttgggctgagatgatgggggtttctgaatatacaatcatgtcatctgcaaacagagacaatttgactttctctcttcctatgtgaataccctgcatttctttctcttgcctgattgccctggcctaaacttccgttactgtgttgaataggagtgatgagagagggcatccttgtcttgggccggttttcaaagggaatgcttccagcttttgtccattcagtatgatattggctgtgggtttgtcataaatagctcttattattttgagatacattctatcaacacctagtttattgagggtttttagcatgaagcgctgttgaattttgtcnaaggccttttctgcatctgttgaggtaatcctgtggtttttgtcattggttctgtttatgtgatgaattatgtttattgatttgcatatgttgaagcagccttgcatcccagggatgaagccaacttgatcgtggtggataagctttttgatgtgctgctggattcgatttgctggtattttattgaggattttcacatcaatgttagtcaggaatattggcctgaaatttttttttcttgtgtctctgccagggtttggtatcaggatgatgcaaaatgagttagagaggagtccctctttgtctgttgtttggaatagcttcaaaaggaatggtaccagctcctctttgtacctatagaggaattagactgtgaatccatctggttttgggcttttttgggttggtaggctattaattactgcctcaatttcagaacttgttatgggtctattcagggattcgacttcttgtttagtctcaggaggatgtatgtgtccaggaatttatccatttcttctagattttctaatttatttgcatagaggtgtttatagtattctctggtggtagtttgtatttctgtgggatcagtggtgatatcccctttgtcgttttttattgtgcctttttgattctctattttcttctttattagtctggctagtggtctatctattttgttcatcttttcaaaaaaacagctcctggatttattgattttttgaagggtttttcacatctgtatctccttcatttctgctctgatcttagttatttcttgtcttctgctagcttttgagttagtttgctctcgctcctctagttctttaaattgtgatgttagggtgtcgattttagatctttcccactttctcctgtgggcatttagtgctgtaaatatccctctaaacactgctttagctgtgtcccagagattctggtacattgtgtctttgttctcattggtttcaaagaacttatttatttctaccttaattttgttatttacccagtagttattcaggagcaggttgttcagtttccatgtagttgtgtggctttgagtgagtttcttaatcctgagttctaatttgattgcactgtggtctgagagactgtttgttatgatttccgttcttttgcaattgctgaggagtgttttacttccaattatgtggtcaattttggaataaatgtgatatgctgctgagaagaatgtatattctgttgatttgggatggagagttctgtagatgtctagtaggtctgcttggtccagaactgagttcaagtcctgaatatccttgttaattttctgtcttgttgatctctttaatattgacagtggggtgataaagtctcccactgttattgtgtggcagtctaagtctctttgtaggtctcaagaacttggtttatgaacctgggtgctcctgtattgggtgcatatgtatttaggatagttagctcttcttgttgcattgatccctttaccattatgtaatgcccttctttgtcttttttttatctttgttggtttaaagtctgtttttttcagagactaggattgcaacccctgcgttttttgttcccttgctggtgaggagttgtgatcctttggaggagaagaggcgttctggtttttggaattttcaacctttttgcactgttttttcctcatcttcgtggatttatctacttttggtctttgctgttggtgatctttggatggggtctctgtgtggatgtcctttttgttgatgttgatgctattcctttctgtttgttagttttccttctaacagtcaggcttctctgctgcaggtctgccgtagtttgctggaggtccactccagaccctgtttgcctaggtatcaccagcggaggctgcagaacagcaaagattgctgcctgtttttccttcaggaagcttcgtcccagaggggcacccgccatatgccagccggagctctcctgtatgaggtgtctgtcaacccctgctgggaggcatgggggtcagggacccacctgaggaggcagtctgtcccttagcagagctcaagcactggctgggagatccgctgctctcttcagagctggcaggcaggaacatttaagtctgctgaagctgtgcccacagccaccccttctcccaggtgctctgtcccagggagttttatctataagcccctgagggaggctgctgcctttctttcagagatgccctgcccagagaggaggaatctagagaggcagtctggctacagtggccttgtggcgctgtggtgggctccgcccagtctgaacttcctggcggctttgtttacactgtgagggaaaaaccacctactcaagcctcaataaggtggatgcccctccccccaccaagctctagagtcccaggtcaacttcagactgctgtgctggcagggagaatttcacgccagtggatcttagctagctgggttctatggggtggaatatgctgagctagaccattcgcctccctggcttcagacccctttccaggggagtgaatggttctgcctcactggcattccagttgccactggggtatggaaaaaaactcctatagctagctcagtgtctgcccaaacagccacccagttttgtgcttgaaacccagggccttggtggtgtaggcacctgagggaatctcctggtccgtgggttgcaaagaccatgggtaaagcatagtatctgggccagagtgcacaccgttcctcacaggatagtccctcatggcttcccttggctaggggaaggagttcccctaccccttgcgcttcctgggtgaggcaacaccacaccctgcttcagctcaccctcygtgggctgcacatatacagtatttcatcctgtatatgtaccacattttctttatccaattcaccattaatggacacccaggttggttccatatctttgctattgtggatagtgctgtgttggatatgagggcatgtgtctttttggtagaatgattttttggggggggtttatacatggtaatgggattgctgggttgaatggtaggtctatttttagttatttgagaagtcttcaaactttcctcagtggctcagtcttcagctttcctcagtggctgaactcacattcccaagaacagtgtgtaattcctttttccccgcaaccttgccacatctactattttttgacttcttagtaatagccattctggctggtatgaaatagtatctcattgtgattttatttgcatttctctgatgattagtgatgttgagtacttttttatttgttggctgcttttatgtcttcttttgataagtgtctatgtccttttctcactttttaatggggttatttgtttttcttcttgctttttyttttttttttaagttcctcatagattcttgtattagggttctctagagggacagaactaatgaaatatatatataaaggggagtttattaagtattaactcacatgatcacaaggtcccacaataggccgtctgcaggctgaggagcaaggagagccagtctgagttccacaactgaagaatttggagtccgatgtttgagggcaggaagcatccagcacaggaggaagatgtaggctgtgagagtaggccagcctcaacccttcacgtttttctgcctgctttatgttcgctcgmagctgattagatggtgcccacccagattaagggtgggtctgccttccccaacccactgactcaaatgttaatcttctttgtcagcaccctcacagatatacccagtaccaatactttgcatccttcaatccaatcaagttgacattcagtattagccatcacaattcttgatattagttttttgtcagatgcatagtttacaaatatattctcccattctgttggttgtctgtttactctgttgatagtttcttttgcattgcacaagctttttaatttaattaggtctcacttgtcaatttttgtttttgttgcaattgcttttgaggacttggtcacaaattctttgccaaggccaatgtccagcagagtatatcctaggttttcttatagaatttttatagttttaggtcttacatttaaatctttaatccatcttgtagccttgtagtgtagtttgaagtcgggtaatgtgatgcctccagttttgttctttttgcttaggactgctcttttttggttccatataaattttagaatagtattttcaatttctgtgaaaaatgatgtgagtagtttgataggaatagtgctaaatctctagattgctttgggcagtatggacattttaatgatattgactcttccaatccacgaacatggaatgtttttccgtttgtgtgtgtcagctctgatttctttcagcagtattttgtaattcttttagatatccttcacctccttagatattttcctaggtattttattttgtgtgtgtgtaactattgtaaatgagattgtgttcttgatttggctctcagcttgaatatcattggtgtatagaaatgctactgattttngcacattgattttgtgtcctaaaactttactggaatcgtttattagttcargaagccttttggcagcatctttagggttttctaattatagaatcatatcatcaggaaagagataatttgactactacttttccaatttggatgtgttttatttctttctcttncctaattactctggctaggactccagtagtatgttgaataagagtggtgatagtgggcatccttaygctgttccagttcaaaagaggaatgcttccagcttttgctcattcagtatgatgttggctgtggacttgtaatagatggctcttattattttgaggtatgttcttttgatgcctaatttgttgagggtttttttttttaatcatgaaggattgctagattttattgaagctttttgctacatctgttgagatgatcataaggtttttgtttttaattctgtttatatggtgaatcgcatttattgatttgcatatgttgaaccagcctttcattccaggaatgaagcctacttgactgtggtttattaactttttgatgtgctgttggattcagtttgctactatttgttgagcatttttgtgtctatgttaatcagggatattggcctatagctttcgtttttggtgtgtctttaccagattttggtgttagaattatgctggtttcatagattgggtttcatagaatgagttagggaagagtccttcctcaagtttttggaatagtttcagtaggattaataccaactattggtatgtctggtagaatttggctgtgaatctctctggtccagggctttttatggttggtaggttttttttattactggttcgattttggaactcagtatttctcttcagggtttcaatttcttctgaattcaatattgggaaattgtatgtttccagaaatttatctatttcctctagatttcctagtttctatgcataaaagtcttcttaatagtctctaaggatcttttctatttctgtggggtctgttgtaatgttgcctttgtcatatctggttgtacttatttggatcttctcttttatctttgttaatcttgctaacagtctgttgatctgtttatcctttcaaaaaaccaactttttgtttcattgaacatttatatggattttggaatctcaatttcaattatttctgcttttagataattattttctactactagctttgggattagttcttgttattctacttcctctagttgcaatgttagattaatttgagatctttctgtcttcttgatgtaggtatttagcactgtaaacttgcctcttaacactgcttttgctgcatcccagaaattttggtatgttgtgtttctgtttttatttatttcaaagagtttttttgtttttttttaatttcaccttctgttgtttacccaaaagtcattcaggagcaagttggtttaatttccatgtaaaattatgtggttttgaggagtactcttggtattgatttctacctttttttccacygtggtccaaaaatatgtttggygtggtttcaatttttttacatttattgaaacttgctttgtcttcgagcatgtggttgatcttagagtatgttccacatgcagatgagaagaatgtttattctgtggttgttgggtggagtattcttctgtagatgtctattaggtccagttggtcaggtgtcaaatttaaatccagaatttctttgttagttttctgctttgagggtctatctaacactgccagtgggatgttgaagtcccccattattaatgtgtggctgtctaaatcttttcataggtctagaagtacttgtatgaatctgggtgctccagtgttgggtgcaaatatacctaggataggtaagtcttgtggaattgaatccttcgtcattatgtaatgcccatctttgtccttattgctgttggtttaaagtctgttttatctgatacaagaatagcaacccctgctcttctatttactgtttgcatgataggtctttcttcatcactttacttcaggcctataggtgtcattacatgtgtgatgggcctcttgaagatagtagaaggttgggtcttgttttttgtttttttttaaataaaatattattttattttttaaataaaaaaawtaaaaagtggttcttgccactctgtgccttttaactgggtacatttagaccacttacattcaaggttaatattgatatgtgaggtttgatcctgtcatggtggtgtttgctgtttgctttgtagtcttgattgcgtatttgctttataggatctgtgaacctctgtatttatgtgttcttttatggtagtgagtatcattcttatgtatgcatgtttagaacttccttgagcatttcctataggctaggtgatgtagtttgggtatttgtccccacccaaatgtcacattgaaatgtaacccctagtgttggagttggcgcctgatgggaggtgattggatcatgtctgtgaatttctcatgaatggcttagcgccacccccttgatgctgtccttgtgatagtgagtgggttcttgcaagatctggttgtttaaaagtgtatgcccccacagccttcccctctcgttcttgccatatgaaatgcacattccctcttcgccttccaccacgagcaaaagcttcctgtggtctcccctgaagcagatgctggcattgtgcttcctgtacagcctgcagaatcatgagccaattaaacttcttaccttataaattacccagtcttgggtatttctaatagcaatgcaagaacagtctaacacactaggtctagatataacaaattcctttagcgtttgcttgtcaggaaagactttatttcttctttgtttgtgaagcttagtatttggtgattacatagtcataaataacatggttaagcatttgtaaccttcatatctctgtgaataactgctaagagttgctttcttatgcccttaggcttggccagtttgtcatatcttgttggcattctttttttttttttttttttttggkaactacacaaatctcactatattgtttgtattatttaaatagttaatccatttagaatttctataaattaaatgtgttagttaatatctagaggcacatgtgaaataaataatttttaaaatgtgttagtaactctttatataggaaaataaatggatttttatttacatatcataacattttaacaagaaaaatgttccatttattactctaacaagaccaaaaaaccaattttctattttgttccatattttgaaagatttgttttcccttttagatgcagaccaacaacgaagagagaaactcaaaaaggaattagcacratgtgaaaaagagttcaaattaactaaaactgcaatgcgagccaattataaaaataattccaagtcacttttkaataccttacaaaaggtaagatagtatttttattttttaaaagcaaatgtttctaaggtacttctttagtggtacaatctgactttgtttactatagtttagggtcagcaaatttttcctgtaaagatccagatagttaatattttaaaaggctgttcaggcctctgtcacaactactctgccattggaaggcrgacatagacagtacataaataaatgagtatagccgtgttctgctgaaactttattaactgaagacattgggtcagatttggcctgaaggttatagtttgcagaccccagttataggttttttgtgataccttcgaacatctggttaaataagttctattcctagtttgtgaagtttttttttccctttctcctgaatggatattaattttatgaaatgcttttttgcatctcttggaatgatgatattatgatataatttttctcttttaatctgtggggttttttttttttatatatatatatatagtctcactctgttgcccaggctggagtgcagtggcatgatcttggctcactacaacctccacttcctgggttgaaacaattctcctccctcagcctccccagtagctaggatcacaggcacccaccacgactccagctaatttttgtgttttcagtagagatggggtctcgccatgttggccaggttggtctcaaactcctgacctcaagtgatctgcccacctcggcctcccaaaaagtgctaggattacargcatgagccactatgctgagcctcttttaatctgttaatgtaatgaattacaaacaattgactttaatgttaaaccaactttgcattcctgttgtaaacagaacttagtcatggtacattaccttttttattcattgctagatttacttactaatatttgtttagaattttggcatctgtccattattgatactggcctgtcattttctttttttgtactccttgtgtctggttatgctatcctcataaaataaactgggcactatttcttctttctgtactctagcttgtgtacatttggtttatttgttccttaaatttggtggaactcaacattaaaattgtctaggcctaaagtattttttatgagaagattttgactactgattcaattttttaagtcattatagaatgatttcaatgttagatttatgtaggaagttgttcattttatgtaaatttttggcagagaattgttcatactattctcttaatctcttctgaatatgtattatttccccttgttattcctaaggtagtttatttgtgccttcattcttcttcttcatcattctcatcagagattgagtcagtttttttaaaggacacactttttattgtgttagtcttctctattgtattttgttttctgttttgttaatatctgtgtttatctttatttccctctctctgggtttattttgctgtactatctctaattttatttaatttattaattctctgccttacttctttgctagtgtaagcatttttaatgctataaattttccaccaagtacagctttagctgcatcccacaagttttgataggtggtatttttattatgtttcaattcgaagtattttacaattttctttttgtttgtttgtttttgttttgttttttgagataatgtcttgctctgttgcccaggctggcatgcagtagtgtgatctcggctcactgcaacctccgcctcctgggttgaagcaattctcgtgcctcagcctcccaagtagctgggactacaggtgcctgccaccatgcccagctaatttttgtgtttttagtagagtctagtttcaccatgttggccaggttggtctctaactcctgacctcaagtgatctgcttgcctcagcctcccaaagtgctgggattacaggcgtgagccaccatgcccggcctacaattttcattatgatttttttatttaacccagaaatcatttagaactatttcttaatctctgtatctgctttttccttagtatctgtttgttacagatttctagcctaattgtactgtgattaggaaacatctatattatatccatttcttgaaatttattgagcacttgttttatgtcccagtaggtggacaattttttaaaaatgtcctgtcattatatgtttgaaaataaaatatattctatagtttttgcatgtagtatttgatatatagtatattcattaaactttgtattttccagatattcaaatcttttatatcatattgattatttttgtctggttaatctatcagttattgagagaaatcttccacatacttacatatttagctatttctccttgtggtactattaatttttgatttacatattttgaatgcatgttattacattagagatattagagatacagaatacagatttagaaaatcctgaaggaggtagtttcttggtgaactgaacctgttatcactgtgctttgaatttctttaccttaatgctttttctattaatattttctgatagtgatataattaaattagctttattttgactagtatttacttggtatatcattttccattttttgatcttaatgttttcttctttttttttttttaatgtcacttgccaatctcaatgttttaggttagtatttggtgggtcagattattcaatctgataatcattgtctttttttttttttgagacagagtctcgcttttttacccaggccagactgcagtggcgctatcttggctcactgcaagctctgcctcccgggttcacgccattctcctgcctcagcctccgagtagctgggactacaggcacccgccaccacgcctggctaattttttgtatttttagtagagacggggttccaccatgttagccaggatggtctcgatctcctgacctcgtgatctgcctgcctcggcctcccaaagtgctgkgataatcattgtctttttaatggggcatttaatatgtttttatttctggcttcttatttcataccttctatttgactcaatgtggtagacaaaatttgaagacaacacccccacagtgacccacacccttaagcaatcccctcctcttcagtgcaggtaggacctgtaacttgcttctacccagtagaatatgggaaagatgataggatgtcacttctgtgattctgttatgtggcaaaagtgaagggatattttcccctgcagattaaggtttttgttccttaaaagagaatggaaaaataagtctgggaagattttccacagtgactgctgtttctctccccaagccacaccaagagaaggtgggaaagggattctctctactcttccctataagcttcgagtaggtttcctggaggaaaagcctgcaagaggtacaaactccccaagtcctcaggtccggtacagacctgagcacatcactagtccacactcagtctttaggaaattaacaaatatttataacataatcttatcaatttatgtggcattccatggcatctttcccaagtaagcaagtgctgggatacttatctctctccatatttcaggttagttgtttgctctgtgacctcagttctctcattagttcaagaaaaatcattaatgtgcagatcgttcagcttttttcttcttgtaatggtgagagctgtgttctttccatctctatctctcagctgaaacagtaagtttgttttatttttatgtgtggtttcattttttgaacttttaaattttgaaaaccttagcatttacaaaaatatagtataataagcccacatgttcctatcacctaggttgtagcaatgatcagctcagagccagtgttatttcacctatatgcccactcactctcctaggttgttttgatgcaaaccccagacaccatataattttatccataaatatttgagtatatatctaaaagatagacttttaaaaccacaacaatactattatgccttaaaaattaataacaggctgggtgtggtggcccacacctgtaatcccagcactttgggaggccaaggtgggtggatcaccaggtcaggagatcaagaccatcctggccaacatggtgaaacctcgtctctactaaaatacaaaaaaaaattagccaggagtggtggtgcgcacttgtagtcccagctactcgggaggctgaggcaggggaatcgaacccaggaggtgggaggtctcaatgagctgagttaacgccactgcactccagcctggtgacagagcgaaactccgtctcaaaaaaaaaaataattaattaataacagttctttaataataaatatctgatgtttagatttccccactgtctcctttttgagtttgttagagttggtattagaaggccagcagtctccttcaactcagtgccagggttcaggatggggaagtttccttgcaagtcatctagttgaggagtagccattgagagaatcccagattctcaagcatgatctcttaagagctttgttttctgcccctagcacccatgatgtggtttaaaaaaaactatggactgctgggcaaaagccagattgactgctctgcttaccaaataccaaggctgtaataatgagtctggatttttttccttgagaaatgctgggagccatagaccagtttttagttgggaagttatgtcatcatactgacactacacagactacactgacaacagtggaggacagttacgagacagttgcagtaatctgggaagcagtaattaagacatgattctatgacagcagagagagcataaggaatacatttaagaaataattagaaagtagaatctcggccgggcgtggtggctcatggctgtaatcccagcactttgggaggctgaggcgggcggatcacaaggtcaggagttcgagaccagcctggccaatatggtgaaaccctgtctctgctaaaaatacaaaaattagctgggcatggtggcatgcacctgtactcctagctactcaggaggctgaggcagaagaatcgcttgagtccaggaggcggggttgcagtgagccaagattgtgccactgcactccagcctgggcgacagagcgagactccatctcaaaaaaaaaaaaaaaaagtagaatctgcaggacttggtgactgagtggatgatgtgaagagtaagaagcaggagttaaaatcctaagtttctgccttgggcaactgggagaatagtaatatatcattcacagaaatataataggatgaggtgcaggttttctttggggctggaggtaataagagataggagtttattgtttggctgtgtttgatttgagatgcttttggaacatctagtatatttagtagacacttggatataagcatctgtgtcagcaaagaggtctgggctgaaaatagacttgggagtcatcaggggaagcagtgaatatgattgagagccccagggctattatgtagataaaaagaccagcaatagagctgcttcctttagaataaatctgttatctgctctgtattatactttgctatctgggattctgttcctcaatatttgaatcacaggtgtattttcatttttagtgattgtactttttaacagaaaatttaaaatttgtttctattattcagcatgagtataaattactaattaaattttgagataagaatggggtttcttgaaaatacaaatcatatattttaatatatctttttaatgtattttatatatctatttatatataataaagtaaaaatatatattatttacatattatatatttttaatatatttctgtaaatgttagatgttttcatttttccaatagcaactataaccctatataactttttgcctccataaagttgttaatttattattttatctgtatttttattgactccatttaggattcatagtaacttgcactttgcctacatttttgataagccctgataataaatattttagatacactcagattgtcttaagagccttattttgggtagtatattttgataattgaatgggtgttatggttaacagacacctgttatggttataatttgtattcactgtaaaggctgctatagttaaaatgctggctttaacctctgaatgtattagccctttatatacattataaaggtcatatatcaaaaaccttttatgataattgcccaattctcttgccacttttcttctcccatactctgactcacatgctgtcaccctcagaaccctcctaagcccttccagtcttcaccctgtaactcttgagtcattcactacttagtcaatgctcccatactactcgtttgcttcactggtgtagcacttactgygtgcttttaagattaagtgaatatgtgggtgtgagctttatttctgaataaatctagaaaagaggcgggagcagtggctcacacctgtgatcccaacactttgagagactgaggcagacagatcacttgagcccaggagtttgagaccagcctggacaacatggcaaaaccccatctctacaaaaaaaaaaaaaaaaatacaagaaaaaaaaaaaagccaggcatgatggtgtgtatctgttgtcccagctactcaggaggctgaggcaggcagattaattgagcccaggaggtcgtggctgcagtgagccatgatcaggccactgcactccagcctgggtaacaaagtaagattaaaaaaaaaaaatctgggaaactttttaaaaacagtacaaaatagtgaaaatcaagagctatatttgttttataaaatataatttgaaacttttttgcaaacagatgttagattttaaaataatttatacccatccaattctacaattgaattgactcttcaagtgtttaaaaatccgacaattggaaaattattgtaggttatgtcttctgacatccttaaaaaagattgatttagtactgagttctgtattgtaaaattcttgacatgaaagtatgatgagtatataaactatgttatggttattactttacataaatcttgaaatcacagaaacagtgcacaacaaacctcgtaaactaagaataacctaagaaagtgagtgttcagggtaccaccagactctttgctccattggcacataattgatgaacccttttctgatttcagaactttacagtgatctgctgttcatgttttgggattctaccagtgtgttacatatattctgcacaaatatctttatccaagtttcatgatattcatagctaaaggaaacaagatgcagattggtacagtggattttatactgtagtctactggtttccaaggaaagaaaaaataggatacaaggtagaaattataagatacaaaaatgggaaaagtttcatgctttctataagttcagaagcaatttttccatcccatttcagagagatagcttaacatatacttctaccttttaaaaagactttcttcagtgtttcattttgtttattaaataaccattaccgataacatttctttacaggcaatcataatggcttatgcatttctttctccttcctctgatctcagtttgtgctgttcttctaagtgtaaataattcctgtgcttattaattaattgccctataggatatttttagactgtacttagaaatttcttctttgagagctaaactcttctggtacataagctgtagtgtgagtatcatttaggactacttataaaaactaacatcttgaagtcatttaccaaatagtaccctagtgactcaaaatttaatgccagcatacttacttgctttgagtaatgttgtcttgtatttggaataaggttataaaacagttggaaaggaaaggtgatttgacatattttagatagtagtcacaatgtccagttatctgcaatttttttgctttgataaatcagcactttaggttagctgacttatttgttcccagaaaaagagttaaaatcagtttaaaattttttatgctgtaaaaaaaatctaaaatcatataattttcaaataagtttttaagtagacaatatgataaagtggcaaagaacatgggctctgcctctgttcaaatctgtgagacactgcacctcagagcagtgtttttatctacaaaatagggtaataattgtactacctctcagaagttgatgttaggattaaatgagctatacatgaaaatgagtacagtaccttgcacatagtaagcacaccatacatattagtagcagtgatagaagttcttattattcctcttctattcaatgtcaagagcagtacctttcatacaggaagcctttttccttactcaacttgtccatcttccccttgttattcctcccaatgaggtaataagacagatataattggctaaatcctagcgatttttaacctcaatttctgtaacctccatgtaatttcccctctacctaatgaaagtgcctcagagttttgcaaaggatatacagatgtgtccgtaagggctgaagtcataggcaaagcttcttagacattttcagtttataaaacaataaaatactatctgtgtttttagactttacaaataacctgtagaaatggttttcctaaagtaaagccaaaaagaaatggagcaagtcaaaatgcctcccttttcaaagtattacccccaccccaatgaaaagaagttgagaaatatatatgaaattattatggaataaatatttattaattatatttaaattatcaattacctaaatcagggctccatacattatgaggagaagttccttttcgtttctttaaaggcttaacatcacaaagggatggcttacactgcactctccaataatgacaagacaggacagtgaggatgatgtcactaatagtggttgagaagggcattggtgctcacaatttgtgtggaagctttcagataaaactgacatctcccaataaatcttaatatgcaagttgaagatcccaaatatagatatgttattcatctttttttcgtttcagaaaggaaattgattgctctattacttatatttggaattaaatgttaatatcttagtttaaatacttgactagaacttcarataaaatattaacatcttcaggaacatatcagttaattttgtaaacccttgaggctatcatttttttaatgtataatctcaaaatccccaattacatgaattcgtaatgcagttgatgactgtcatatcgaatgttcttagccctcaggcgaaccgcaaattgaggatgacatgttaaaagaagaaatgaatggattttcatcctttgcaaggtcactagtaccctcttcagagagactacacctaagtctacataaatccartaaagtcatcacaaatggtcctgagaagaactccagttcctccccgtccagygtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacrgatagaagctgaaacccagactgaattaaggtatgacacatcagcaaccaacagtaaatccttcaggaaattaaatgaaaattaatgaattaatattccttgttttctgctgccagccttaagatctgatagtgcccttttgattggaatgagatgaatgtgacttttccttttccatgtatcactagaactatcagagtaattgctgaaaaatagctattaaactggtcaagcaccttatgcgtatgaattacatattttattatttcaagcgtggttcaagaattgtgtatgtttttaaatattatactttcagagaattcttaaaataggtcatcagacagcatttgtggaaatatgcatattgattcatgttaaaagtggcgaaacaatgggctatagaggggaagaaactaaccctttatccatctaaccctctgctccatttcctgcagatattccggccagtcttcatagcaacaactgccaagaataattttaaattgggataatttctagaaattaagtataatttgcctcaataatgttttcaaatacagtagtgcctggcacaagatgaatgttcaataaaagtttgccagatgactaaagaaaaaaacaaatcttgtcaagttttgagatttagcagatttgtgattgtgattgtttttctagtattacataaacaatttatctggcagtaggttttagttgttttagaaagtaaaaacaatttaagattagtatttttttctttgaatatagrtaagtacagtgatatcagatgagtctgcagatatttaatcaaataaaatcaaataattcaaaattatgtattttataagaatagatggrtctcattctttttgagtttattttttctagccagtaaaccttgttaccacagtgcttatattttgaaggattaacaattatttattttaaattattacagctttaaatctgagttggggacagctgagactaaaaacatgacagattcagaaatgaacataaagcaggtaataagtatgaaatcttttggtattgctacatttgaattacagatgtttttcagtaaatagaatatgtacagctatttagactgtgaagaataatctgttggtggcacttatcatacatgatatagccagtatacagaaggtctgcctatttacaaatggttatagckctctctgaatggccaggtggatcctgccaaatctgggaagtcatttgttactaacatctttcctagatgattggttggctggctggacaaatggaaggatcagtaaaataccttaagtattgttttcaaagatgcagacctggattactagaggagccagcagagtagtgcagaagttgagtttttataccttttttttttttgtaaagaattgccacatattatataattggaaattatacattttataagaataagtagctgttattctcttatgtttgcctctgctttttctagaccatgaagctgtttattacagggtttatattttgaattcttagcatcatttcttttaaaatattgcaactttgagtctgattttgagataaattgttttatttttggagtttcagtcttgcacttgtgtcctgacttaaatttgttgcttataaaaatggtttgtctattaaaatgtcaaacacagatccagagatagaagaataaaatataatcatactcaacttcccccttcccttctgaaaatgggtagaaggtggtagttttccatctcagctattaatcgctgtttgacatagggccctgccacttaaggcccaaggacaaatcacttatcctctgagagctgaatttcctcatctagaaaaactgtacttaacttgcaggattattaggaggagtaaatgatgtaggcaaagtgcctagcctggtaagggcttaataaatgatagctattactagcttgaaatttttggaaagagttagctttgcagataactacgtaaacatgaaaaaatatttatttacaatcctgcaagaaaatgtgtgtccccatattccatagatagtgccatcagtacttgacttgaagaagccagtagagtattaactgcagtagatccatattttaacagcacctttaaaactgtaaagcactatacataaattgtcattgtaaagattgaatctaatgatgtgagtaaatgcttggcacagtttgtggtgtgtagtaaggagtctataaaagtaagctgccattatttttgtttgttaatattattgttcatgctgccagcgctaccactgcttctacatatttgacatgttggcatttaaaacagatgagctatttgaatttctgaataatgagattttgttccctcaaacttacttaaaagttgaaaatttgcttcatttttccctttatatgtttatttgtggcaatttcttaatgtcatttaaatgccactcattaaaatacaagaaataagtcattttatctttaagtttaagaaaaaagtgctggatggatagaaaaattattctaaaatattctttgtcgtactgtataatttttatctactggatatctctgttcaatcacttaaaatttgctgtgttatattctgctttcgtaatgtatttttaagcaaaaataaamattttttttattgcatccccaggcatctaattgtgtgacatatgatgccaaagaaaaaatagctcctttacctttagaagggcatgactcaacatgggatgagattaaggatgatgctcttcagcattcctcaccaaggtaaacagttcacaggagaaataatttcaactgtctttaattgccttcttgtataacagacatatagtatttgccgcataagtactatttaattgcatgctccaatctattttggtgttatgtaattcaataacagttttagttttaccaaggaaattttacaaattgaagtgcttagtaaaagttgaaatgaattaattttgctaattcattagtaaaggaaaaaaccacaccaacttgtattatttattatcactgttcattaaaaaaatgattttccccaagacaagtcctctggcagtgatgctaaccagtttacatgccacaaatagtactgaagagctttaccatttgaggagtcataatttgtgattttgaatattcatcatatcctagtgcttgaccaatctgtgctatatgaagacactatttatttatttatttatttatttatttatttatttatttatgagacagtctctctctgttgtccaggctggagtgcagtggtgcggtctcagctcactgcaatggaggcactctttaaaaactactcatcatgttgagtaattaaggaatattatacattaattagcaggtagtagaaaacctaaaagatgcctcgatagtttcagttgtcaaatgtatttccagtgtcagagagtggatatgaaatgccggtggaaggggtagaagaaaggaaggagtagagattaaaaagagggcaagaataaggtgttagtagcagaccactagggaagtacacacaatcccctcaggctctggcttctccctcargcctttgctagggagatctcacctgctaaggccatggagagttcattgttaactaccctgtctttgaaatttctgatgtttcaacacatataacttattatttattaatataactgctcttgagccagtcttcattgaatattaagaatgacttaaggaaaggaatatttatcttttctaatactttctaaaagaagtaaagtagaatagtatagttgagtatacctgaataaaatttagcttcaaattaattattggtaacataactgaataataacaaaatttatcatgatgaccacctttaaaaatattttcataataatgtatctatatccagcattatctatacattaaccttagtcaaattgtcattgtttatactagagaagtgccgtagtgtagttttaaaaagaattgtgaatttatacctagaaaagtagtttaaaaacctgtctttgctgcttactaacattaaccttggaaagttacttagcctttctgacccttggtgaactaatcagtaaatgggaaaaataatacacagcccacatgcctgactgggttgtttagaagattaaattagatatgggtatgagagtgctttaaaaattgctgaaacatgtaattacaggttgagcatcccaaatttgaaaatctgtaattcaccatactccaaaatccgacatgatgcccaaaggaaatgctcattggaacatttttggatttcagatttttggattgagatgctcaactactaagtatataatggaaatattccaaaatccaaattctgaaacacttctggttccaaacatctaagataagggctattcagtgtgtactaatatacaatgttattgagtacttattgtatgccaaccactgttttgctcaactactttaacttcctctttctagggcaatgtgtcagtattccctgaagcccccttcaactcgtaaaatctactctgagtaagatcttttttaagtcttcgttttgcatagtggaatcaaggattaagaatcaaagaaaccatattaaataagtcaggattgaacaataatctctttttttaaaactggcaagtaataaatgtacatattcatggagtacctagtgatattttgatacatatactgtacagtgattagaacagtttaattagcatatccatcatctcgaacattttatcatttctttgtgttggaaacattgagtatccttcttctagctatttgaaactatgtattattgttaaccatggtagtcatcctatagtggtatagaacactagaacttactcctcctatctagctataattttgtatcttgtaacaaatctcagcttgtccctcattcccgtctacccttcccagcctccagtaccttctgttctactttctacttctatgaaatcaactgtttttagcttccacatatgagtgagaacatgcgatgtttaactttctgttgctggcttatttcaccagcatccatccatgttccatccatgttgccacaaatgacatgattttatttgtttttatggctgaatagtatttcatggtgtatatatacattttctttatccattcatctgtgaacactaatctctcttacaaccagctttgggatatcaatcgtataatacatactaaatttgagaaactgacctgaataattttctcgaatttttttgagaaataataacaactttctggaataattatcaatcacgtcatttttatctccagtagaaatttgtccccaggtattacctgatactttttaataatcagtatccatgattcttacttattttttaagtaaaaataataaaataataaagaagagttttagagaaatgcagacttttaatagttcaggatactctttccagaggtttctaacctcagcagttctttgcagatattttatttgtagattttaatgttgttttaattaagttactctttttagggaaaataatttataaaattttatttattttcaaatatgctgtttttaaataagcaagaccctgtgaatcagtttgaaagtgtaactttttattaaacatttaaatctattatttgatttgcttattaactcttcccttatatttgcttattcagtaatttagttacttgctacttacatttggtattaattcactaatttcagctaattaaaatcaaacgtacaataatatcctaattttcttgtaatagctactaaaatatagttataatagagaagtgtgttcaagtagttaaaaattaccacaagatttatgttcacaaattttcctatgagaatttttcgtctccaaacgttttgagagaaaaaataaatttttctgcttagtaaatttctcaaccttaaaacaagatgctggcctagggctaggagaggacttcttagttgwagctcctgcttctctggacaactttcctcttccttcttgcaaatgctttgcagagggacttgcacctctgctgctggacctggtcaggagcaagaggaaatttaaaacattcctcgggagtgcttgctcccagtggattgcatttgattgcgccttgtccttcgttgctttctttttgtgttgtttaattctgcttgttttttactgctatggatgttgcagatatctgtgaaattttactctattaggtcatcacctttagtaaatatttatccttgcataatttgagaaggtagacatgtttgttttgtaatattccccttagtaatatgagatagaagtacattggtaatggtagagatagatatttctaattaggtactaatgtttcttacagttttcagaataagtaagraataatttttatgctatatattgccttccttttacagtgaagaagaactgttgtatctgagtttcattgaagatgtaacagatgaaattttgaaacttggtttattttcaaacaggttagtttttttaatggtgttatgttaattcaggagtacattaaatattcttcatatttcttcatatgatgttaaaattttaaagttattttcccatattaggaaatgaaaaaatatattgctttcttggaaacttattattataattgatagcaagttgtaaagaatgtttaattcatactctaggggaagttcaccacttgggagaattaaagaatagagcttttattcattttaatattatatcccttgagttataagtgactagtgaaggaagatctttatcacttatttgcaaagctccataatcccattttactacctaaaattgtcatgagaatcaaaagcaagcatttttggtgcaaccattattagtattagatctagtaaaatgagaacaaattaagagctaggtttgcacgctgtaagttaaatggaaagtttgcaaaaccagattagctattgcatagcttaaggaaactgtgtgtcctgaattttgcttgaacatttatgtatctaagattcattgagcartgagctctactttgtgttatgtaacctaggaccctattatgtatactacttgctttctctgtcataataatatgccaagcatagacatttttaataaattatttctatcctctacatcaagttttttaaaaaattaaagcaaacattttcattattggtataaaaaggcatatcaaaaagacctaagatttttggcattaattctgttgacccctttcattttaaaaagttggttaataatatttgcataatatgggtaaagagtttcaggatacataatgaaaagttttggcaatctgtatcacaatatgaatatacctaacactgctgaatcgtgcacttaaaaatggttaagatgataagtttggttagtttttgccaccacaagaaaaaaagtacacatacaaaatcatatgtatttatgcttaaaattttatgtttttctcaagattataagactgtttattacagcatttttataattgtaccaaaaaccagaatcaacctaaatgtttaatggtaaatgtttggttgaataaactgtggaatatatatgaaatgtgaggtctgtttagggattaaaaatgatgttgaagtgaatttacagatatagaaagatgttaaagatatatgtcattgattagaaaaaacaaaatagggctgggcgcagtggctcacaccagtaatcccagcactttgggaggctaaggtgggcggatcacaaggtcaggagttcaacaccagcctggccaatatggtgaaacctcatctctactaaaaatacaaaaattagctgggcgtggtggtgcrcgcctgtagtcccagctactcaggagggtgaggcaggagaatcgcttgaaccccgcaaggcggaggttgcagtgagctgagatcgtgccaccacactccatcttgggcgacagagtgagactctgtctcagaaaaaaaaaaaaaaagaaaaagaaaaaagaaaaaacaagatagatacccaaatagtatgtattgtttaattacaagttggtaaagaaatacaaatgaatagaaaaaatgcctagtagtgaatattctaaaatgttaacaatagttgtaaaaagtagaatacagatttcttgggttttaaaaaaaaattgtgaaataattcagaactactaactctgaggttggttcataacttcactgatgctagcaaatgataacaaaggaaattagttgttttttaagaaactgttgatacattcctgtgatagagaggtgagcatggtgttctagaatgaagaaattctgtggagccagacacatctgggttaaattctcctaaaggcttttgacctcaggggagaggaaattatcatcttagagatgtggctttctcgtctttaaaatggtttttacactatctttccctccctacattggtcagaactagaggtaaaatgattattatgactagcacagtagcacttaatggaaattaataggtgataacttttaaattattatgtggatttaccatcagtgggagtttttaaattttttaattattttttaaaattttgtgaggtacacagtaggtatgtatatttaaggggtacatgagatgttttgatacaggcaagcattgtgaaataagaacgtcacggagagtggggtatccatcctctcaagcatttatcctttgagttacaaacgatcagattacattctctaagttattttaaatgtacaattaagttactattgactgtagtcaccctgttgtgctgtcaaatggtcttattcattctttctatgtttttgtacccattaactaccccacttaacctgcagccctctactacccttcccagcctctgttaaccatccttctactctctatgcccatgagttcaattgttttgatttttagatcccacaaatacgtgggagaatgcaatgtttgtctttctgtgccaggctcatttcacttaatataatgatctccagttccgtccatattgttgcagatgacaggatctcacttttttaatggctgaatagtactccatggtgtatatgtactacgtttttttatccattcatttgttaatggacacttagttgcttccaaatcttagctgtcataaacagtgctacgacaaacataagagtgcaggtatctcttcgatatcctgacttacttccttttgggattgctggaacatatggtagctcaatttctagttttttgagggacctccaaactgttctccatagtggttgaactaatagtttacattcttaccaacagtgtgcaaggattcccttttctccacatcctcaccagcatttattattgcttgtttttgcatataagccattttaactggagtgagatgatacctcattgtagttttgatttgcattcctctgatgatcagtgatgtgtggaataccttttcatattcctgtctacaattcgtatgtcttttgagaattgtctattcaaatcttttgcccattttttgattgggttattagatttttccctataaatctaatagtaaatagttgtttgagctccttatatattctggttattaattccttgtcagaggggtagtttgcaaatattttctcccattctgtggattgtctcttcactttgttggttatatcctttgctgtgtggaagctttttaatttgtgatcccatttgtccatgtttgctttggttgcctgtgcttgtgggatattactcaagaagtctttgccagaccagtgtcctagagattttccctcaatgttttcatttagtagttccatagtttcagaacttatatttaagcctttcatctattttgatttgatttttgtatgtggtgagagataggggtctagtttcattcttttgcatatgggtatccagttttcccattaccatttattgaagagactgccttttccccagtgtatgtatgttcttggcaactttgtcaaaaatgagttcactataggtgtgtggatttgtttctgagttctctattctgttccattggtctgtgtctgtttttatgcctgaccatgctgttttggttactgtagctctgtactgtaatttgaagtcaggtaacatgattccaccagttttgttctttttacttaggatagctttggctattctgggtcttttgtagtttcatgtacattttaggatttttttttctatttctgtgaataatgtcactggtattttgatagggattgcattgactctgtagattgctttgggtggtgtggacattttaacaatattgattcttccaatccatgaatttggaatatttttccttttttttttttggtgtccttttccattttgttcattggtgttttatactttaatataggaatttttaaaagtataatttaggaaggattataaaatatctctgtaagaggtttttctttagggtttggttgtgtgtgtgtgtgtgtgtgtaaatatcggggtagagaggctttgggtgtttgcatatgtctgtgagagaaaaacagctttttggtggtggggtgagaaaaaggagaattttattcaaagaaataaaagtagcatacagtctttcagaaatatgtaatgtgaagcaaatgcataatggaagaacttagaacaggaaaggattagtcttcagctttacagagaaaaagaaaaatctgaaaaacatttttcaacctttgtagtttcagtgttacgtrgctagtttatatttagatgattttctgattttgagacattaacatttttgtttatcatttgtaggtttttagaacgactgttcgagcgacatataaaacaaaataaacatttggaggaggtttgtctttccttataacttcattagaaaaattataatgtaaaaataattktatggtttttttcataccttcaaacaatacattaaaagcaagkgctttttttttcccttgaacttttttgagggtggtggtgggagaagtgaaaggaaaagtattaatcctgtgagattttcagcactgcagtcaaaatttaatttgactcaattaatgtaattagtctcatcttttcttaatcctaggaaaaaatgcgccacctgctgcatgtcctgaaagtagacttaggctgcacatcgraggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcrggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaatattacttttcttccttttttaaaatgtatgtataagatttctctattggttttctgtgctgcaataataagttaccagaaacctagcggcctaatgtgccacacatttattatttatcccacagttttgtggatcaggagtgtaggcacagcttagttgggtcctctgtcctgggtctcacaaggctaccccacaatcaaggcagtggctggggccatgttttcattaagaggcttgttggcagaattatcctccttgcagttatagatttgagggcttcgttgtcttgctgaccagtggctagaggctgcctatagttctctgccacttggccctttccttagggaaattataacgtggctgcttgcttttttaaggatatcaggaaaaccagagagattctgctaacaagatggagtcttatataatgtaacataatcacaggagtgactttctatcacctttaccgtgttcttttgggtagaagcaagtcacaggtcttgcccacacttaagggttgggaatatatacaagggtgtgaatgccagaacacaggaatcactggggtcatctgaggacctgctggccacaatttctaaaatcacttttcagaggaaaacatattttacctatattttcagaggaacatattttacccagacataagcggttttgtaggctatgggaaatggtttatgatctggtgtgagtcttgaagcgttggaccttgtctgcaatatctttaattttgtttttctcacttttcctgcaatatctaaagcctcaaggacctttcagttgtcagtgacccagggaattctgtcagctggctgagatgttgtctcttgttgtgagtgcaaacatttagtcagacctgtctgaagccctctcctacccttgtagctcatgaatgagacccttactattagaacatggcccagcagattcatctctaattatacctttttaactatttacaataatataattgaatatttgtgtgcccgttatgtacaaagtttcatgcctagatactgtggaggataaaaacaataacccattttgtttttataagctatattttaattttatatttaaaaaaatacaacccaggtattcttctaaaaacttaacagtgacttccaagtatcctgttctttaactcgggtttttatcatcctttggccatagcagtgtttcccaaagggtggtacttaccactggagacctgagagttgattttagtggtatgtggatgacaggtccatctcattcatgggatgctgaccatcaccactgtcttcaggataagacacaggtacaacctgcaaagcacaatatggtgggactgagcacccaacccacttttcacctccactgtcggaatccccaactcaccctgctacaacccttttttggcacaccttcccctcagccctcacctctggacttcttccctttaaccctgtaagcaacaccgtctatcccctcttgcagtcctcttaaacctcctgaaataaccttggctctattcttggtccccagcctgggtctccccatctgttagatctttacccctctagttgcttcttgggttctgttgttcctcagccccagggttcctttcttcagtcccagcctcactctttcacaaaccccctcttcccattccccatgtaactaccccagacctactggcctggcccaaattttccttccttggctggagctaccatctgtctttccggaggcattctcagaaactatctcctggctgctgttctccaacactttggtccaagccccagacctgccctatttgacattcagtcttcatgctctaactctgggtacagcttcttgtctctggggccatgacccatcctaatttggatacctattaggacaatttgttgttatcctttagtttccctttaagttttaaaaggtgagttgatttaaagaaatattaaaaatggttcttgaatgtggcaaaagtattatagtatgaaggtaggatgtgggtggtaagtttgggaaacagcacttaaactcttctagcagcatctttttttatccctaagacatcttgttacagcatcaagcaacatctttatatcttcccctcttccttctcacacagcccatcaactgaggctgagaggcatgatgaatgcgagtgtgtcttctgagccaggttgcctggatttgattccttttgagctgtgactttgagctgggttactgagcctgtgtgtgttttctcatatcttggagaggggtaattatagagcctttatcatagaatacaagaattaaatgagcttgcatgataaatacaggctgctgctacttttttttttgctatttattttttatttcagtaggattttgggaacaggtgatgtttggttacatgaataagttcttcattggtgacttctgagattttggtgcacccagcacctaagcagtgtacattgtacccaatgtgtagtcttttatccctcactccccgcctaccctttcccctcagcccccaaagtccattgtattattcttatgcctttgcatcctcatagcttagctcccacttatgagtgagaacatacaatgtttggttttccattcctgagttacttcacttagaataatggtctccaatwccatctaggttgctgcaaatgccattatttcattcctttttatggctgagtagtattcaattgtgtgtgtgtgtgtgtatatatatacacacatcacattttcattatccacttgttgatcgatgggcatatgggctggttccatatttttgcaattgtgaattgtactcctataaacatgcgtgtgcaagttatcttttttgtataatgacttcttttcctctgggtagatacccaggagtgggattgctggatcaaatggtagatctacctttagttctttaaggaatctccacactgttttccatagtggttgcactagtatacattcccactaacagtgtaaaagtgttccctgttcaccacatccacaccaatatctactatttttttattttttgattatggccattcttggaacagtaaggtggtatcgcgttgtggttttgatttgcagttccttgataattagtgatgttgaacattttttcatatgtttattggctatttgtatatcttcttttgagaattgtctattcatgtccttagcccattgttgatgggattgtttttgtttcttgctgatttgtttgagttacttgtagattctggatattagtcctttgtcagatgtatagattgcaaagattttcttcactctgtgggttgtctgtttactgattatttcttttgctatgcagaatcattttagtttacctaagtatcatctgtttatctctgtttttgatgcatttgcgtttgggttcttggtcatgaacactttgcctaagccagtgtctagaaaggcttttctgatgttatattctagaatttttatagtttcaggtcttagatttaagtctttgatccatcttgagttgatttttccataaggtgagagatgaggatcgagtttcattcttctacacgtggcttaccaattgtcccagcaccatttgttgaatagctttgttgacagtcagctgactgcaaatatgtggctacatttctgggttgtttattccattcctttggtctatatgcctgtttgtttgtttgtttgtttgtttgtttgtttgtttttgaggcagagtctcactctgtcacccaggctggagtgcagtggtgtgatctgggctcactgcaacttctgcctcctgggttcaagcgattctccgacctcagcctcccaagtagctgagattacaggcacctgccaccatgcccagctaatttttgtagttttagtttgtagtttgtaattttagtagagacggggtttcaccatgtgggccatgttggccaggctgtctcaaactccagcatagaaggtatgttccttctatgctgattttgctgagggttttaatcataaagggatgctggattttgtcaaatgctttatctggtctattcagatgatcatgtgatttttgtttttaattctgtttatgtggtatatcacatttattgattttcagatgttaaaccatccctgcagccctggtatgaaacccacttgatcgtgatggattatctttttgatatgctgttggattcggttagctaggatttcgttgaggatttttgcatctgtgttcatcagggatgttggtccatagttttgtttttttgatatgtcctttcctggttttggtattagggtgatcatggcttcatagaatgatttagggaggattccctctttatcttttggaatagtgtccataggattggtaccaattcttctttgaatgtctgatagaattcagctgtgaattcatctggtcctggaatttttgkttttttgttagtaattttttttttttttttttgagatagagtctcgctctgtcacctaggctggagtgcagtggtgcgatctcagctcactgctgcaacctctgcctcttggtttcaagcaactctcctgcctcagcctcccaagtagctggaattacaggtgcctgccactgcgcccagctaatttttgtatttttagtagagacatggtttcaccatgttggccagactggtcttgaactcctgacctcgtggtccacccgccttggcctcccaaagtgttgggattacaggcgtgagccactgtgcccagcctatttttgttggtaatttttaaattaccatttcaatctcactgctcgttattggtctgtttagagttttctgtttcttcctgtttaatctaggagggttgtatatttccaggaatgtatccatctcctctaggttttctagtttatgcatgtaaagctgttcatagtagccttgaatcatcttttttgtttctgtggtatcggttgtaatatgtcctgcttatttcttgtatttatttatttatttattattattatactttaagttttagggtacatgtgcacaatgtgcaggttagttacatatgtatacatgtgccatgctggtgcgctgcacccactaactggtcatctagcattaggtatatctcccaatgccatccctcccccgaccccacgaccccacaacagttcccagagtgtgatgttccctttcctgtgtccatgtgttctcattgttcaattcccacctatgagtgagaacatgtggtgtttggttttctgtccttgagatagtttgctcagaatgatggtttccagcttcatccatgttcccacaaaggacataaactcatccttttttatggctgcatagtattgcatggtgtgtatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatatctctgatggccagtgatggtgagcagtttttcatgtgttttttggctgcataaatgtcttcttttgagaagtgtctgttcatgtcctttgcccactttttaatggggttgtttgtttttttcttgtaaatttgtttgagttcgttgtagattctggatattagccctttgtcagatgagtaggttgtgaaaattttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcctgaactgattttcgtataaggtgtaaggaagggatccagtttcagctttctacatatggctagccagttttcccagcaccatttattaaatagggaatcctttccccattgcttgttttcctcaggtttgtcaaagatcagatagttgtagatatgcggcgttatttctgaggcctctgttctgttccattgatctatatctctgttttggtaccagtaccatgctgtttttgttactgtagccttgtagtatagtatgaagtcaggtagtgtgatgcctccagctttgttcttttggcttaggattgacttggcgatgcaggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatccagagactttgctgaagttgcttatcagcttaaggagattttgggctgagacaatggggttttctagatatacaatcatgtcatctgcaaacagggacagtttgacttcctcttttcctaactgaataccctttatttccttctcctgcccaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagtatgaaaggttgttgaattttgtcaaaggccttttctgcatctattgagataatcatgtgttttttgtctttggttctgtttatatgctggattacctttattgatttgcgtatattgaaccagccttgcatcccagggatgaagcccacttgatcatggtggataagctttttgatgtgctgctggattcggtttgccagtattttattgaggatttttgtatcaatgttcatcaaggatattggtctaaaattctcttttttggttgtatctctgtccggctttggtatcaggatgatgctggcctcataaaatgagttagggaggattccctctttttctatggattggaatagtttcagaaggaatggtaccagttcctccttgtacctctggtagaattcggctgtgaatccatctggtcctggactctttggttggtaagctattgattattgccacaatttcagatcctgttattggtctattcagagattcaacttttcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctctttttttgtttattagtcttgctagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttggatgcgtcccagagattctggtatgtggtgtctttgttctcgttggtttcaaagaacatctttatttctgccttcgttttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgttgaggagagctttacttccaagtatgtggtcaattttggaataggtgtggtgtggtgctgaaaaaaatgtacattctgttgatttggggtgaagagttctgtagatgtctattatgtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccgttatgtaatggccttctttgtctcttttgatcattgttagtttaaagtctgttttattagagactaggattgccacccctgccttttttgttttccatttgcttggtaggtcttcctccatccttttattttgagcctatgtgtgtctctgcacatgagatgggtttcctgaatacagcacactgatgggtcttgactctttatccaatttgccagtctgtgtcttttaattggagcatttagtccatttacaattaaagttaatattgttatgtgtgaatttgatcctgtcattatgatgttagctggttattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttctgaagcttagtttggctggatatgaaattctgggttgaaaattcttttctttaagaatgtcgaatattggcccccactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcttgcagagtgttttccaacttggttccattctccccgtcactttcaggtacaccaatcagacgtagatttggtcttttcacatagtcccatatttcttggaggctttgctcgtttctttttattcttttttctctaaacttcccttcccgcttcatttcattcatttcatcttccatcgctgataccctttcttccagttgatcgcattggctcctgaggcttctgcattcttcacatagttctcgagccttggttttcagctccatcagctcctttaagtacttctctgtattggttattctagttatacattcttctaaacttttttcaaagttttcaacttctttgcctttggtttgaatgtcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgtgtttttggtgtggatgtcttttctgtttgttagttttccttctaacagtcaggaccctcagctgcaggtctgttggagtacccagccgtgtgaggtgtcagtctgcccctgcttgggggtgcctcccagttaggctgctcgggggtcaggggtcagggacctacttgaggaggcagtctgcccgttctcagatctccagctgcgtgctgggagaaccactgctctcttcaaagctgtcagactgggacatttttttgtcctgcttatttctaattgagtttctttggatcttctctccttttcttcgttaatctcactaatggtctatcaatttcatttctcttttcaaagaaccagctctttgtttatcttttatattgtgttttttttgtttgtttcaatttcatttaattctgccctgatcttagttatttctttacttctgctgggtttgggtttggttgattcttgtttctctaactccttgaggtgtgaccttagattgtctatttgtactctttcagacttcatgatgtaggcatttaatactatgaactttcctcttagctctgtctttgctgtattccagaggttcagatattttgatagtttgtgtcactactatcattcanttcaaagaattttttaatttccatcttgatttcattgttgacccagtgatcattcaggagcaggttattgtacttccatttatttggcatggttttgagggttccttttgcagttggtttctaattttattctactgtggtctgtgagagtacttgataagatttttattttttaaaatgtgttgagacttgttttgtggcctatcatatatggtctatcttggagaatgtttcatgtgctgattaatgaatatatactctgcagtttttggctagaatgttctgtgaatatctgtttagtttatttgttctagggtacagtttaagtccatagtttctttgttgactttctgtcttgatgacctgtctactgctgtcagtggagtattgaagtcccccactattactgtattaacatctatctcatttttttggtctagtagtaattgttttgtaaatttgggagctccagtgttaggtgcatagatacatttaggattgtgatattttcctgctggactagtccttttatcatcatataatacccctctttgtcatttttaactgctgttgctttgaagtttgtgtgatacaagaatagctactcctgcttgcttttgttgtccatttgcatggaaagatattccattggtaacaaatatcccactggtattttgttggtaactttttaattaccatttcaatcttgctgcttgttattggcctgttcagagtttctgtttcttcctgggttaatgtaggagggttgtatatttccaggaatttatccatctcctctaggttttctagttattccattcaagatattccatccaaatggacatcaaaagcaagcaggagtagctattccacccctttacctaagtttatgtgagtctttatgtgtcaggtgggtctcttgaagatagaatatacttggttgatgaattcttatccattctgccatttcatatcttttaggtggagcatttaggccatttacattaaacattagtattgagatgtgaggtactattctattcatcgtactatttgttgcctgaataccttaggtttttttttcattgtgttaaaatgaaaaattataggtcctgtgagatttatgctttaaggatattctattttgatgattttgaggatttaagatttagagctccttttagcagttcttttagtgctggcttggtagtggcaaattcagcatttgtttgtctgaagaagactgtatctttccttcatttatgaagcttaattttgttggatacaaaattcttggctgataattgctttgtttaaggaagctaaagataggaccccaatcccttttagcttgtagggtttcggctgagaaatctgctattaatctgataggttatcttttataggttacctgatgcttttgccgcatagctcttaagagtctttcctttttcttgactttagataacctgatgactatgtgcctaggcaatgatctttttgtgatgaatttcccaggtgttctttgaacttcttgtatgtggatgtctagatctctagcagagctgaggaagttttcttcaattattccctcaaatatgttttccaaacttttagatttatcttcttcctcaggaacaccaattattcttaggtttggtcatttaacataatcccaaacttcttggaggctttgatcattttaaaaaattctttcttctttgtctttgtcagattgggctaatttgaaagccttgtctttgagctgggaagtttctttcttccatttgttcaattctattgctgagaccttccaatgcattttgcattttgcatttctctaagtgtgttcttcatttctagaagttgtgctttttgttttgtttttgtttcgttttgagatggagattcactcttgtcgcccaggctggactggaatggcgcaatcttggctacctgcaacctctgcctcctgggttcaagcgaatctcctatctcagcctcccgagtagctgggattacaggcgtctgccaccacagctggttaatttttctatttttagtagagacagggttcaccacgttgggcaggctggttttgaactcctgacctcaggtgatccacctgcctgagcctcccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttcaagcaattctgcttcagcctccccagtagctgggattataggcgcccaccaccatgcctagctaatttttgtatttttagtagagacagggttttgccacgttggccaggctggtctcgaactcctgacctcaagtgatccacctgcttcggcctcccaaagtgttggggttataggtgtgagccgctacacctggccctatatcattttttttatttctttaagttagactttacctttctctggtgcctccttgattgacttaatagttgaccttctgaattcttttttcctgcagtttagagattttgtcttggtttggatccactgttggtgagctagtgtgatcttttggggtgttaaagaaccttgttttgtcatattaccagaattgcttttctggttccttctcatttgggtagagaatgtgagggaagatctgggactcaagggctgctgttcagattcttttgtcccacaggatgctcctttgatgtggtgctctccccttttccctagggatggcatgtcttgagagccaaactgcagtgattgttatttctcttctggatctagtcacccagcagggctaccaagctctgggctggtactggggagtgtctgcaaagagtcctgagatgtgattcatcttcaggtctttcagccatggataccagcacctgctcaagtggaggtagcaggagagtgaagtggaccctgtgagggtccttggttgtatttttgttaagtgtactactggttttgtgttcgttggcctccagccaggaggtggcgctttcaagagtgcatcagctgtggtattatagggaaaatcacactgtgggcggggccatagagctcccaagagattatgtccttttttttggagttcttctgctgtcccgcagagcctacagcagcaatccatctccttctgtctgctcaattctcttggctttcctggtatattcctgcagtagttcttggagcaaaagttcacaatgtgggtttccacacgctgctctgtccatctgagtgggaactgcaaattagtcctgcctcctatctaccatcttccctccagtataccccctgctgctastatttttaaacaaaccatgccactctcttctttaaaacacctgtgagagtttgcacttgctaacacaataaagtccaggacctttggcattttctatgttatattttccttcccagttcatgtcctgccatcctctccgaagcaccctgtgtcaatcacacctactcgcttgttcttcacacatagaggtcctctctctctccatgtatctgctcagggtatcatttcctctctttggcaccctggagtcttcatttaaatcccagactgaatataacacctcctgtgaaaccttgagggattgccctaacatttgtccctcctaccccaactctgtgatctgaaatctgtcttactacatgagttttataatactgtttacccaatttgtctctagactgtaagattctcaagaggaaggacctgtttctctttggatacccagcttgacaatgaatgcatttgttcacggaggaagatagtttgagcttaatgggaggtttagcttcagataaggttatagggaaaacaggatatttcctcttctctttatactcagaaagttcaggttccccgtgtagaaagaagaatgtagcagattgctaagctacatgaaaatgtgtttgctcacattttaaatggtgtaaaatataaattaacatcatcattagaaggctggccttaaaaagtcacatggtctctaggaagtcaataagtaaagaacagagcagcttttgtgggcaagactatactttgccaagtgaactaatagctgtatggtcaccagtgaattactttatcccagaccttgtgtgtttttgatttctcagacctcacggggatgaagggccttggttttaaagagctcggactaaatgatccaaagatttctttttgttactaaaattagttctactttaattcttaaggtctgtagaaattaaaatggaaataatttatatttgaagtagaaatacctattcactcttcatgtgctggtgtagtattggaaatcagtctgctaaaccgattcatacttcagtgatagaagatgccaccctgagttactttccccagtagccagatggaaccagtaaggaatatcatatcctaaaagaacaaatccatgtttaaagactgggaggaagatctttttgggttggagtaaggaaagttttgcaccaaggctaagcttgttgccttgtgcattctgctttgtgctcatattcgagttttgaggcaaaaacacacacctagcagtttgggacatgaggcctccatatcacctagtttttccaacccaacaaaccctcaagtttctcccgagagaaagaatataccattgtataagtttcctattgctgctgtaacaagttaccacaaacattaaaaaacatatcttacagttctggaactcaagtcctaaaatcaagctattgctggagccacattcctcttggaggctgtaggggagaatctgtttccttgcatttaccagcttgcagaggctgcctgcgttccgtcacttgtggcatcttcctccattttctagccaattgtggaggatctttaaatctctttactaaagaccctggtgattactttgtgtccacctggataatccaggataatcccccaactcaaaaatgcttcatttagtcacatctgcacagtcccttttgccatgtaaaatttataacttcaggggattaggatatggacatatctggggagctgctattcagcctaccatgactataaatatcattaacctaattaaaatggcctaaattagctggctgtggtggctcacctataatcccaggactttgggaggccaagatgggaggatcgcttgagctcaagagttcaagaccgaccagcctggtcaacagagtgagaccccatctacacacacacacacaaaaattagctgggtgtggtggcccacagctgtagtcctagctaattgggaggctaaggcaagagaatcacctgagttcaggagatggaagctgcagtgagttgtgatcaggccacttcactccaccctgggtgacagagcaagaccctatctcaaaaagaaaaaaaaagaaagcctagatagactttagtttgtattaattatagcttggctatacaatgagtcccaaattaggacatatattaaacgtccattgatttttaattactaaagcagtggttctcaaactttaatgtgtatcaaaatcacctggaaaactaaagtgatttctgggccccatccccatagcttctgactcaaaatatttagatctgggtcaaggctcaagaatttgcatttctaacagattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactcttaaagtgattgattactgtggagatgtgtgatgacagattggcacctactaaggaaacctctcttgcctggtacattattaaaaataatccaytggggaaataggactaatttaattacatgcctttatgcagtaagatccacagttgaaaaatagaggcagtagctttaattgcactgtaatgttcacacacaaatcatatcttgcttgaaacagttttatggcaaaaatagaccatatattgatttcacatatataacatttaacccttcaagcctttttgcccattaaatatacacacctttacaaaccaataacagtttagaagaattaagctcttctgattataaacttttacattattgatcagacagtagcacataaaattgcttttttttttagtattttacatgaataattttatttgtgcttcatgaaaactccatttatcccattttttattatactttaagttttagggtacatgtgcacaatgtgcaggtttgttacatatgtatacacgtgccgtgttggtgtgctgcacccattaactcatcatttacattaggtatatctcctaatgctatccctccccctccccccaccccacaacaggccctggtgtgtgatgttccccttcctgtgtccatgtgttctcattgttcagttcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacatttccttaatctagtctatcattgatggacatttgggttggttccaagtctttgctattatgaatagtgctgcaataaacatgtgtgcatgtgtctttatagcagcatgttttataatcctttgggtatatacccagtaatggggtggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgttagagttctttgtagattctggatattagccctttgtcagatgagtagattgcaaaaattttctcccattctgtaggttgtctgttcactctgatggtagtttcttttgctgtgcagaagctctttagtttaattagatcccatttgtcaattttggcttttgttgccattgcttttggtgttttagacatgaagtccttgcccatacctatgtcctgaaaggtattgcctaggttttcttctagggtttttacggttttaggtctaacatttaagtctttagtccatcttgaattaatttttatataaggtgtaaggaagggatccagtttcagctttctacatatggctagcaaggtttcccagcaccatttattaaatagggaatgctttccccatttgttgtttttgtcaggtttgtcaaagatcagatggttgtagatgtgtggtattatttctgagggctctgttctgttccattggtctatatctctgttttggtaccagtaccatgctgttttggttactatagccttgtagtataatttgaagtcaggtaacatgatgcctccagctttgttcttttggcttaggattgtcttggcaatgcgggcccttttttggttccatatgaactttaaagtagttttttccagttctgtgaagaaagtcattggtagcttgatgagggtggcattgaatctataaattaccttgggcactatggccattttcatgatattgattcttcctatccatgggcatggaatgttcttgcatttgtttgtgtcttcttttatttcattgagcagtggtttgtagttctccttgaagaggttcttcacatcccttgtaagttggattcctaggtattttattctctttgaagcaactgtgaatgggagttcactcatgatgtggctctctgttcgtctgtgatttgtgtataagaatgcttgtgattttttgcacattgattttgtatccagagactttgctgaagttgcttatcagcttaaggagattttgggctgagacgatggggttttttaaatatacaatcatgtcatctgcacacagggacaatttgacttcctcttttcctaattgaataccctttatttctttctcctgcctaattgccctggccagaacttccaacactgtgttgaataggagtggtgagagagggcatctttgtcttgtgccagttttcaaagggaatgcttccaggttttgcccattcagtatgatattggctgtgggtttgtcataaatagctcttattattttgagatacatcccatcaatacctaatttattgagagtttttagcatgaagggctgttgaattttmtcaaaggccttttctgcatctattgagataatcatgtggtttttgtctttggttctctttatatgctggattacatttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctttgtcaggctttggtatcaggatgatgctggcctcataaaatgagttagggaggattccctctttttctatggattggaatagtttcagaaggaatggtaccagcttcttgtacctctagtagaattcggctgtgaatccatctggtcctggactttttttggttggtaggctattaattattgcctcaatttcagatcctgttattggtctattcagagattcaacttcttcctggtttagtcttgggagagtgtatgtgtcgaggaatttatccatttcttctagattttctagtttatttgcttagagatgtttatagtattctctgatggtagcttgtatttctgtgagatcagtggtgatatccccttcatcatttttttattgcctctatttgattctcccctcttttcttctttattagtcttgctagcagtctatcaattttgttgatcttttcaaaaaacgagcccctggattcattgattttttgaagggttttttgtgtatctccttcagttgtgctctgatcttagttatttcttgccttctgctagcttttgaatgtgtttgctcttgcttctctagttcttttaattgtgatgttagggtgtcaattttacatctttcctgctttctcttatgggcatttagtgctataaatttccctctacacactgctttaaatgtgtcccagagattctggtatgttgtgtctttgttctcactggtttcaaagaacatctttatttctgccttaattttgttatatacccattagtcattcaggagaaggttgttcagtttccatgtagttgagcggttttgagtgagtttcttaatcctgagttctactttgattgcactgtggtctgagagacagtttgttataatttctgttcttttacatttgctgaggagtgctttacttccagctatgtggtcaattttggaataagggcaatgtggtgctgagaagaatgtatattctgttgatttgtggtggagagttctgtagatgtctattaggtctgcttggtgcagagctgagttcaattcctggatatccttgttaactttctgtctcgtttatctgtctaaggttgacagtggggtgttaaagtctcccattattattgtgtgggagtctaagtctctttgtaagtctctaaggacttgctttatgaatctaggtgctcctgtattgggtgcatatatgtttaggataattagctcttcttgttgaattgatccctttaccattatgtaatggccttgtctcttttgatctttgttggtttaaagtctgttttatcagagactaggattgcaacccctgccttttttttccatttgcttggtagatcttcctccatccctttgttttgagcctatgtgagtctctgcatgtgagatgggtctcctgaatacagcacactgatgggtcttgactctttatccgttttgccagtctgtgtattttaattgaagcatttagcccatttacatttaaggttaatattgttatgtgtgaacttgatcctgtcattatgatgttagctggttattttgctcattagttgatgcagtttcttcctagcattgatggtctttacattttggcatgtttttgcagtggctggtaccagtcgttcctttccatgtttactgcttctttcaggagctcttgtagagcaggcctggtggtgacaaaatctctcagcatttgcttgtctgtaaaggattttatttctccttcacttatgaagcttaatttggctggatatgaaattctgggttgaaaattcgtttaagaatgttgaatattggcccccactctcttctggcttgtagagtttctgctgagattcgccgttagtctgatggtcttccctttgtgggtaacccgacctttctctctggctgcccttaacattttttccttcatttcaactttggtgaatctgacaattatgtgtcttggagttgctcttctcgaggattatctttatggcattctctgtatttcctgaatctgaatgttggcctgccttgctaggttggggaagttctcctggataatatcctgcagagtgttttccaacttggttccattctccccatcactttcaggtacaccaatcagacataaatttggtcttttcacatagtcccatatttcttggaggctttgttcatttccttttactcttttttctctaaacttctcttcttgcttcatttcattcatttgatcttcaatcactgatacsctttcttccagttgatcgaatcggctactgaagcttgtgcattcatcacgtagttctcttgccatgtttttcagctccatcaggtcatttaaggacttctctacactgtttattctagttcgccattcatctaatcttttttcaaggtttttagcttctttgcagtgggttcaaacttcctcctttagctcagagaagtttgatcgtctgaagccttcttctctcaacttgtcaaagtcattctccatccagctttgttccgttgctggtaaggagctgcgttcctttggagggggagaggcgctctgatttttagaattttcagcttttctgctctcttttttccccatctttgtggttttatctatctctgctctttgatgatggtgacgtacagatggggttttgatgtggatgtcctttctgtttgttagttttccttctaacagtcaggaccctcagctgcaggtctgttggagcttgctggaggtccactccagaccctgtttgcctgggtatcagcagcagaggctgcagaacagcacatattgctgaacagcaaatgttgctgcctgatcgttcctctggaagcttcatctcagaggggcacctggccatgtgaggtgtcagtctgcccctactgggaggtgcctcccagttaggctactcgggggtcagggacccacttgagggggcagtctgtccgttctcagatctcaaactcctttctgggagaaccactattcacttcaaagctgtcagacagggacatttaagtctgcagaggtttctgctgccttttgttcggctatgacctgcccccagaggtggagtctacagaggcaggcaggcctccttgagctgtggtgggctccacccagttcgagcttcctggctgctttgtttacctactcaagcctcagcaatggtggatgcccctcccccagcctcgctgccatcttgcagatagatctcggaccgctgtgctagcagtgagtgagtatctgtgggcgtgggaccctccgagccaggtgtgggatataatctcctggtgtgccgtttgctaagaccattggaaaagctcagtatttgggtgggaattacctgattttccaggtgccatctgttaccacttcccttggctaggaaagggaattccctgaccccttgcacttcccgggtgaggcgatgcctcaccctgctttggcttacgctcggtgggctgcacccactgtcctgcccccactgtccgacaagccccgtgagatgaacccggtacctcagttggaaatgcagaaatcacctgtcttctgcgtcactcgygctgggagctgtagactggagctgttcctatttggctatcttggaaccgcaaacagtatgtttttcttacattttttcctttacctttttgtttgacttacaggggtttaagtattctgtattatcttgtttttattaaacctgttctagaaataaacttgttgtctctggagaatattcagttttttcaacctgtttgttggtctgaaccagtgttgcactggtattatttcagtaaaactacaaaaccttaccaaaatcctttcnggacacttaactctaagattaaattacatttcaataaatattaatcactgtaagtaacaaaatatttgtctcattcaatggtccattaatttcaagtgatttctaataaacttccaggataaaaaaatttggaccgtctcagcatatggtcacagtctgacctgtaatatctgtatcttatgaaaaatgaatacgtttatattccctgttcatttgttcagtttttctcagctgatgagcagacagaaatgaaaactagttattgaatctgtactagtctcatcaacctactaaaaaaattgaggcctgacagactcatatcctgtctaacccaggtaatcatccaaccttctgaatttctttggcaatggacatctgtttttaagagtgaatactgaagatgtttgttttaccaagtttttagagtgtgaatttaagttacacacgcacacttaaatgtcagtggtttcacatttgacaactgaaattaagtagtagtctttgtacacactttaaaaaccacctaccagttcagttaaaattgtaggtctattaacactgaaattatgtcgcttgtgtactgctatatccagtgcagctacaccacattgtcgattcagagccaagggattttacagattttaaagtgcgtttatttgacacaccacaaagtcatttaatgaaagttaaggaataatgatcaaaacatttatctagttaataagtaattttcagaaatttggaacagtacgcaagccatactatttctgaagttctacagaagttcaaacacaatgattcctttcttgtcatccgtttgtccctatttataatattaaagcataactcaaaagtatatggttactatccctttagtaacccataaaatgttggaaggtgtttagatgttctttagatttttgaaaattaagtattttttagaatacacatgggtaatgtcaacatttttggaaatatgatgtgcagacagaccttaattttacttgtatgtgacctagggataccctctatataatagcatttgccttggaactgctgctccttcagctgggtgctgaagaccttcaccttccttcttgggccatcccttacttcccatttcaagccagtaatattaaggaggacatataagtggcaacaggaaaggtaggggacagttttgccaatttgccctccttcaccccctgccccacttcagacagtttcattagcaagatccctgctcacattataaggcccattctgttccttacccatgcacagctcaagtttctgcaacaaacgctggcatacgttctgaaaagtttcccataaaacagacacttaacttcagttgctttctgagtcttggttgccactgcccgacaggagtatttattctctgatctcaccagcagggtgcagtagggagaaaagttgccctataatttcttggagtacagaacacatacagatacggtttggttctgtaccactgcttacctttcagggcccctatggtttcagtaagctttgagggcacaaactaagaaggctaacaccaagagtattgtttgcatgggtaaatattactaaaagtcaacatacaagtgaacttttagagcatattttttatttgggaactacctgaaatacccagaaaactatgccaccactttaacaatccaaggacttcaaatgttttctaaaactctctctacccaagtagacatgcaaactttgatctgaatttcctgacatttccttatttttctgtttttgttttgtttttttttgagacagagtcttgctctgtcacccaagctggagtgcagaggcgagatctcggctcactgcaacctctgcctcctgggttcaagcaattctcctgcctcagcctccctgagtagctggacacgtgccaccatgcccagctaagttttgtatttttagtagagacggggtttcaccatgttggccaggctggtctcatactcctgacatcgtgatccacccgcctcggcctcccaaagtgctgggatttacaggggtgagccaccacgaccggccttcctcatttttctataaataattttagatagtagggtaaatggagttcttatttccaggaatttgaaaagctcatattcttttgagaaatgttttcccaggcaaatttctaatgcagctattcctctacttttgaaatgtccatccctcagctcaaaagaaagcaccctgcaatttagattctttttttaaaaaattaagtttaaactggaaagggatagttttagcttgttccacatgaaatcttgctgataagcaaattcaactacatttctatccaaaagagttcctttaaaaagtctgacttacagtcaggcatggtagctcatgcctgtaatcccagcactttgggaggccgatgctggcagatcccctgaggtcaggagttcgagaccagcctggccaacatggtgaaaccccatctctactaaaaattaaaaattagccgggcgtaatggcgcacatctgtaatcccagctacttgggaggccaaggcaggagaattgcttgaacccagaaggtggaggtttcagtaagccgagatcgtgccactgcactccagcctgggtgacagaacgaaactccgtctcaaaaaagaaaaaaaaagtcttatttacaataatttcctgtttccatttctttatgcaaatctcaaataataaacctgctcttggcaagctgcagctaatctccagtttatattactgtacatagttgtatatttaaattttcttaatattgtgaacatttaacatctcaacccttctgaaatgactgatggtgaaagcttcacagaaaagctggccacgtcatgctgtcgccactcagtcccacaacaccacactctcctccctcctcctcctgtttctggctagacattgctttctggacgtttctaaggaagcacaggcccagcttctaattcgaccaaagggttttaaagtctaagttctagcattttctgaatgcttcacagtagatgttccagaagaaattaatgactacaataagcattccaaatgatattctaaaatgaggactttctggctggacacagtggctcacgcctgtaatcccagcactttgggaggccgaggcagacagatcacttgaggtcaggagttggagaccagcctggccaacatggtgaaaccccgtctccactaaaaatacaaaaattagccgggcatagtggtgcatgcctgtaatcccagctactcaggaggctgaggcaggagaatcactcgaacccaggaggcagaggttgcagtgagccgagatcatgccactgcactgtagcctgggcaatagagcaagactcygtctcaaaaataaaaaataaaatgagtactttctgtgctcaaaactaccaactaagctaaactatttcatcaaaagaccccactaatcaggaaaactgataccagagataccaaaattgatcagtggaaaacagtggtttataactctacgttttgtggaagtgcacattttgataattcttattaaaagacactaagatacatgaagcattgtgtaagtttggcagacattaatatactcatttcagaggcagtaaacctatgaacccttaatgttctagtttgctcttgaaaatgatactatttcaaagctcagtaatgtggatagatttttattcagaaatcctttcatattcactaactgcaattaaaagtttaaaattacatggctcttaggaatgacgccaaacatgcaacattttaagagtaatattaaacagtaattttgccctcagaagtttacttatcaaattattacaacaggaacacaaatagaccacatattactctttaattagatttgttttacaatatgttcttgtcaacgagctatgtcaaactgtttgtttaaacctgacagaaaagcattttcacaaaaacgtaccatggagagggagggggaggggaagaagcactttttctagagatggaaaatagttccagtaaaaagttcttattcctttcttctaaggagctcgttctgaatattttcacttagttctactgttctttaaacaggactttaaaaagaattttgtatttacaaaatttacattttgttcctacaaaatgtaattttttaattttgtaaaataaaaatgtaaaattttaattttgttcctacatgagaagtgtgcgtactttcaattagttttcattaatatcttctgagttttcctcttaggtggttggtttctgggtaaggcagagttaggctggtgcacacactatttaggaagtcctgtctcgtggctgacaacatacatgtagtgctcaaggaagtgagttaaggagtgacatgggaatcaaaatgatgcctagaatagtgtaatttgggaaacagccctagatttgacattttggaagttcactgtaagaagagaccccaaaaagaaggaaaagggaaagggttcctcagctaaatatcccactcatccatgcctactcagcggtcactgtgacaaggccatcttaatcggggccagagatgacactctccccctgtaactcagcctggctctgtctattgggatgtgcctaaatgggatgggtgagggggcactaaacagctaacactggccagggaattaaggagctaaaatgcaagtacctcttgaataccacagcaatctctgtgcacaaatttggactgtactttttgggagaagaggtgaaaactattattaactattcccttccttcaaccaaaaggaaaaatacgcctctttaaggcttcttttaatgatactataatgctgaatttatttatgaaaaagaaacaatacaggttgaggtgggaaaagccccaaggaaacggagtaagtcactggcggtcacaggacttgaattccctggggacagtgctgtggggtcccctgctcgccatcccagcacctcagtctgagtatagataatactgcatttttgtaaagacgaaggcatcctgcatttaccatcacactccacctactcttgtcctagtcatcttacatactcttagtccttaatctctcccaaaacgcttctcagcgcccattgttattgtgtcatctacaaagcaacacatatattaaaactcagatttgtttttaacaaaaaagtgcttaaaaccaccctaggcaattgtttttcacttcattttcaaccaataaaatcaaattcatttagatctatgaataatactgaaaaaataatgcttattctcttacattttaaataatgtgccttcatcctcaactttacattaactgactcatttcagtatctaaatgaattgagctctcatttgaaaaacagaaggtacaactatatagaatttttaggataaaaaatgttctggatagaaaaatccttttgatgtttcaaaataacacagattctcagtatagttttcagtttggcaactaaaccattattaagtacccaaggtttttaaaaaataacaaaagataataacatgatttttaaatacaaagttatataggagcaactcatatctgtggatcatccttacacaaagttgtttctcactagaaaaatccctaaatatttgtcataaaataaaaactccattatcaaaaattagtttaagatagaaatctatgcactttaatgattgccagaattgcccagcatagcttcagtaaaatagagaattgtctagaaaatacaatctccaaaatgtgtgcaagtactgcaaaccggacagaccggggcagggcaaggcccttgaaaccaagtcctccttgagcacctttcccaggttagaaacccctcttcagcctgtgcttcgcacgtttccttcagcgtgccgccattcagactgcgccacttacgtcccagtgccacgctgcgtggatcaagtgtcaacrggaaagtatgagttaggcaagcgctttttttttaagctgtaaacgcttcacatgactggccccgtaagaaattgtgggagcttagatgagcctggagcttttcaggaactggatgaggactctgtacacaaatgtgtactggcagagagtctgcaccagcatcattctctgttgcctcagcatgtccagcactctcgggatgtccagcacctaggttgagagaaacggtaatgaagataatgtgttcccctngggagacagaaaggatgggaggacacgagtgtcctggcagaaacctggttrggagatggacagtctcttttccaccttagcgtcttctagaaataagccatgattgcctacttctgattttctgattagttttagctataaatagaatgtccatgcagactatttcttcaacattccccaggtgtagctcactgactttgtatggttggacataattaccatgtctcactaaataccaaaattatacaaaaacatagtgtgctaagtgctatcagtatctagctatttccctcaagggctctgggcagcatgaatcatccttgaaatgtaaacagaaaaagaattctgagctcaaatttgaaaaaccctgggcaagtaaaacaaaattaaacagctttatttatcgtatgacttcttagtctttaatatgctaattggtactgagactctccaagaagacacagccttttgcagggaacattagtaacatcttgaggccaccacagtccaaggaaatgtgcgcaaaaagagctattaagtcactatgtccytctcttccccagcctyatttccacccaaaaaggccaggtgatcataagcgccatcacctcattgtgttccaggcaggcratcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatcaaggcgtatcacattgttgactcaatcttcatattctctccactgattaagaggactgcagataaagagcactgggtgccagtgaaccaaacccaaccacaaagggacagtgtgaccctgagcaagtcactacctctgtccactttctgatctacaaaatgaaatgacggagatactgagtcagctgtggcrttctactcactaccaaatcataatttataaacctcgttaaccctccccaaaacacttgtattctttatgttaaaacaagtccgaagcttatatgagataacataaaggaaatatttcggaaacataaatgttcctctctgtttaacacctccagaggcagctgtcctcggaacaaagttaaagtcactcacataaaaatcccttgaggtcttctggacagccatgttcaggccagtctgtgtattggaggtgccagacggtcctctcttgcccrgtaaggaggtgcttcatcttcaggcctgtggtggcatagcagccagagtctgtgcggaaccgggtcgtgatcttaaaccttccataggtgacagtgttgtgcctggaaccaagtcgtggccagtacctaaagctcttctcccttccaccctcctgttaaagatgagcatggttaaatgactcgagatccggcaatggatgcctttctcacatagacggcacatctgaaacagaaccacaaccctaccctgcctttttctccacaggtcaggattccagatgattaacattaactgttcttcagaggctgagaaaatcacttaagagaartaagtacctacctcttctgctgtcaccattgctataattgcaattccctgttcccataccatctgccaaaaatcttgacaggtattctgtaatggtccctgtgtggcaatataatcccattcgattccactgacagagacctgggattagaaaaggttaaaaaaattgatgtgtgggtataatatacataggtatgtatgcatgcattcatggtagtactaaaaaagtttttttaaaaaagtaaaaagtaaaaaagtagtaaactggattattcagcagaataaggaaagacttttcatcttttcccttgtgaatacaatttgcattactgacatttttataaacttaggtactgtgaatatacataatatctatgcaacctgtttaaccttgctgaatgtcagttctcatttatacaataaagatactgcctaccgtcatagggtcattgtgaggactgagtcagtatctatggtacctggcacataactcaataagtagctgttattgcagacatggtgcctcttctttaaaaaaaaccttcctacttaagatagtctcacctctgaacttctgagtcaaggtcactctccacaataatattaagtttccacttcagatttaacttccttgagagcagtctaatacaacagtaattactagatttgtggttaagagacctgggttaaatcttggcttcaccaatattgagtgacgacaataactgtctccaaacactcactaaacgtaaaacccagtgccaagccttgtgccacacgcactctcactcagggctgccagccccctagtcaccgctccacatcgtctcactgagcacccagtggctgccactgtggatgagtaccaggttataacagtgaataaacactagggaggaggaggggactagtgagaagctggcagggtaggtgtcatcatttatttatttccatgtaagtgagatgaggtcccacaacacagcttataaagtgaggtcccacctcattttagatctaggcgtcagacccaggtctatcaaattctttcctctattctgcaagtggctgctgaagattttgaaatatcactacagaactacagtatcattcattcttatccatctagtcatgagagactggatgagttatttcaaggaaatgctcggtttttaagtaaattatgctgatattatatttaaaaacaaaatagtatgtgcatagattcccaaaagccatcaaggggtactggcattcacaggcagactgccagtctccagaaagccttggtgtcagcttgttcccttctcaaataatacttgcaaactaaagaaaaaaaccaccacctgtccacagttactcattcactcaccatgagatttctccttcccaaaataaagaattgaatgtggccagcatgaacaaagggtacaatgaggaagagggaacatctggctttattccatcatgtgttgtgaatcatcattttgtccattttcataggagtgatattaccccagataaggtgccaagaacatacactagggaaggacagcctcttaaatacatgggactgggaagactggatatccataagcagaaaagtaaaactggaccccctatctctcaccataaacattaccccagtttaatggcattatactggttccaggaaaaaagcacttcttcaaagaaaaaaatgatacttaaaaattattataaagagtatgtaaagagaacagatggcaccttggtaagttgaaagcttttgtgaacaccatcaaaaagcccagacacttttgttacataaaaatgcatgtcagtatgtgatgaggaaaaactagcaattcagtggctcccagaatttatgagctaaaaagaggtcttcagatttagaaggacaaagttctaaagccaggcaacacaaggtcaaggctgtagggagccatgatcataccactgcactccacctgtctgggcgacagagcaagactctatctcaaaaaaggcaaaagaaaaaaaaaaaagccgggcaaataagtgcgccctgagtcctggtaacagtgttgggggcagagtggtttcgcacatggagagtagacatgactttggctctgtctgatagacgctttttatctagcactggtatgtggatttcccagcttgcagtacagtttgtcacaaatgtttaaaactagggtgtttatctaaaacaatacaataaaaataaattttaaaatatctgaattctaaacagacatgaatacaattcttaccattcttgtaacttaactgaaactgcatgtgctgttgattacttgaggcgttcctctcaccttaatatgtgatgcrttgatgtaaccagtgttgttttctttagttgggaccaactccactctcncatcatcataaggaagaacatcttggaatcgatttctttctgcattttcagggagtcgtgctgttgagcactccccatcaactagccgtttcttaagaattctttcatattctgtgaataccattccttgttctaatcgttgttccagaattttacactataaaacagaatatgtgtaataacatgaatacagccacacgtcgtggctaccttttgactgtatatttgaaatcttgttttctgcttcaaatctagcactgtataatattgaaaattctaggttgggcacggtgtctcatgcctgtaatccctgcactttgggaggccaaggagggaggatcacttgagcctaggagttcaggaccagcctgagaaacacagtgagaccccgtctctgcaaaaaattaaaaaacgagccaggtgtggtagtgcatgcctgtggtcccatctacttgggaggatgaggcaggaggattgcttgagcccaggaggttgaggctgcagtgaaccatgagaacctatctcaaaaaaaccaaaccaaaaccaaaacagaaacaaaattctaggtgaaaatgaagttaaaattttaaaaagccacaacaacaagagttaaaagaacaaaagacaatcattttggtgagaaatataatgcaaacttttgtttaaagttgaaaattggcctaaagaaatttgttgaattcattttctctagatctgtggtcaattttgtgacccctaatagatggaattctcctggggaacagtaagtaaatctaggggacggataatgagttccaacagctatgaacaaatgtttccattttatgtcatacgatatataaaagactaaagcagtaggaaatattcgaaactacctccaggatcccgttgtaaagcaaatgtatgcctatctgattttgatgtaataaaacctcatagaaaatacacctcaggcacaaaggaagttttgaaaaattgagaaactactctcgagataaactttcagtataataaaagtcaatgtctgctgcttttcccctgtatgctcctgtatttttgtagatttcttctcactttaaggccatcaaaatcaagactgctccaaaaggccaggagaaggtaaaaaagaacactgagaaacaaacaaacaaaaaatcagcattcgaacctgaaattatctattaagacattagctatacatttgccccaattttgaggcccatattacaaaattccttaacactcatttattattaaattgtgttagaaaattcaccaaaatctcatgaaggcatttgcgtagtatttaccggttgttccagagaaggcacaaagccctgtgtgtcccatacataccctttcatcattcgttgctctggtagccacttcctttccttcatcaggcagaggcactcgagatagggagagtccatttagggcagccagtttaagaggaccaattttttttgcatctactcgagtctttttcattccctgtaaaaggatttatatgtatatatgaaatatacacaaatacaacccctgtgaaaagaagtttcaatgcactgaagaccaggaacacacagagggagtgttctcctttgccaataaacccagaaagattacactccttcacacaccacttgtttaacaaacatkagtaggaagacattcctttcaaggccaaagccctgataaagtcttccagatagaaggttttgaaacactattggttacaaagttctgttgtaatgaaaggtgaggctccaggcagactgcattccttttaaaacaagacagacgtaacaaatcagctgaagtccaaaaaaaaaaaaaaaaaaaaaaaacaaaagctttaaatgcaatcaattgactatagtaagcttttataaattttttttttgagggtctcactctgtcacccaggctggatggaatgcaggggcaccatcatagctcactgcagcctcaacctccagtctcaagcaatcccacctgaacctcccgagtacctgggactaccagcacatgccaccatgcccaactaatctttgtgtgttttgtagagatggggtctcactatgttgcccaggctggtctcaaacaactgaacttaagcagtgttggcctcccaaagtgcttgagattacaggcgtgtgccaccatgcccggacagctttttataatttttaaaatatataaattctttaagtcattctgaaaaattaaatggtttctgcagcagccccctttgtgtgttaagccccctcctcatatgctactctgcattctagtgcagacttagatgacccgggttagatcacgctacctctcagaacggctacgtttttaaacaaggaaaataaaacagggctaaaatctccatcatgacaccaggaggataggacagaagagaaagcatcaacaaaatcttgtctcctgaaatcaagtgtttcctaaaattattattagagcatgattttcctctctgagaatagtaagcataagaacactaagttgaccaggtgcgggggatcacgcctgtaatcctagcactttgggaggccgaggtcaggagattgagaccatcctggccaatatggtgaaaccccgtctctactaaaaatacaaaaattagctgggcgtggtggcacatgcctgtaatcccagctactcgggaggctgaggcaggagaaaggcttgaacctgggaggtggagattacagtgagctgagatcgtgccactgcactccagcctggaggcagagtgagactccgtctccaaaaaaaaaaagaacactaagtttcgttggatatactacacttccttggatgatatcaatataatgagtagccccaactggaaaataatggttctgccctgtaaacaaaatccgtgttattccagctctctcagcctgtaacaggccatgaagccccatgataatggtgcaagaacagagggaaaaggcaacttggtgagagaggaaaaaaatcctaaaagattgctgctgtaattggagactgtgattggtacctaactcaataagctaagtggattaatttttaattttataattaatatttgatcatgagctccccacataatgcagtctagactataaacagcagaggcctgggttcacatctggcctctaactgaccaacttctttcaggcaagtcacctttcctctgtaagcctcacctagacagaaagagacagatatatccagacacaggcatacagactaaacacttcctgcttaggctgaaatttaatgattctaacgtgcagaaaacagtgatgtgctggtaatatttaacaacaggctcttggaaggaagttttgatcggtgtttgcccatatccatggtgtaaatactcccatcacagccaatttcaaactgttaatgtcacatcaattggctcacaagattcctgaacatttaagtcggctcttgctagtcaatatgaactagctctggcacttctctgcctgaaaatgactcaaaatatcccacactgggacacgctggataaagctgattggctgtgaggtcagttcaaaagccagtattggaagaatgttgtatgtagtcaaaactagccttgaatatgccttaattagcccttagaatataagcacaggattttaatgcataccctgcacagtgatttcttatgtgagaaccactgcactaaagggtacaacaaaaagaaaatctttatgtagatatatgagcacccaaaccagtctgcctttaagataacaatcaggttgctggaggtggagatgggtggagaattctaaaatcattcctacttgtctacagtttatttcactgtttttaatactaaacctccataaccttaattcacattaggaaatttgttgtaacgattaagataatggcaaccccatgttactatgaaaggtcagagggtacaatagggaattggcctcttccactcttgaaagccattaagttaaatatatgatgccacctcacagtaatgttaatattgactaatctctttcaatgt

SEQ ID NO: 10678 - DNA, 15669 bp, Homo sapiens
tagaacacactccctgtccacccctgtctccccaggcataaggctttcattccaggccagtccttaggcaccagaatgcctttggtttccgcataaaggagatcccttctgtctccccttcaagtcctctggatctgaccttgggaaacaaatcaggtgtgtgcagagttggctgtgccacattacagaatacaagaaaagtcttagcttaggggcttcttttcagttctgatagtttttatctctctgccttctggttagatggtgggccattgccatggtgggggcctggagaaggcagactggcaggtggcaccagccacagcctggctgggagtgaaggaagttgttttggaaaagggaccaactccttggatgcctgtgtacctgttagaaatgaacctttactgcacactttccacaagatgaaaaaaaaaaaaaaagaaacaaacctttactgtgttataatggacaagcctccatttcctctctgggcctcaggttttcttttctttattttttattttatttatttatttattttttgagtcagagtctcgctctgccacctaggctggagtgcagtggcctgatctaggctcactgcatcctccgcctcctggattcaagcgattctcaagcctccacatcctgagtagctgggattataggcgcccaccaccacgcctggctaatatttgtagttttgtagagacagggtttcaccatgttggccaagctggtctcgaactcctgacttcaagtgatcttcctgcctcggcctcccaaagtgctgggattacaggcgtgagccaccgcacccagcctgggcctcaggttttcaattctgtaaagtgttggtgctggatttgaccgttaagactgtttttagcgcttatgctctgccacctccaccctatgcccctagactatttgtgacgaaagaagaaacagcaaacaccaaaccagctgctcagaggccacatatacacgcatgatttcataaaaatgaatggatggttgctgtgggcaatggagaggagagacagggtaaaggggtagcaaaaacttccacctagtttttgctccattccaagaactttaaagccagaagggtggattatgaatgttagaatagaactgcctgttacgcatgtagtcttagacagggtataaggctgcgatcacctgaactctttttggcttctttagtccacctcacatgaacatatacagacacacatatacatgcacccaatcatgatgttcacaggagagagtactcttccctgctgttagaacttctgctcatcaggcggctgctgccacttctggctctgccagacacatattctaaatcacagagctattctccctggcacataacccccgagcaccaacatgtaaacagcagcctgagggcctgaactcagtgcattcagaggcccacagacgctgcctgcttccaagggcacagaacaaaggtcatctgggggctgagggccagcgcagtgctctctctgggcaatgtacacttctatcccgagttggatgacctctccggcccaggcagtactaattcccctcgggccagtcattaggacgacttcccagaacagtaggccagctgtctccacccctctgctgaccatcaaaaatgaaggtgagagtataattgggtacatccccagggaagaccatttggcagtatctttcaaatttgcaaatgcatagaccttataacatagcaaaatctatttgtagaatatactcacatacaggtgaaatgacatgtgtttaagttattcattgcaacatcatctgttagtaaagataagaagtaagctcgatgtctatcagtagcagactggtttcatagacaatcatataaccatacaatgggatactgaaaatgagatgcttttggctgcgcacggtggctcatacctgtaatcctagcactttgggaggcccaggtgggtggatcatcagaggtcaggagtttgagaccagcctggccaacattgcaaaaccccgtctctactaaaactacgaaaattagccgggtgtggtggcacgcgcctgtagtcccagctacttgggaggctgaggcaggagaatcgcttgaacctgggaagtggaggttgcagtgaatcgagatcgcaccactgcactccagcctgggtgacaaagactctgtctcaaaaaaaaaaaagaaagaaagaaagaaaaagaaaatgagacacttttgtatatctatctggaaggatcacagatacatagtcaaattaaaataagcaaggtgcagaacagtgggtatatatgactgctatttgtatagaaaagaaaggataaaagaatatatatatttgtattgacttgtatctatataaaatatgagccgagggataaaccagagactaatggtagttacctgctagggagatgaaaactgggatgaaggcaagtctctattatatgcatttgttatattttgatggttgaataatgtgcacgtataatctattcaaaatattaagttataaaacacaaaatcacaaaagagacccaatagtctatagactaaggtggcaaaagagggagcccttccccctgccatctgcttgggcgggggaaaaccagactgaggaatgagagcagggatgagttggcagaggaggaagaagccaagtgtctcaacattgatggatttgctcataaaaccatccctaaccggagtcagaaatttctcttcttacagtgtcgtttggttattggcctaatcattccccaaactcaggcacactcaggtggtttgagaaatcctgtcttttttgaaaatgttaaacatttttacacacttcttccaaattacaaggtcacccctaaggcattgacatcattgaggttgcttcactttccggcacccctttcccttccccctccaatgctgatgtcctggaaaaaaattgctgaatggcatgcattgattttggagattactttttgggaatcttatgatatccctttgagataactggcaacaacactctggggtgctgcaaaaccctacttgggagtgactgccttgctggtcaacaggaagccacagccaagactctgtgcccagtggggcctgcaccactctgtcatgacttgagtgggggcagtaagaggtggaaggggccagaggctgcctcttcactttcacccccatggatttccatggatccaaaggcctgcttggggttcttcatgggcatagaagtcacttgcttgggagcccaagacaaaccctgctcatgggtgagcagctgggtccctgggagacgaggctggttctttttccttsgggataattttaggttctgaattcccctgcaaccttcctaactcccagcccccagctcagcctcccagagggattgttcatwccagtgactataaagtgttctctcgaaatatagagctgttcagagacctgccagggcatagccctggaggcattttccatgataatttttccccctttgtcccattgtttcagaggaggaagcatgatagctcaagaatcaggtcctgatagtccctgataaggtgtcacatcttcctgcctctccacttgaaccctggggctttattttccagcgcccccctccccgtacgcaatctgagaggaactggtttagagattgagagagcaggggctggaaaaaggaagccttgcaagtcttgagtgagggcagggagaagggaagaggaagagggaagcctctggtggaaccgcctaagagacttcagaggctttgaaacaccaggcctgccaccacacacgctcaaaaatgaacgcatgaattcctcaactcaacgccttctagtttttaaaagttaatgaatgaaatccttaaggaagtccggacacggtgactcacacctgtaatcccagcattctgggaggccgaggcgggtggatcatctgaggtcaggagtttgagaccagcctggccaacatggtgaaaccccgtctctactaaaaatacaaaaatttgctgggcttggtggcacatgctcatcccagctacttgggtggctgggaggcttgggaggctgaggcagaagaattgcttgaacctgggaagtggaggttgcagtgagcagagattgtgccactgcactccagcctgggcaacaagagcaaaatttcatctcaaaaaacaaataaacaaacaaaaaacctaaaggaagtggagcgaacacttaccattggggagatggcaatggaagagttgtgtatagtttggggggatggtggacctgcctcatacccagtcacccatttacccatttttttttttaaaatagggtcttgcttcttgccgtcttccaagctggagtgcagtagtagcatgatcacagatcactgtaaccttgaactcctgggctcaagcgatcctctcctctcagcctcttgattcatcctttcttttttttttttttttttttttttctgatatggagtttcgctcttgttgccaaggctggagtgccatggtgtgatctcggctcactgcaacctctgcctcccaggttcaagagattctcctgcctcagcctcttgagtagctgggattacaggcatgcgccaccacacctggctaattttttttttttttttttgtatttttagtagagacagggtttctccttgttgttcaggctggtcttgaactcctgacctcaggtgatctgcccacctcgacctcccaaagtgctgggattacaggcgtgagccaccgcgcccacctgttgattcatccatttttaatatgtctttatagcagaaagattttaagagaaggggctatctagaaaatctctaggtggaaaggtgcatggaaggggcagtgcagagtggggaagatggagaaattgaaattcttcagcatcccagactacatagtgccaaatccaaatgcaaatccagagctagcaatgaaaaagactcctggccgggcgcgatggctcacgcctgtaatcccagcactttgggaggccgaggcgggcggatcacgaggtcaggagatcgagaccatcctggccaacatggtgaaaccccgtctctactaaaaatataaaaattagttgggcatgctggcgggtgcctgcagtcccagctacttgggaggctgaggcaggagaagcgcttgaacccgggaggtggagattgcagtgagcagacatcacatcattgcactccagcctccagcctgggtgacagagcgagacgccgtctcaaaaaaaaaaaaaaaaagaaaagaaaaagaaaaagaaaaagaaaaagactcctgagcctcctagtggttcacgcctgcaattccaactactcaggaggctgggacaggagggtggcttgagcccgggagttcaaagccagcctgggaaaaatagagagagagagagacttgaaatatggtaaatttcctcagtacctgaaaatattaaaaaaaacaaaaagctagaaggaaagagaaggtaactgaaacagaagggaaaggggacagatctcaccaagctgaggtcttgggagaggagatactggctgagccctattacttaatttaaaataccttaggggaggccacccaagtggatgcggggctcctgtgaatcctttgcttgactccagcgggttacctttgcctctgatacataaagggtggggatgggagcgctctcctctctccttcccctgccttgctgtgggaacttctgggaaaggaggtgcagggctccaggaagccagtgcccagggagtgctatgctgagtccaggagcctggccacggcaggggtggacagatggtggcagaggaaccacggtgtcccttcctccagatttagctaaaggaaacgtggagcatcccattggccatcctccccactctccaattcggctccagaggcccctccagactataggcagctgcccctttaagcgtcgctactcctcccccragagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctyacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgccyggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggaygtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacgggtaggtaaccgggkcagagggaccggcggctcagggtcgggaagcatgcgatgtgtccgtgggtcaactttttgagtgtggagtttattaagagaaggtgggatggctttgcttggagagaaaagggaacgaggagtagcgaaccaaaatgggacccasggtccttttctttccggatccagtcactagggtagaagcaaaggagggcgagcgggccgtcgttcctcacccaaggacccaaggtgcgccaccggaaagcgctgcggtgtcccgaggactctcgcctcgcctggtcggctttagggattttttttttttttaaatagagacagggtttcgtctctgtcgcccacgcgggaatgcagtggygcgatctcagctcactgcagtcttgaactcctggctcctgggctcaagcgatcctcccacctcagcctcctgagtatctgggactacaggcgagccccaccaatcccagctatttttaaaatttcttgtagagatggggtcttgctatgttgcccaggcttgtcttgaacttctggcctcaagtgatccttctgcctcagccttccaaagcattaggattacaggccggagccagggcgccgggtcggctctagttttggttttccagctcagttctttgcccccctcccccgatttcttgccatcactagacctggctcggacttgaaggcagggctagtgcccccccacccgccccccaagccctcggcctcagttctgggttttctcaaaggtttgacagctgtggaggtgagaatccacttcyggtatgaagtacagttgtgagtgaggagcctgtgagtgcagatgtgtgccctcccgctccmtgggctgggttggagtagggatggggtggggcgtgtgtggctgggtggtgccctggcgtttttgtgtaactaaatatgcgttccagggtctctgatctctgtcattcccctcagtgcacctgttgctcctttcaccccagggtctattatctccactttttttcccagggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccagstgccgtggagcagcaggctggctttggtaggggcacccatcacccggcttgcctgtgcagtcagtgagtgcttagggcaaagagagctcccctggttccattccttytgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttacaaatttgagcctgttgatgcagttttctcttatttccattttatgaatcttatcagccaggtttcctatgtaaagaaaatttctaaggaaatcattagatcattttgtgagtttctatttaaactctatgagccaagactattgtccaggatgatttatggaatgcccggtaaatcacagatgttttgcgtgtttgtgatgtagtgcgcaatgtgttgtcttggttcaggggccctagagttataaaattccatctgccccaaggaggagctcgatagatttccacatatgggtgttccctgtgaattggacctggtctgtgctgctctcttttctccaggagcccaggttttatttctcaggatgttttcataccaaagatgactttctccttttcaaccagggcagggtgagatctctggtgtctgaggtgtgcaagatttcttggcaaagactcaactttgtggctgttagtggaggaggaagtcttgcttgacaaataagaggccctcctctccccatctctggatattctcccaacatcgctggataaaattggccagtcagtgctaggcaggggagaatgatgatgttggaggtggggcccctggtgtgtagacttgtccttgaacattgtccagaagctcatactgcttgagtcttgttggacttgcccgtgcgccagctgtcacactcctttgcagtgtttagacttgtgctggggctatggattccatctgcagattgtcagatagaatctgacagtctggtcatttctccagcaacttgtggccaggcatcaagtggagggagatttacatccttggatgggagcaggctgcttttgctagcatgaggcctgagcacttgaactgtagaagacaaacagctgtcccctgaacccagagatatgatgacttccaggcccgtgagaacaacagagtccctagagccgctggcctccccagagtctgttagctggagctgggcatgggacagaaatgacatggaagagagggctgagttggaggagagggaatgaagagcgggctttttcagagctgacctaccctctgcatcaagtggaactgagggggaacaggcagaatttgggtacaggaggatgtggggggctgactttcccagactttcttctggggaatggaggtaggtgcaggctgtggtcctcacgggcagtccctgggccttagtcccatgctgactgcatcctcaaccctaggagagtaggagcagctcctctcctctgtgtgtttccattgcaccctacatggtcctaggagcacaggggaaggcatgggaatagcgcttcttactgttttcatcttaaaactgcctagatccaggccttttgaaggcctcttggcgaaggtatgtctacacactgtctgtgtttgggtgtctgtccagaacggggaaatgggagcctgccatggcaagcactgctaatgctctcccccacacaacaagccctgggtatagtctgcctttggccagtgagaagcagctgaagcataacatgcaattcagtttaatttgaggccgaggtgggcggattacctgaggtcaggagttcgagaccagcctggccaacatggcaaaaccccgtctctactaaaaatacaaaaattagccgggcatggtggtgggtgcctgtaatcccagctacttgggaggctgaggcagggagaatgcttgaacccgggaggcagaggttgcagtgagcctagatggcaccactgcactccagcctgggcaacagagtgagactccatctcaaaaaaaaaaaaaaaaaaaaaagggacaaggaaaaagacagtctcatagaaatcaaataacttccttgtatcgactctcaccccatctaccagattccaaagtccattttctcttctctatatgcactgcttagaagcagttgtgtgacactgaacaagtcacttagcctttctgactgtttctttgcctgtgagtcaactggagattacatgatcactctactcagctcatgcaggctgcttttgaagacccggtgagacactgtgtgtgaaagtggtttggaaactgaaaatgcttctccggtataaagcggtgaaatcagaatctggagcttggatgagtcccaggtctattatagcagggatccccaacccctgggccgcagactgctactggtctgtggcttgttaggaactgggctgcagcgcaggaggtgagtggagggcaagcgagcattaacacgtgagctccgcctcctgtcagatctgcggctgcgttagattctcactggagcgcgaatcctaaagtgaactgcacatgtgagggatctaggttgcatgctctttctgagaatctaatgtctgataatctgaggtggcagctttatcccaaaaccatctccttctcccctgtccgtggaaagattgccttccaccaaaccggtcccttgtgccaaaaaggttggggatcactgtcttatagggtcttgctctgttgcccaggctagagttcaggggcacaatcatggcttattgcagcctcagcctcctgctcaagtgatcctcttatctcagcctcccaagtggccaggactacaggcttgcaccactatgcccagctaattaaattttattttttgtggagactgggtatttctatgttgcccaggctggtcttgagctcctgggctcaagagttcctcctgcctcagcctcccaaagtgctgggattatgagcatgatccactgtgcctggccctggttttgctccctgtatattcctgtttctgtcgacagcctgggtcttggacccacttgtctttggtctttgtggacatgccctgcctggtctttcttctgcaagtttgtactcacctcagactgactgctttggttttctgtcctggtctttatacatctccacctctggctctgtttccatgttcagaccctggtctggcccgatattttgctcctggtctggatcaccccatcattaccaatgcaacatttacaacgagaacaattttaagaatgggtaggccaggcgcagtggctcacgcctgtaatcccagcactttgggaggccgaggcgggtggatcacctgaggtcaggagttcaagaccagcctggccaacatggtgaaatcccatctctactaaaaatacaaaagttagccgggcgtggtggcaggcgcctgtaatcacagctgctcgggaggctgaggcaggagaatcgcttgaacccagggaggcagaggttgcagtgagccgagattgtgccactgcactctcaaaaaaaaaaaaaaaaaaaaaaaaagaatgagaagatttagaacagaaggtacttctggatctcaggacattatggtctattatagtagggggttcatgagaatgggaccctaaggaaccagaaaggggagagaaggtggcgtatactttgctagggctgccataacaaatgactacaaactgggtggcttaacacaggaggaactgattctctcacagtgctggagactaacagtccaaaatcaaggtggcagcagggctgtgctccctgtgaggcgggaggggaagatccttccttgcctcttctcttatcccggtgtttgctgacaatccttgggattgtttgactggagctgtatcactctaacttctcccccatcttcacaaggccttcccctgtctgtctgtgcccacatttctctcctcttataaggacatcggccattggatcagggctcaacctaatccagcatgacctcatttgaacctggttacatgtgcaaagaccccatttccaaataaggtcacattcacaagttctgggtgttaagacttcaacaaactttcaaggggacataattcaacccctaacagagggtatgatggggaaggggaagacagaattgctccagacctttccaagcttatcttattcctgctgcttcaaacccccatttctttttctttttcttttttttttctttttttttttttgagatggagccttgctctgtcgcccaggctggagtgcagtggtgtgattttggctcactgcaacctctgcctcctgagttcaagcaattctcctgcctcagcctcccgagtagctgggactacaggtgcatgctacaatgcccagctaatttttgtatttttagtagagatggggtttcaccatgttggccaggctggtcttgagctcctgacctcaggtgatcctccttccttggcctcccaaagtgctgggattataggcttgagccactgcatctggcccaaacccacatttctaaggctctgtttcatcctgtcgccagccaggagggtggcagaggtgctcccattcctggatttccattgctggggctttcctcccatctccctgggcccagattgaaggggtcgtttatcaaatcagaccttgcgtttgctgtcccttggagtagaagttgctgtccactctccattcttcccatcttccttgagtagtagaaaatttaagttttagctggaaacacagcctcctagctaaaaacacttggcagcatttgcagtatgtggtggcacacacccgtagtcccagctactcgggaggctgaggcaggagaatcgctcgtacctgggaagtggaggttgcagtgagccgagattgtgccactgcacttccatctgggtgacggagcaagactccgtctcaaaaaaaacaaaacaaaacaaaaaaacacttggcagcctaacttgcggataggcatggccacgtgactaagtgctaccagcagaagtgtgcagcactggctggaatgcgggtatgatggtgagaactgaagtagccgcctgtggtcacaagacggtaatcatgtgttgtggatgtcagaggaaccagatggaaggagcctgggtctctggcagtgtggagccaccattttggccctggactgcttatgtttaagacccttaaatgaaagagaaataaacttctggccaggcacagtagctcatagatctcatgcccattttcaaggccttatatccagctccacaaaccaagccacacagggctgggcacagtgactcacatttgtaatcccagggctttgggaggctgaggcaggaggattgtttgagtccaggagtttgagaccaacctgggcagcacagggagaccccatgtctacaaaaaatttttaaaaatgtatctgggtattggtggcatgtgcctgtagtcttagttactcaggaggctgaagtgggaggatggcttgagcccaggaggttgaggctgcagtgagattgcactactgcactttagcctgggcaacagagcaagaccttgcctctaaaaacacacatgtacacacacaaaaactgaaataagcttatatcttgtttaagccacagttactttagccatttttcttttcttttttaacggtagctgacctgaacaaatatatcagccaaggagtgggaaagaaggttataccttttttagggtatataggttatacctctggggagaggcatggacatcttcctgggttctgcaatgagtgtagcttaggttaatctagccataaagcggccttgctctggtaccttgcagggtacctctgacctatgagaaccaacatctctctagagtctgagtttttgttgcacctgagaccaccaagtccatctccttgacattgattcttatggggataattatcaataagtatattagcttcctgagactgctaaaacaaattactacaaccttggtggattaaaacaacagaaatgtattccctcacagttctggaggccagaagtctgaaatgaaggttttggcagagctggttccttctggaggttctcaggggaaaatccgctccatgcccctggtggcttctagcttctggtggctctggcagttcttggcattcctgggtttatagacatgtcactccagtcgccacctctagctt

SEQ ID NO: 10679 - DNA, 232882 bp, Homo sapiens
  misc_feature (1)...(232882): n = A,T,C or G, or insertion/deletion polymorphism (see Tables 1-2)
gattacaggcgtgagccaccgtgcctagcccctaatcttttctttatagtttttttaaacataaattttgtcaccaaactgtatattttttaaacttgaacatattctgtgacttgctttttttcaacattttcatttcttctatgataacccatgttgctgtagttcatttcttttctctgccatttagtaagcaattcattgtgtgattattcttggtttatctattctgttaatgaatatttgatgtatttctaatttttggttcttggaaacatactatcatgaataaatgtatataagaggttaaggtatatgcctagtggtggagttgctggtaatgcacattgttttccaaagtgattttctcatcgcttaccaggagtgggtgagagttcccattactgccacttgcaatgcttggtatgaacaggtttttaatttttgctagtctgatatttgtaaaatggtatttcatgtagttttactggctattatcctgatgtttaataaagttgaacatatttttctatattcatttgtcttctgtaaaatgcttatttagaccttctgtatatttttatcttgggttttgaggtttttttcttattaaatcagaggagttcacacattctggatactaatctttttttggttatatgtctgttgcaaaatcccttctctcggtttatgacttgttttttcaccatctttaggtatcctttgaagaaaattgagttttaatgtagttaaattttaccagttttgtctttatggtttgagccttttatatcatgtttaagaaatcttctataccataaaattggtatatattctcattattttcttttcaaaggttttaaagtttacttttcattttgaagtctgtaattcatctgaaacttaatttttgtgtatggtttaagataattataaatattatgtattcagcatggttattaaatagttactgtgctcttatttcatttaaaatcaagcttgcaagtagaagtctcaggcaacagattaaaccagcagtgactataaagctacaccttaatcaaaatggagatcacaacaccaaagttctgcagacagacccagccaccctgctccatttggttcawcaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactcttctctccagtatgacccaggtttcttgactctgagtaatgcaccttctataactatctaaatttctactgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaatagttttgtagactgaggatctcattattttacagccttgaattatgtcctgtatactctgttaaagaaactgggaaaaaaatgccaactggttgtttctgggtggtggaattatggctgtttcttttcttttttaatttctatagtaagtttgaataactttcataacatttaggaaaaaatattaaaggaaagaaaaaagatcagggaatttaaatatatttttagtagatatttttatccaaacttaattcttagaatgataaacacatagtttaccagaaaactcagctgttcaaaactactcagtccccaaaggactcaggtaaacaggctgagggttttatatatagagcgctctagagtttcctttttctgtcatttttttctccatgttagtgaaaaaaacatgggaatcttaagacattaagccgtttctccttttctaggtaatattacttctaaatggagaattgtttgtgttgtttttcatctcaaatggaaacagtatttctttgaagtttttcacatcccttatgatcaggaagttctgtcagctgctatattaaagtcctcctgctataacttactcagtcttctctgtacttatatgaatttgattaagtatcttcttttccagagtttccataatcatagattactctcacatctttcttccaccaacagtagaaaatattttggtggaaatgttatgatactacattgcctctaacttaaatatgttcacttttaaaaccatcatgactgttatattcaaactcaaatacttttcttagaacaaatgaacctaactccaccattaacgtggttagttcagtaagctttatacattttgaaagtaatgtttgaattataaaagcagaataagcccattatttttcagctttcaaaaaattatataaagatgagaaaaaatactatatggcactaaaatgtgtatttaatgatttgatcacagagtagtaatggctctttgttctagatttttacagctcctctctacccaggaactccatctataacttaagtatgcacaacagccatgagtccaaaagttttgacataccataatgggcgaatatagaaaaagtaatttcatatccttagtgggttaaaaggcagtatcaataatacaaatatctatgttaatgtgctctaaaactgggcttttacttgagttgttgccattctaaacccaagcaacttttgaataagatgaactttttataattataatgtaaattatgtttgttatcattagaaatattaccaattatatgaccaccagagtgagagactgtgtttttttattgtgcttgagcctaagttgacattttttagttgcaaagactacacttttcattttcttctcttgcagttatcatatcctctgttgcagaagagtctgcccagcagccaaaaagggaaataacacaaaaaagatttgtgccttatctcaccaaccatatgaggccttttaacttttaaaattttttttactctgctctgttacactaagctataaactacccacttatgcatggcattatattgataacaaagcacattttgaaatcttttctggcttttttacatggtacagattcagttttgttaatagtaggtacttagagtgacccatattgtgtgttgaacaaaggataaagttctagtctcagaatttagaatgctcttaggctgttccatcctctaaaatagtttaatccataagctcattaggctgcagaaaggaatctcctgagggagttattctgaagaagggaagttcctctggtctggtgtctactagaattgcttttccttgaaactctgccttcttctggaaggcagaaatctaacatgattcaatggctacagctgtggaagtgtgcagaggaaaggtgaaatcattatagaatactgaggaatactttgacagaaattatccttactctttttccattgaagtggggtcccctgaggtaaccagaggtgtgatgggaaaagcaaatcaagttattttttacctgtgtgccaatgttgtgattgtcataagtccaatgagaagtggatgcctgtggttttgaaggaatgtgcttagttcacagaacgaaaaggcttctcagttaactcgaagactaaaagcacacagattaaaattcagagaatgaggaaaagaaaatccagggaagtctgagtttcattggagcaagtatagatggttaggatatgatttcctggcatggtctgaaaaccatattctttcattccaaataaataaaaaattcttacaaagctcaagtgagtttaagtgctgcaccataataaaatggcttgatttgcagctgagacttggcacaattcatagactaaaagaagagcttaagaaaagctacaggcattttttttttttttttagtatttggggggaaaaatgagcaagtccccatgtacttttcaaaaaggcaaaaattatttatctcttggtatgagcaatgtaattaaaaccttttttttatgtttaggctttcaagaatataattattgggtattcttttctatgcttgtttcatctactctttgtttttaccaagggataaatactaaattccatgcctttcttgggcccttaaaacaatttattttcatgccaaacctctcattaagcctcctccctttctttttaaaatttattttttattgagataaaattcacataaaatttaccctttcaaaatgtacaattcagtggctttaggatgttcacaaaattgtgcaaccattaccactatctgattacagaacatttttatcatacccaaaagaaacctgtaattattagcaatcactcttcattttcccttcttctagcaaccactaatctactttctgtagatttgcctattctggatatttcatataagtggaattatataatatgtggccttttgtgtctggcttctttcacttaacataatgttttcaaggttcatccatgttctagcatgtatcagtatttcatgcactttatgactgaataatattccattctatggatactccttttcacagtattttaacaagccttattcttggtcttactgtggattataatccattgcagtgtattttatgttcataaaagaactaactgatttagtaacatattttctataattatggctttttagaattgtcttcccagaatggtggctcacacttctaatcccagcacttaggaaggccgaggcaggcggatcacttgaggccaggagttcaagaccagcctggccaaatagtgaaaccctgtccctactgaagatacaaaaaattagccgggcatggtggtgggcgcctgtaatcccagctactcaggaagctgaggcaggagaattgtttgaacccaggaggcggagattgcagtgagccgagatcgcgccattgcactccagcctgggcagcaagagcaaaactccattaaaaaaaaaaaaaaaaaatcttcccagatacaagttggaagagtctgagagcaatttcttcttagccagttattagaagagttattttccagtggattgtgttttatttttagcctgattcaaaagttataccagctaggaagttagatgaactatcgaagagacttagctaaaatcagctctaaagaaaattggaccagtattacagtcagtctccatatctcaggttccacatctatgtattcgatcaaccacagatcaaaggtattcagaaatacaaaaataacaataagaataatacaaaaaaatttaaaatgtagtataacaactatttacatgtcatttacattaggtattacaagtagtctagaaatgacttcaagtatagggaaggatgtgcataggttatatgcaaacatgatgctccttgtcttatgatggatttacctttcgatattttctgtttacgatgggtttatccagatgtagtcctgtcataaagagcatattgaatgcgtgtatcaccatcctaaagtcaaaaaattgcaagttgaacaatcaaaagttggggactttctgtactacaccattttatgtaagggacttgaacatccacagatttttgtatcctcaggagtcttaggaccaatcccctgtggataccaagggacaactgtatatcctttgaaattttaacttaatagattttctactaaagtgagagatgttgtgggcatttggcagatttagaaaagataggaaagcaactgagtatttatgtcttcctatagtcatcttgtgtttttcaaattagaaaggtaaaaactattaaaaatttctttgtctatagtggaatagagaaaagggcatttgcttttccataagttcatgcctcagaatattctaaacaaattttgaaatagccacattgggagatctttaggacactgctccccagattatgaagctgcttcagccactgccttccaaagcttataagctactggaggaaatggaaaggtacataaacatcatcagttcagttagagtgtgttaggcagatgaagagctacaacaaataaggagctctgcatttataagagaggagacattagttgtcactaagggcatcaagaaggtgctatttttactgatcattttgctgttttgattataccccaatttacattgtgaaatatgctcttcccaattggctatagttagatgggactgtcagacatgggaccatgctccctgctatccacactgagactgtaagtctctcctggaactctgaaaccctcagacttaaagagaatggttgacacaaattcattttagtggcctggccagatgtttgatggcctgatacatagcctcktgaatctgctcctgttcctgtcctttatggaccaggtcttaggtctgtcccttaattctgcagagtacctaatgcatttccaaaaaaatcattctctgcttaggttacagttttagggtctaaccctacatggtgtagagtgtaacaatacaattacattaattttgcaaaattgcatactttattatacaaaatggaatttttgtaaaacagctccacaaattgtcattatctacaagttaggcttttttttttaggataaacatacattggctgcaacaaactcatagttaagatctcacagtgtgattagggagacaagattcaaaatatacaactttaaagagcatttttcttttaatgtcctattatttgctttctgtactttatcatacctgtaaattcttgtctctgtaaaactcaataatctggtggtttcactgtaattctttcagtattaatatattgtggtctgcttgtagaaatatgatttttaaaaaaagttgggcatgagggctcatgcctgtaatcccagtgctttgggaggccgaggcaggaggattgtttgaggccaggagttggagaccagcctgggcaacagtgagcccccatctctacaaaaaatcaaaaattagccaggtgtggtggcatgtgcctgtagtaccagctacttggcaggctgaggtggaggatctcttgagcccaggaggttgagactgcagtaagcagtgattgtgccactgcattccagcctgggtgacagagtgagaccctgtatcaaagaaaaagaagataaaatattaatcatcaaatgaaacagtgcctagaatagtacctggcacaaagtagttaaattaatgaacaagcgaatgagtaaataagagtgatgagcggatagtacgtacaatatactctgtgcatgggctactgagctccacaggagaacatgagcaaaaccacacagatgatcaagtttatacattcgttgtcatcaatctcaattaaacccttaacactgactggctgtcttactgtttccctagttagctgtctcccattttcaacagctattccaaaacttctccactcctcttaaacctccaatccacccggcaccccctctcattcttggtagattgactcctcccttctttacagaacaaagagaggtgaccagacaggaattgtctcccttcttctgaccaccaaatatacaattctccctgttccctgcactaatagtcctcttcctcttcccattccagtagaagaggcattcctcacatttctggatcccattcttttctgacacttttgtgacttttacttattcgtcttcctgatatcttatgttagaaagtaagcattttcaagtctatttcatctcaatatctcttgacccacatccctgttcagttaccatacaccctctctngtctccatttcagtaactccttgaaaaaatttacctgccttcccaaacccatcttgataacatttccaggaacttccgtgttgctaaatctaatgcatacttttcaatcctcattttaatatacctatctccatcctttgttttcttattttcttttttgtcactcttctgttttacatgctacatctctagcactgcattattactctttttgcaggactcttttctatgctcctcttagttataagtgttccccagagctttatcctaagccatttttctccacacattttactaggtaatttggtttattccctaggctttaattaacatcagtttgctgataactatcaactatagatgtttagcccatattgctctcctgaatttgagacacatgtacctaccacatgtctacacttaatgtctaacaggtacttcatactcaaaattcatcctctcttacaaacttactcttyttccagtgttttctattcatgaaatggcatcaccatccaaacactcrctcaaaccagagacatgtgtcactcttggcttctctctggcttcttaaccacagctggtcaattaccaagtcctatcaaatctaccttcctaaatacatcttgaattcgttcacttctatccattgcccccatgctcattggtccaccattatctcttgccagagctagtgtatctgcctgcagttaactggtctccctgattttctcttgtcaaaccccccataccccacaatgcattcccattccttgccccgagtcacaattgtcttccaaacatagaaatcacgttctttgaatgctgaaaactcttcagttgatttacattgcctttttgataagatccaaacttctaatatgacctataaagtctttcataatctggctcctgcctttatctccagcctcatttcttcttyttttttttttttttttttgagatggaatcttgctttgtcccccaggctggagtgcaatggcacgatcacgatctcggctcactgcaacctctgcctcttgggttcaagcaattctcctgtctcagtctcctgagtagctgggattacaggcacccaccaccacgcccagctaatttttatatttttagtagagatggggttttttaccatgttgatgaggtccagcctcatttctctagtattctcccctcccctactatgttcttttagttccctcacttctgtgacattgaactcaaagcttctgccatctggaccttcctccatcatctaccaagttaactcatgcattcttctggtttcagcttaaacttcctttgctccaggaggttaggagtccgtgctctgtgcacatagtgctccatgctgccttatcataggtgcattagattttgctgtaattactaggttaattttctattttttgtggactataacaactgcgtttttcttgttttcctctgtattccagatctgtcactgtgtctggtacatggtaagtttctattaaatgttgaagggtgaaagggagcgagagagaaaggattataatatggaatagagtacaaaatttgcacacattttgcttttctgtcacatcagtatggtttgcattaacctcacaagttacatgtcagctttttttttttctttaatggaaagacatatttaggacatgttgtctgcagaccccactgaatggacagaacaagatacttagaccagtggttctcagccgaggctgctcactggaattacttgagaattttttaaaattctgattcctgagtcccaactttatagattctggtttaactggcgtggcatctgttaaagctctccacgtgattctgatgtacagcaaaaattaagaacatgacagttttactacagccatttctctatgacttgcttcaatgactgatattcaagccggtcgaagaacaagaaaatcaaacagtccagattcagcagaaccctgatccacccacgtgctttcaattacaactaaaaatngctggaacaattaaaaaagagtttgttggtacaaataactgtcaagtccagaggtagtattggttcaggcaaacatgatccagtggcctagagatggccccaatgccccagtatctctctgcttcgctttcctgtcttcgttttctttctcctaatttagactcttcttgtggccataggtggctactaaaggcaccaggaaaatgagcccgtctttgtcattaacatcataagaaaagtctttcagattcactttgattggactggtttaggttaccaaccaattgctgcatttaagaggttggaatatagtaggagtagagtcctcttcccaggaaacacagcaatccccaaatgaaagtgggatcttttagaaaggaagaagggagataaatcaatgctgagactatcaatgtctgctttacccatacagtggttttggctggctgcagaatttggtcacaaaactgtagcactactttatagtacatagtacagtactataaagtacatactttataagtaacccagatttctacatcaattcccacagttaatgactactaaaaaactaagcatgattagattaatcataacactgtttagtgagaagaacttgagaacggaaaattgatttggatcctgcaaacttaagttgccccacgtatggcttttgtttagtgcctcagtaaacaatgttttcttgcttcattttgaaaaatgaaaaatcttagattctccagagagagtttgatttgtagattcccaccctgccccctgcccccagctgagtcaccagccaggaacattttgttaaggtttattttttacaatttttgttatgaacgcaagagttttaaatttcccccccaaatattgttgaattataacattggatatgccttttctaattatatatgctaaaagaaaaataccacacacacacacacacacacacacacacacacactcccctaaaatccccttccaggctgggtgcggtggctcacacctgtaattccagcattttgggaggctgaggtgggcagatcacgaggtcaggggttcgagacgagcctgaccaacatggtgaaaccccatctctactaaaaacacaaaaattagccaggtgtgctggtgtggcatgcgcctgtaatcccaactactccggaggctgaggcaggataatctcttctcttttctactgtaatttgaaaattagcaaattttttttttttatagctgtaaaaacaaattcgcgaggagattgtttgataggatcaggggaggcgtaaggatgcggctaaagtagtatatgatcacacggcggtacgctagcgaaatcgacaaggggggggctggcgaagttgcggaaaccgctttgtttttggtgggcgcatgtgttgtaggagacggggcggtttttatggtggaatgagggggatcggcgatagtaggagggggagaagaaactgaacgatagcatttaaagaggttataagatagagatgagataaaaggaggggtaaaagaaaaaattaataggatggtacggcacttgttatcgagagcgggagacgggagagtagtataagggggagagtaaatagaaatgcgggagaagtggaaataaaaaaagagaagtaatcaccgggtgaggggggacggtacgcgaaagggcggcgcgatacggtttcgtagggatggacgaggttggcaagacagatgtggtaaggtatgatacccaacaacagaaaaaataactgggagaataacaagggcgagggagcgagttagaaagagaactgtgagagtggggagaacaggaaagttaaggtgcgcagagaggggatatataagtnnnnnnnnnnnnnnnnnnnncgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgccttggcctcccaaagtgctgggattacaggcgtgagccaccgcgcccggcccaggagaatctcttaaacctggaaggcagaggttgcagtgagccaagatcgcgccactgcactccagcctgggcgacagagcaagactctgtttcaaaaaaaaaaaaagtccccttccttctgcctatcccccagagaagggcaaccctccctagttgaaaactcactgttgtagaactggctgtcaccaactacccttctggttataatttggcttcttaagtttcccatagacagaaaatgtgctaaccagcaaacttggatttgaggcttgctacgttatgtttcccattgcaagttaattaattggcattcatcggcccttagagtcccattgtgtctgtgtgtgctaacatttaagtttctgagttaataaagctgagtaccacattccagaacaaagccccttccataaatctcactagaaccagaggtgctatcccgtcctggtgaccaaccagttattctccaagccaccctcaccagactccttttcctccaattgtactagtaaaatcatttttaaaaaagaaaaaagaggcataaaatagcataggcagaatttaatttaccatctagaaatgcaagatggcacacatctgtagaaacattgaaaggagaacaagacctttaggttgccgtaatcccagggctgattatgagaagttcccttgaagcgagtgcttgtgaggaagaactcagtagctagaatgtgaactttgagtaaatattggccctaaaaatctcagttatcacatgtggaggaaggaaagaagcttgttacaagagtagagactaaattcacccacagggctgcaagttcctttattccagaaaaccacaaagaggaatcttttagtgatgcaaacatcaaggataaagcctttttatttttttagacagggtcatgctgtgttgcccaggctagagtacagtggtgtgatcatatctcactgtagcctcaaactcatggctcaagtgatcctcccaccacagcctcccgagaagctaggactacaggcatgtgccaccatgcctggctaattttttaactttttgtagagatgagggcttgctatgctgcccaggctgctgtcgaactcctggtctcaagtgatccccccacctgggccttccaaagcactgggattacaggcatgagctactgtgcccagccaaagagtaaagcctttgcagagatgttgttttgtttttaactrtagaatatctcaaacttatacaaaaatacatagaataatataatgaactctcaggtacacgtcacttagtttcaatgataatcaactagtgtcaaatattgttgcctcaaaatccccacccactttgctctgtgccccacttctatgtaattatgagtcaaatctcaggcatcatttctgagatggagctggtttagttgaagagcaatcttattctgactggtaatatgaaaatggtcactgtggtaaaagacttgcattttttcagattacagttcccttgtggttaggctgcactatcccagtacaatttcacttgttcttaggtgcatgtgatatctgctgttaattaagggattgtttataggagaataagagcaagtctgaagaccccaggaaaggtgtgcaggccagattatcaccttaaactttagagagctggcctggatttggctggatatgacccatactgggccatgggaggcccttacaaccacagaataaggagacctttattctaaaactgaagaacccagaagtgcatgccatggcatgcaaataccgttacatcagagtaatccttttgctactcaagaggctgaagcaggagcaatgcttgaacccaagagttcaagattgttgtgatctatgatcaggcctgagaaaagccactgcactctagcctgggcaacatagaaagactcctgtctcaaaaaaatttattttaatacaaaaaacctgaagaaccctggccgggcacagttgcttacgcctctaatcccagcactttgggaggctgaggcaggaggatcacctgaggtcaggagttcgagaccagcctgaccaacatggaaaaaccccatctctactaaaaatacaatgttagctgggcttggtggcacatacctataattccagctactcgggaggctgagacaggagaatcgcttgaacctgagaggcggaggttgcagtgagctgagatcacaccattgcactccagcctgggcaaccagagtgaaactccatctcaaaaaaaaaaaaaaaagaaaaacaggctcaggtgccacctgtaagaggaaggagaactggaccctgccatgggagttaggcagagagggttcaggatcaggcctgaamcttctgatatgctgagaagccagtcctgaggttgcaggaggttatttgcttggaggctcgcccctgggagctaaccatcatgatcctgtgggaaagttaaatgttctcaaggagtcctaaagttacttgtgagggaaacctagtaaaagtctagacttcctgttgcaccataggtaggatgaaagtaaaagaaatctactgtcatgataatttccaagcccctttgagtcctgagctaataaataaatgtaataaatacatattaacattatatatatacttttgatgtgggtagccagtttctagaaggatacataagaaattcttaatagggtttcctctgagatggggccagggagggtggccaagatttttactttttactttgtactcttctatacattaaaaaaagtttatttattatttatataatacaaataaataagatacaaatgtgtgtacatataatgtgtcagcatatcccaactgagccgaaaagtttatgccacattaggaattaaatggtagagaaaaatagcattttaaaaatattaccccacagtggtttacntgtaaagttccttcaaaattttccttctgaaattttcctgtttttttttaaagactaaatatatctttcttgctgagctataagctataaaacaattttagtattctcccaggcctccaccattactaacaatattaattccttgcatatagcattagaccagggttctcatccctggcttgcacacccagagcctggcctgcacacctagagcctggacccaaagtaagtaaacctgaattgggctcacctgagcctgtcttttttctcaactttaaaagcttcacaggtgactgtgatgtagagccagagctgaggttcagcattagaagaactggggagaatgttgcagggaacagtgctagagtactcaaccaaccttctatgctagttgatgggtccatcccagagattttccgtgaatgagcaagtagcagagcaaaacctaaattgaaccctgtcaaggaatcacgaacacctttgtagtttaaaatatacttgttaaaggatgttttaaattaattgttcacttcattccaatttgtcttttgactcccttagtacttttcttccttgcatttcatgtaaatccaatgctgtgtgagtaaagagaagagaggagaaagaagaaaatgtgctgaagcaggtatttttagagtgggttttcagaatattttggagttagcattaattcatttcaaaggagcagaaaaatattcagaggtagcatgaggttagtatgaaaaatgttggcaggacctctgattctgttgctgactctccaggatttggaacaggcatgtttccttcatgtggaattggaattaattggacaattaattcaaaatgccttcatgaaaagaacaaaaacaaataaaattgcccttcatgtctgattgcctcaacagaacaacaaaaaagtgatggaactggatgctctcccagtcttacatttctatgtaaatgtgaaagagaaacatggctacaaggaccaggtatggcctaggaaatgggagaatctaccttttagaaggggttcttaacatagggtctttggaaggtttcaaggtgtcaatgaaccttctgaaatcacatataaaatggtgtgtgcacctttttttctagggttatggtccatggctttcatcagattctcaaaccattggaaaggattaaaaactgcctttttttttttttaaggagtctggggggtagggtggacggtataaaaattattcaagttaggaatattaaaaagagagcctgttaatttagtcaaatattaggggggatcacattgattcttggagctggagagaaggcagaaaatcacatcatttgaagccacgaattgtcaggaaagagatgggcaagaaattacaggctgaaattcaggtgaaggagcaggtagttggtaattgttgaagctgtgtgatgagtgcacagggattcattatatcattctctttacttttgtttaggtttgaaatttttcactataaraagtttttgaaaataaggagccccagagagaattcctagaagatggcagaggaggaaaaagaggaacctatcttcccacctagataataattttaccagtagaatctgtctaatgtaagtattttggaactgtggagtctgttgaaggcttataacttccagggcttgagcaataattgtggttaattttcatcaatttcagctgtaatcacagtagcagctaaccacccttcagccacatgtcaggcagctgtgcacatgctcctggagcaacctgtacacagcctgtgggagctagggtagctgaaaaggaccctggcctccaaatatttaggatctatgctctcattgctgattgctgcttctcatcacaaaggtgcaaagaagcagcaggttttgttgttgcactttaccccattgttgcgagtccctccatctctggatgaaatgactctcagggaatataaagggcaaacacctttttcccttcctacattttcccccttttaggaactagatattgaagactagagcattaaaaatgaaccacatgtatgtgattggagttggaaaatcatcatgtatacccagggaaaggcaaaggctcaaaaaatatatgaaaggatcttaactttatacttctggctgatccacaccacaaagacagcctacaacaacaacaacaaaaacagaaaaccagcaaaccagctgggtgaggtggctcacacctgtaatccctgcactttgggaggctgaggcaggcagatcacctgaggtcgggagtttaagaccagcctgaccaacacggagaaaccccgtctctactaaaaatacaaaattattcaggtgtggtggcacatgcctgtaatcccagctacctgggaggctgaggcaggagaatcacttgaacctgggaggcagaggttgtggtgagccgagatcgtgccattgaactccagcctgggcaacaggagcraaactctgtctcaaaaaaaaaaaaaaaaaaaagaaaagaaaagaaaaccagcaaaccaaaagaaaggacactgattttcagagttaccacattattagattcaaatatccaatttccaacaaaaaattcacaaggcatgcaaagaaacggaaatgtatggcttggttaaagggggaaaaaaaataacaagaaattgtccctaaaagagacctaaaaatggttgtaatagacaaggactttcaaacaactgtcttaaagatgctaaaagaactaaaggaggatgtggtgaaagtcaataaaacaatatgtgaagaaaatgtaaatatcaataaagaaatagaaaacctaaaaagaaagcaaaaataaattctggagctgaagattacagtagtcgaagtgaaaattttaagaaattcaaaggcaaatttgagcaagcagaagaatcagcaaacttgataggacaatgaaaattatcaagtctgaggaacagaaaaaagactggaggaacgtgaacagagcctaagggacctgtagggtaccatcaagcagatcaacatatgccttgagggaattccagaaggtgaacagagagagaaaggggaagagagaatatttgaagaaatgatgatcaaaaactccctaagtatttggaaaattcacaaatttctggaaattaaccaacacactcttaaataacaaattaataaaagaaatcataatggaaattacaatgtacctagagacaaatgaaaatgaacacacatgatacccaaacttatggaacacagagaaagtaatgcaaaggggaatatttataataaattcaaaatttacattaaatagcttacattaaaaaaacaataaatgtcttaaatcaacaacctaaacttaaaacttaagaaactagaaaaagtaaaagaaactaaacccaaagctagtaggaggaataaaataataaagattagagcagagataaatgaaatagagaatagaagaagaatagaggaaaataatagaagaataatagagaaatctgaagatggttcttccaaaagatcaacaaaattgacaagcctttagctaaatggactaaagaaaaagaagactcaaattattaaaatcagaaattaaagtggggacattattaccaaatctacagaaataaaaaggattttaagagagcaattgtacttcaacaaattggataacctagatgaaatagacaaatttctaaaaacacacaacctatcaagactaagccacaaagaaatagaaaatctgaataaacctgtagctaacaagaaagttgaatctcttataaaagacagtgatttaaaatatcccatgaaataaaatccctgcacagtggcatgcaactgtagtctcacctactcaggaagctgcagtgacaggatcgtttgagcccaggagttcaagaccagcctgggcaacataagaaaccccatctcttaaaagaaaagaaaagccctggatctgatggttttaccagtgaattataccaaacatttaaagaactaacaccaatccttctcaaacttttccaaaaaaattgaagagattacaccctaacccagtctattaggccagcattaccctgataccaaagccagacaaagactctacaagaaaagaaaactaatagaccaatatcccttatgaacattgatgcaaaaatattctgaacaaaatatgagtaaactaagtgcaacagcatatttaaaagattatacgctatggctaagtgaggtttattcctggaatgcaaggatgattcaatctatgaaaactgatcaatgtartacaccacattaacagaatgaagggagaaagccacatgatcatcccaagtggtgcagaaaaagcatttgacaaaattcaacatcctttcatggtaaaaatgctcagtaaactctgaatagaaggaaactaactcaacataacaaaagctgtctgtgaataacccacagcaaacatcatacttaatggtgaaagactgaaagctttttctctaagatcagaaacaagaaaaaaatttccactttcaccgtatagcattggaaatgctagacatagcaatgagacaagaaaaagaaatgaaaggcatctaaaatggaaaaaaagaagtaaaatatccctgtttgcagatgacatgatctcatatgtagaaaaccctgaagattccacacacaaaaaagttacaattaataaattcagcaaaatagcaggatacaaagtcaacacacaaaaatcagtcgcatttatatacacaaacaataaacaatctgaaaaaacttaagaaaacaattccatttataatagcatcaaaaataataaagtacctaggaattaactttaccaaggatgtaaaaaatctatgtactgtaaagtacaaaatatatctgagagaaattaaagaagacataaataaatggagagctatttcatgttcacggattggaagacttaatattgttaagatttcaacactacccaaagtgatctacagatttagtgtggttcctatcaaacaagtaggttttttttttgcaaaaataggaaaacaaatcttaatattcatatgaaatttcaaggaactctaaatagtcaaaataatcctaaaagagaagaacaaagctggaggactcacacttactgatttaaaaatttataataggtaatagtaattaagacagtgtggtagtggcataaagaccacacataaagaccaatgaatacaatagagaatccagaaataaatcttcaaatatatggtcaaatgatttttggtaagggaaccatgattattcaataagaaaaggacagtcttttcaacaaatggtgctgagaaaactagatatttacatgcaaaataatgaacttttacctttacctaataccatacgcataatttagctcaaagtagatccatggcctaaatgtaagccctaaaactataaaactcttagaagaaaacataaggcaaaaacttcacgacatgggattaggcagtgattttgtgtgatgacaccaaaggcacaggcaacaaaagaaaaaaacagacaaattggacttcatgaaaatttaaaaattttatatcaaaagacactatcaacagaatagaaagacagcctacagaatttgagaatatatttacacgtcatatatctgataagggattagtatccagaatatatggagaactcctaaaactcaacaacaaaaatacaaacagctcaattcaaaaatgggtgaaggacttgaatagatatttgatacttctccaagaagatatacaaatggccaatcagcacatgcaaagatgctcagccttactaatcattatggaaatgcaagtcaaaactatagtgagagccacctggacacccttaggatggctactatcaaagcaatagaaaataaaatgtgtttgcagggtatgtggagaaaatagaatctttgtgcctgtttgggggatatagaatggtataaccactgtggaaagcagtatggtggtttctcaaaaaattaaaaatagatttaccatatgatccagcartgccatactcagaagaattaaaagcaaagtatcaaagatatttgtatgctcgtgttcatacagcattacttacaatagctaaaacattgaagcaacccaagaggccattgacagatgaatgaaaaagcaaaatgtgatatatacttacaatagaatattgttcagccttaaggctgggcacagtggccacgcctgtaatcccagcactttgggaagccgaggcaggtggatcacctgaggtcaggagttcaagatcagcctgaccaacgtggtgaaaccctgtctctactaaaaataaaaaaattagctgggcttggtggctgacgcctgtagtcccagctactcaggaggctgaggcccaagaatcacttgaactcgggaggcagaggttgcagtgagccccargatgatgccactgcaccccagcctgggcaacagagtgagactcggtctcaaaaaagaaaaaaaaaaaaagaaaaagaatattattcagccttaaaaaggaagaaaattcaggccaggcatggtgcctcacatctgtaatcccagccctatgggaggccaagtcaggcagatcacttgaggtcaggagttcaagaccagcctggccaacatagtgaaatcccatctctaccaaaaatacaaaaattagccaggcrtggtgacaagcaccagtaatcccagctcctcaggaggctgaggcaggagaaccgcttgaacctgggaggcagacgttgcactgaaccgagatcataccactgcactccagcctgggcaacagaatgagaccctgccacaagaaaaaaaaaatgaagaagaagaagaaagaaaattctgaggcatgctacaacatggatgaaccttgaggacattaggctaagtgaaataagccagtcacaaaacaacaaatactatatgatcccacttttatgaagtacttaaagtagtcaaaatcatagagacagaaagtagaatgatggttgccaggggtagcaggaagggagcaatgagttgttgtttaacgggcatagagtttcaattttgcaagatgaaaagagatctggagatggatgctggtgatgtttgcacaaccatatgaatatactgaatgccactcagctgtgcacttaaaaatgattaagatagtaaattttgttacatatattttaccataataaactttgggtaaaaaattaaaatgaaaagaaccaaagtgagatagcagaggaccctgtgagctgttgagcctgtgtgaacagagactagtggccctcatgghatgtggctgaatgagtggttggtaacgatctcctgctttctactatctgtttccttttcttcctcagtttttttcttaatctgcttccttgagaaaacaatcctgcttctttgagatacaaaattccaagtttgatgtggtgattatggggaaaaaaagaacgtaaggtcacaatgagaagatgggacactatggaaggccctttaattttctaatagtcacatagactttaaaaaatagtctctggggtctggtaacttggtaatgtcattgagttattataaaagagtaagcaattttataatatatttgtttagggatataattttgtataatttcccttgttcacttatttttcagtataaatcagccttgatgatatgatcatttctatttttttctaaaattagaataataataatacctgttttattaatggtgatataaaatctaggagaaaaacatgaatgaatactcacaagtatttactacttgtgagtagtagaaaacatgtgaatactaacaagctaccatagtcttgttcctgaatttccataagagagaccttccaaatgtatgaatttttatgtctatatcttaagccaagaatatccttcttcactatacccaccctacacctaatcaggaaattttcaaagtctttcaacatatttcatattcacaaattgcttatgttggatcatcacccttgtccttcacttcttgggcaccagagggcatacatcttaaatctcactttctcagagacacaaatcctttttccctccactgcaggattttctcctctggatttgctctggcacctcgaagaagcttaggggaacagttcagctttgctcttcctgataattagtggctttcctgatggtgtggttcaacacacccaccagagacggaaggtaatgattactcaggagacctgcttcctttatcaatctgcacaatcaaaagaattgtccttgaaaatagtctttgtagaccattagttcataatcttttttgtttgtttgtttgttttgctaacttttcattgtttttaggctgaagatagcctaaaattgtattcattactttagccttcgaagcttataaagtgagataatagaagtgaaactgctttcgaacgggaaagaagcaccatataattgcaaagtagaattacctttaggagaaatgttaaccagacaaggccagtctgtcacccactggggagtcgcacaatctcagctcgctgcagcctcaacctccccagctcaagcaatcctcccacgtcagcccccagatagctgggactacaggcatgtgccacctaagttttttattttttatagagacagggttcaccctatgttgcccagtctggtctcgaactctgggctcaagtaacccgcccacctcagcttcccaaagtgcaaggattagaggtatgagctgctatgcttggcccataatttttgattcttgtgactgtatgcccacattttttttcttatgatttctctgtagatctgtccttataaaaatttttattttctaaacttgttaattcttctggacatatcctaaactacacatttagagccacccaagtagccatccatccacttatgaaataatatgagtattaagaaatctagaaattaaatttaaaaaataaaatatgactttttgtttgtttactattaaaaaacaggtctcaacaatcaataagtaaatgattctaagagaaaatgttaaaatataatttttttttccctaataccagataagaatatttttattttcctttgggccatccctcaatcacagtatattcagagtagttttcaaattttgtaggattgtttttatctttctgtggctttgacaagtatcaagtatgggtagatttagttgaaaaggtaagtaggccacagagcatcagaacaatttctttattttattttattatttttttttgagatggagtctccctttgtcacccaggctgtagtgcagtggtgtgatctcggctcactgcaccctctgccttccaggttccagcaattctcctgcccagccttctgagtagctgggattacagctgtgtgccaccatgcctggctaatttttgaatttttagtagagacagggttttaccatgttggccaggctggtcacaaactcctgccctcaagtgatccacccatctcggcctcccaaagtgctgggattacaggcatgagccaccacgccaggcgcagaacaatttctgaattcaaaacaaatagccctgaatagtaaattctctcttcactgaatagagaattcatgttcaatgttttgtcaatgttttcattgtaggcaaacctgagaccaattttcttaggaagacaatgccataaatgttgatgaggctccctagttaacccccaccccaaaccaaaccaaacaagactttttatccagttaaatatgttgtagtcccctctgagatccccatcactctttgctattcatatttttactatttttgtgattagcataagtattagaaagagaaattaatatctgcagagcactttatccacatgtactaagttgtacttatatcccaactctatgtgaggtatatgtatgaagtactgttgttctgggatctttgggattgggatgtcgcttttctggccggaaatctctttggctggtggtgcctttgcccaagttttctcaggccctctgggcttgttccgcccactcggcctggcaggctgtgctcagctcatgctactggcccttgatcacacctctaagggagactgagtcaggtgtggagcggcaagggatgtgtaagcaagcgtgggatccggccactgcgcacaaatacgccggctgctgccagggggcaggcagttccgagtgctggcacgggtgccagcgctctgtgaggctatgctggaccaggcacactgcaagcaacttccccagctggcaccggaaaatgcagtgacgcccagaagcttgacacccagaagcttggagatgcctgcaactgcaggcccccaaagagggagtcacagccctggcttggggagctcccaggtctgggctccctgaagggccgcaggtgttctctcctcttcacccacaacatggtggacaaggggcatgtttcagccctgtttgtgtcacagctcttttagccttgccatttggtgggtcccgagttcttgttcttccacacagacaagtagagggtgagcaaggcgaagaggagctttattgagaaacagaatagctcagaggagacctgcagtgggcagcttctttccatagccagggtgtcccgacgagttttcagctgtcagcagagagggtagctcctctctgcagctagtcctcccaccatctcctcggctcctctctgcagctggtcatcaccttgtctccctgtcctctctccatcctctcttccgagtctgactgactctgggggtttttaatgggcctcagagggtaggaagtgtgtgctgattggtccatgggtggccgtggatgggcccagggaaaagcaccacacgttcccactctggtccgtgggactggcagcccagcccccaggcttcaggccccccttggcttgaaggtaggagtttcctggggacccaccccattctgcccaggagcctatctgcttcctgctgctgttcatggtgcccaggctgttcttgccaaggggcacctgcaggccagcgccaggctgtcctcagcaccccctggtctccctcccatgttcattagttcccaaagtccagagagggcagagatgacaggggccgggtgtctcagcggtgccctgagcctgcgcacacccagccaggctgcaacagcgcccgggcttggccccatccttgctctgagatccgagggggcgctgggagcggggagaggctagacactgggagcagacccctctgagcctaccggggcaagggtggccttcctgggcccctgagagttcagagatgcctggttctgcagtcgcagctcggcgtctgcagctgggtccaggagggcggggctcctgcctgctcccagcccctaagcacagggaggcaggggtccatgtccacagcggtgtcttgggtggctgcagccgcacccgaaaggtccaggctgctgcctgctcccggctcccgctggcttcatgaaggtgacaccgccccaggcccagctccgccttgggttccctctctgcccaccccttcacgtccgaccgcactgctcttctgccagcaggcaactcggcctggccccatcacggcggctgccagagcggtgggatctggggggctcccagggcaggctccagagactatcatctcctccccgcagcctccccgcagtggtggccagcaaaagcagcgacgtggggccagggtccagagcagcagaggctctgggcctgggatcaagtcccacccaactgcacgagggttgggcaacaaagtcgaagtccgctgcctcagggatgcgtgccacaggggtcacaccgctgccactgtcactcccacagccgctccctccattactgcccatgcccctctgctgctgctatcactgtgatccttataactggctcagataagttaaataaacagatttaaaaattcaagacgtaggacgggcgctgtggctcatgcctgtaattccagcactttgggaggtggaggcgggtggagcacctgaggtcaggagttcgagaccagcctggccaacatggcgaaactctgtctctactaaaaatacaaaaattagtcgggcgtggtggcgggtacctgtaatcccagctacttgggaggctgaggcaggagaatcgcttgaacccaggaggcagaggttgcagtgagctgagattgtgccactgcactccagcctgggcaacagagygagacgccgtctcaaaaaaataaaaacaaaaaaaataaatwaattaataaaataaaataaaaattcaagatgtacattattatggaagagaattcatggttttatttttttcagaattggcatagacaatyctgaatttctaacggtttatgtgtgaaaatgtttttttaaagtcaaatattttaacttaattatatttttaaatgaatactgagtgcatggaaaaatatattctggacttcagttcctcaaaccccaccttcacctgcaaatcataagttttagacccttttcttttctgagtattaccttttctctccacctacattccctgctaaccaggatagtcactctcatacgcagcagatgtgaagccaaatgtttgggagacagtgtgggtggagagaaaaagtgtagccttgagcatcagacacatcttaccttacttaatttacagcatgcccttgagcaaatgttgtaactgactgagtctcagtttccacttttgcgaatgtcataataataatatctatatcttgcagttattttgaggattaaatgagatatcatttatattgtcctgaagtgtaattggtttcaaaatactttccacccttgctagtagtaaaatgagtaatatttagcaataaattactttgcacttcagttgtggtttagagtagtgtgaaagcttagattgttactattccataggaattagctcctggttttggcctgagactgactaatgtctaatcctcaaaattcctattcataaggttcaataataagcagatgggttacacaaccctaattttgcaggtcgcacttacttttcctcttgatataagtttttgtcagcaactaaaaacatccagtttagtgaaaaagtgtgatcaatatataacaacacaggaattgtctaagaagaattcaggaacaagagaatgttgggtaaatcgtaggctgatcatgagagagccacagctatagaaaaaatctgatttagagaaatgataattttttgtgttttctcttaccccttccctccctttagttcccaataattttattttatagcaaagatacttaaaataaaattttattttatagcaaggatagggtcttgctttgttgcccaggctggagtacagtggctattcacaggtgtggtcatagtgtactacagcctcgaactcctggcctcaatcctcccacctcagcctcaaaagtaggttggactacagatacacattaccaattttaaattttaaaatgtaaaattaaaattttgcctttcttcacttttctttctttccattacttaaacttcatttgacatttatacaatcaagaaatacaaactgagtccttactacatgtcagaaacttgtagaatacaataataagtgaaacagccagtctttgatttcaagaagttaacattggttgggaaggcagataactagaggtaagtaacaataaataaaaaagatgatttcagagaatgctaaatattaaggaaaataaagtaaatatgacagagagtaaccaaggagcatctttagattgggtggtcagagaaggctttctaaagagagcttgagctaagacctggctgataggtctgagccatttgaaaatgtggcaggaaaatgtgatgcacagaagccaagagaagaaaatgttttaagaaagagagactgggcaattgaatctgctgataaaataggtgagatgaaaaccagaagtgattattaaagttggcctttggtgacctgggcaaaagcagggacagtggtgtgatctgggtgcaagttcagctgctgaggctaagygaagaattctgccaaatggagaaactagtgatcaggttgtatatgcccagaagctggctagattgttctttataaaataaagtaagctctagtacccctagtacctcacaaaacaaatgcatctacttggtttgtatcacttctgacaagttgtgttaataataatagtagaattatttattattttactactgatttcatatacttttgactattatatcaagatcctgaattttccttttttaattcaacttaataattttttaaacttttacttttgtagagacaagatctcgctgtggtgagcaggctggtcctgaacttctgggctcaagccaccttggcctcccaacctgctgggattacaggcacaagcaaccacatccagcctcccttttttttttttttttttagcaagtgtgtgaaaccctacgcttctgtctcctcttcaccccttcccatcttctttcctaactgtgcccgtaaatgaatatataatcaatttgggtggagtttatcactgaaagcttcctaaactggggagtaaatcagtttggcacagtggttatgagagcagattttggctgtgacctggctttatatgctggctctactctttactacatatgtgaacttggacaagttacttaacttctttatgcttcaatttcttcctttgttaaaaggggataacgtgccaggtgcagtggctcatgcctgtaatcccagcacgttgggaggctgaggtgggtggatcacttgaggtcaggagttccagaccagcctgaccaacaggtgaaaccccgtctctactaaaatttcaaaaattagccaggcctggtggcgtgcacctataatcctagctactcaggaggctgaggcaggagaatcacttgaacctgggaggcggaggttgtagtgtgccaagatcacgccactgcattctagcctgggcgacagagcgagactcaatctcaaaaaaaaaaaaaaaggggggggggggaggcggggataatgataatgttttataagtgttttgtaggtatcaatttatctaatttcacaataatcctataagtagtataattaaacttattttacacatgagaaaaccaaagaacagatgttatctgccttagatcacaaaactggtaaatagcaaaccagaatttgatcctaggcagtgtgattcacaacctagagcccttaactgcaatgatgtctccctgcctgtcctaaagggtcatgctctgtactgtgtggcctgaaagcccttctccaagtcttgttggacctgggtgaacacctgacccaaaacgatacaatgcttatatagcccagctagaaagatgacctgaactggtcagattttttcactctgaggaatttgttctgaaaacatgggaataaactgccacatgatggtgtgaactacaactgagaggtccagtacagttggggccttgatggccactgggagtcttatgtgaggagaatcagcagagggaagaagagaaaaaaaatagggcagatgcaccatgacaaaactaattagaagggtttgtgacctctgagggagcagccagcctcattccgttcctaaactttctcaggtctggtctcctgaaggcccaactgtccttagttcttttcttttcttttcttttttgagatagagtttcgctcttgttgcccaggctggagtgcaatggcatgatctcagctcactgcaacctccgcctgccaggttcaagcagttctcccacctcagcctctcgagtagctgggatcacaggcatgttccaccacacccggctaattttgtatttttagtagagacaggatttcaccaagttgatcaggctggtctcaaactcctaactttaggtgatccacccacctcagcctcccaaaatgctgggattacggtcgtgagccaccgctcctggccgagtccttagttctttgagtgagtccactgtgtatccttccaaaaaaacaacaaacaaaaaatgcagctgttataatcatagcaaagaaaaattctttacttaacctagcatggatggttctctgttccttgtaaaataataacagcaaccacaaaacaaccttatttaaaaatgggcaaataatttgaacatacatttctctaaagaagacatacaaatagccaacaaagtatataaaaagatacccaaaattactaatcaacagggagatattaatacaaatcaaaaccacaatgagttaacacgtcacaccaattaggatggttattgtttaaaaaaaaaaaaaggccagacatgatggcccacacctgtaatcccagcactttgggaagtcgaggcaggcagactgcttgagcccaggaatttgaggccagcctgggcaacatggcaaagccccctctctacaaaaaatacaaaaattatccaggcatggtggcacgtgcccatagtcccagtactcaggaggctggggtgggaggatcgcttgagcccgggaggcagaggttgcagtgggcggcagagcgagaccgtgtctcaagaaaaataaaatataaatataaatataaataaaaccaaataaaaagataagtattggtgaggttgtgaagaaactggaacactagtatgatgttggtgagaatgtaaaatggtactacagctatggaaaacagtatggagattcttcaacaaattaaaaatagaactacagtataannnnnnnnnnnnnnnnnnnnnnnnnnnnnnnnnnnnnnnnntcttctgggtatatttccaaaagaattgaaatcaggatctcataaagatatctgcaccttcatgttcactgaagcactattcacaatagtcaagatatgaaatcaacctaagtgtccatcaacagacaaatggataaacaaaatatagcatatgctagaatattattctgccttaaaaaggaaaaaagttctgacacacactataatatggatgaaccttgaggacatattaagtgaagtaagtcagtcacaaaaagacaaatactgtatgttccacttatatgagatacctagagtggtcaaattcatagaaagagaaagtagaatggtggctaccagaagcagggcagcagtgggggttgaggggagatggggagttgtttaatgggcatagagtttcagttttgcaagatgaaaagagatctgaagattggttgtacaacgtgaatgtacttagtactactgaactgtacacttcaaaatggttaagataataaatgttatattaggtatattttaccacaattaaaaaaccarcaagcaaacaaaaccaaccaaccaacaaaacaaacaaaaaccaacaagaaaaaaaatgttgtcagtcatatttagaccatagtgagtctgcgttattgagagaaatagagagtttggggaaaaatgcctgttgagtgaggaagacatgaactcagtcacttacatgtccaggtacggtgttctatagtgcaccaagtagaaatgtccagtcatgagctggggtacaggcctgaggctaggaagacaaagnagtagccctttactgcaggattgattagacgagagagggcactggttaggacaaaggaatcaggcagaggaccattaccataattctagtttaggagaacagtattggtatggccataccatactgttggccataccaattggtatgaccataccatactgttggccataccaattggtatgaccaaattttccccagaaaggggaagctggagcctgagcaggcggtagagactattgcaagttcagtaagagacacatatgtttggggacatgcaaacatattcaattggcagtcagtttgcctcctgaaagggtgactggagctgagaacctacattgcctctagtgtagcatttccttaggtaggctctgagtcctctgagaaatgattccctctgatattcacagtgcacatgaatatatcagaggccctcagagtgttctgggaaagggaattgcttaattttgttaaacctaggttttcctaaactcatgtgactgccctgccttttttttcataaaacatctattaatttaatgaggactacactttggggaattgttctcctgttcgtgaagatatttcttagttgacaaagggaagcagaggagaaactggttagatagttgataaatctgtgaatattcaatgtgtccctattaagtcaccaaaacagactgaggaagcttccaaaaacccaggcctggcctggaaactgaggacactaacccctctgcatggggagcggtggtgaagtttgctgggggctttgatcaaagacagcttgctgtcttggctttctccctacactgcatgtgctagtgaagcctggccaatccctcccctagttcttttttatcctctacattggctccttgtccttgcttttccatttgcataactaatgcacacaacacagagttcccgcaattttaaagacagctggccagcacatcttggatgctgatgtcaggaaacatctggaagagggctaaagttactgaaggcccatctgagaacaatggaaacacattaatatggaaaattcagtattggggttggggggtggcttgtgtaaataaaaatggctgtcagaccaacttataaaagtcttgcgcaaaaccttattgtagttttggcactaataccacggagcaattgagtggtagtccagctaaaactgaaatattgctgctttgttttgtatatgtatcactgagaccttccttttcttaaaaggtttcctagaagtcctgccagctcagcaagatattctattctaaaaagttcataaaatagtgttttactttataataatattaagatgatctcccttctttctccttgttccctcttgctcaaaatataaggatataaaatagagttctgatacacctttttctgctatctctaagaagtcartgttggccaggcatggtggccaacctcctgtaatctcagcactttgggaggctgaggcgggtggatcacctgaggtcaggagttcgggaccagcctgatcaacatggagaaaccctgtctctactaaaaatacaaaattagccgggcgtggtggtgcatgcctataatcccagctactcgggaggctgaggcaggagaatctcttgaacccaggagacggaggttgtggtgagccgagatcacgccattgcactccagcctgggcaacaggagtgaaattctgtctcaaaaaataaaagaagtcagtgttagtagaaatactaaggtttacaaatatttaaatgtgaacattatagaatgtgcacgaaaaatttacatgtgaacattctttttctttttttcttttttattttttcttttgagacagagtctctctctgtcacccaggcttgactgcagtggtatattgtgtgatctcagctcactgcagcctccacctcccaggcacaagcaatcctcctgcctcagccccttatcctgagtagctgggactacaggcacatgccaccacacctggctaatttttgtattttttgtagagacggagtttcaaatattgcccaggctggtctcaaactcctggactcaagcaatccacccgccttggcctcccacagtgctgggattacagaaatgagccaccgcactgcaacattatttttcagggctgtgtggcatagtagttaaataaacagattttggagtttgaattctagctcctcctcttacccaattatatgaaactttgagaaaattacttaattagcataacttcattttgaaaattataactatttttgccagttggaattgtcatgaggagtgcacaagctaatatatgttttcagtgcttaatgattagttgtccaggttagctattcttactgtggttttgttgatatataaggattaagaagaaatccctgctataatctattttgcaatccaactccaaaacactgagcatttgctttcaatttcctgcccaacagatatatgttttggaatcagggtttctccccctaagtgttactttaaagttctacctactgtttcactttattttgtagaaactgaaaatggcatcttgtctcttgtacaactacaagttcatgattactatctcatattgttttctgacatttgaattcttggtcttgatacctgctttttccytctgaaagcttgttggattttctcctatttctaagggtctgacatttcacaatggtctattttcatccattgtctaggtattttgggggcgctatcaatctggcagctcacatcctttggtttttgaaatcttgaattattgatttattatgagctcctccccatcaatttttctgttctctttctttctggaactcctgtttattgaaatattgtaccttgtagactgatcctctgattgttttttctttcctattgtccttttctttgtcttttagctttattttcctagtttctcaactttatcatataaactgtctaagttttaaaattccattattatatttcaaatttctaagagttattttttgttctttttatttcatcctattcttataacatctttttacttctctgaagatattattagcttttttaaaagcttttatttccctgcatattctcaagactttgtttcctctctagtttttgttttgttttgtttttcgttgtttgttgttgttgtttttttttttttaacttttgtgtgttctgtctctctcttctttggtaggggcttttttcagatgtctgataattctggcccttcacttgtattttagagctaatgggcacctctgtgccatggatgaagcttgttaccttttgtctttagaatgatcagtctgggccatttctatgggagggggatgtccttgtctttaggtcttttttcttggtctgagcaagttttctagaaggtaaatgtctcctctccttcctagaatggttccttatgctggctgcctctgttctggaggttgaatttggactgagaatagtgcttcattatataagcctttttycaaatctgtctgctttcagcataatattcccagtctttatcgtgcctagtgtcctagctctggcttagagaccctctgttatatcttctgcagcagtcactaaactgcatttgggagggaggcttttggggtagcctaccctgggaaatggcttgcttcttggtttcccctgtgctgatttagaatttagccttcttagtttgttacgtgatatgcaaagtatcctatttttyagctcttaaaattttgttgctgtcattattttctcccccttttaatttgttaaaatccttttatttttaatttaatagaggtttgggggtaaacacatttgttcaatcagccatctttaatcagcatttttaaaaagatattcttggccaggcatggtggctcatgcctgtgatctcagcattttgggaggctgaggtgggaggattgcttgagctcagaagttcaaggctgcaatgagccatgatcatgccactgcactccagccttggtgacagaaggaaagcccatctcagaggtttatcagtccattcttgtgttgctataaaggaatactcaagcttggtgatttataaggtaaagaggtttattttggctcatggttccacaggctggatgagaagcatgcgccagcatctgcttctgatggggactcaggaagcttccaatcatggcagaaggtgaaggggagctgatgtgtcacatggcaaagagggagcaaaagagacagtgaggaattgctaggcttgttttaaacaaccagatctcttgtgaactcatagagtgagaactcactcattatgtcgaggacagcaccaaccctcttatgaaggatccacccccatgacgcaaacacctcccaagaggcccacctccaacactggaggtcacatttcaacatgagacttggagggtataaacatccaaaccaaaatgagggtggggaggagatattcttaatgtaatactttttttctgaaaaattagattttctgtgccagaatcccaaatctaagaaatctaagataaagtaatgtgcctgagaatagctttgtaaatgtgttcatttaatttctaactgggttttaatattttggccgtcataactgttgtgtggtaaatatttctgtttgttggcaaaacccttttgggttgttcatcaccttttatgtcattatagatgtaaacaacatgtgtgctccagatggactctgaaatccaggctcccactttatgacacactcctctacaacaccagagactcccaaacacaaggccttatattgactcatttcagctcacatcctggcgactctcaagagagaaacctcagagtgactaaaatctccataatgagaagacatgtacattcagtatctattttggtaggagactttatattcagccttctttctgtagagtaagacgtggagatttggacttagggtgggctgtatgtggggtggagagtaacaagataagcaaggaattaactccatagtaaatgttaacactttctacatctttaaccccaattttatgtgccaaagaaagaatccccacaactgataccttcctggcagaactgacttcaggaaaggcaactcaggcagatattcgagtaggcctagactgtgtgggcctgtggccagtctcacaacaaaacagaatcaacagccttgcagtctcagaaatgcagtggtcattctggtaagcaatagtcaaaactaaaatttcttaaactgattttttgcctctatggtcaaaggagaactgatcctacttgttatttcatagatggaaaaatccatttgccaatcaggatgtgtctgatactccttttttttttggtttcaagagtaaagtcaagaaaagctgctttttgaaagtcaaagaatcacagtagttgttatttcttagtgcttactatttgctacatgcttcacatacgtggtctcatttaatcttcccaaacaattttgccataatattattacaaccatgttgaatctgaaaataataataataataataataataataaggcttagagaggttgagtaacttacctaaggttaccaaattagtaaagactgaactgggatttaaaagcaagatttgtagaatttttctccaaaacccagaatctctgcattgagccagcctgccattctgagacagacaacattcataacacttgcatattgtttgtacagtgttcattgtttaatgtagggcacatttcatacataccaagaggaatcatatgcttattcttgctagtatatggcaaacttttccattctataatacaaatatgactgatgactgctgtcatcagcccagcaaatcacctttcatcacaggtacacagatgacaaatacagagtacggaaggagtcagctgaaggtgctgcttgcctgggctgtcttttttttttttttgttacatctgccacttcatttattttatttgcaggaggagttgaaaccaattttaagggagattttcattttccccctaaacatgaatcattcaagtaaaaccaacttaactatagaaatgtagcaaagtaaggggaaagcagcacaacaacccaagaggcaaaggctggggggaaggggtgggtgcagtctgcgtataacatatgcacaaatgccttatgattcccctgctcaggaccgcctccccagaaggcaagcacaagggcccattttaagaggatgtttccccccaaacatctgagagcgcttcaacttaaacagcttacggttaaaaagacaaaaaagaaagcaaaactaaccaaagaaactccaaaaaaccccatgaaccacccagccataactgccttccttaatcgatcataggagtttcattttataaaaagataaataaaaaacattgaaaaaaatattttatcatgttatatttgtaaagataatagaattcatacgtttcttagaaaacagaccagacactgccctccagtttccaccccattgctgggaggatcagcaggactagaaagtttgggatactggagctgccggtggagaatgggaagtccagcccagaagaaattaggaaatagggctcaggggcacgtgaggtgtggttaggagcaactccacgtgatacatggctgcacagaaaaggggaacacaggtgatcggaaaggccttaaactcctccttgacatacaaaaccgattttcacaaagatccwggcagtttggtcccaaactaaggtgaacacttcaaagtttattcacatgctttactttctcttttaagaatcatcgtttcccaaattaaattagatttaaattataatgttactacatatgcctaaaaaaagaaaagaaaaaaaaagaaaggcttttaaaatcaggacaggggagaagagattgaaaatcatcaaattagtcctcttagctccaaatgaaatgaaattaagaacaaaaactctgggcctaccgcaccgattgcagctgcagcttgcaatggcaccttgggctgtcattttatccaaaacaatcactgctccgtagaaagactgcaaagacttggagtcctgtgtttcagtcctggtgttggtgctaaccagttgtattgggcttgttacctacgaagaaaactcacctttgttaaatgcccagtgtgtattgggcacggctttcttttttaatttatgtggttttctttagaagcccatacgtgtccaagggttatgaaggatgctaaagttagactcttccacccatggcccccagcctgtgatcccattcccagtgttatctattgttaccaattttgcataatacttctagagtaccaggaactttaaatatattatgtcagttaagtttcctggttattgctccaatttaatttaatttaatttaatttaatttttttgtctttttcaggatttagggcaggaaaggcaggctagtgtatgtactcagtctgcatatttgctccaatttataaccctattttacagtttctgaaattgagcttagtagctacttgcaaataactaattagtagtggagctaagattaattcaccctttctgtactcactgaataactataatggtaccatgctaggctttgaggatgggatcatgaggcacatagatccttcctgtcagtctagtggaggggttttcttttttttattaattttttttctttaattagggataggatctcactgtgttgcccaaggctggtcttgaactcctgggctcaagcagtcttcccacctcagcctcccaaagtgctgggattacaggcctaagccaccttgctcagccaagtgaagaagttttaaaaagtaaatagataagctactgcttccactgtcaccatgtgatgtgcctgctcccactttgccttctgccataaccaaaagttcctgaagccctcaccagaagctgartagrtgttggtgctacgcttgtatagtcagcagaaccgtgagccagttaaacctctgttctttataaattgcccagtctctggtatacctttatagtaatgcgaaagtggactgatacagaaaattggtactgatgagtggggtgtagctataaagatatttgaagatgtagaaatggctttggaactgggtcacaggcagaggttggaagagtttggagggctcagaagaagacaggaagatgagagaaggtttggaactgcttcaaggctggttaaatggttgtgaccaaaatgctgatagagatattgacagtaaagtccaggctgatcrggtctcagatggaaatggggaaactgttgggaactgcagtacaggttactcatgttatgccctaacaaagagcttggctttattgtgttcatgccctaggggtctgtgggagtttgaacttaagagtgatgactggctgagcacggtggctcatgcctgtaatcccagcactttgggaggtcaaggcaggcagataacctgaggttgggagttcaagaccagcctgaccaacatggagaaaccccgtctctactaaaaatacaaaattagccgggcatggtggcacatgcctataatcccagctacttgggaagctgaggcaggagaatcacttgaactggggaggcagaggttgcggtgaaccaagatcacaccattgcactccagcctgggcaacaagagcgaaactccatctcaaaaaaaaaaaaaaaaaagaatgatgacctagaatatctggcagaagaaatttctaagcaacaaagcattcaagatgtgccctggctgcttctaatcacccacaatcagatgcaggagcaaagaaatgacttaaagttggaacttacatttaaaagggaagcagactgtaaaagtttggaaaatttgtagccttgccatgtggcagagaaagaaaaacactttcaggagagaaacacaagcaggctgcagaataaccacttgctagagagattagcatgactaaatgggagccaagtgctaacagccaagacaatgggaaaaaggcctcaaaggtgtttcagggatcttctaggaagtccctcccatcacaggctcagaggcttaggaggaaataatagtttcaggggccagatccaggacatcactgctctgtggaacctcaggaacactgctccccacatcctggctgttctggctccagccttggctcaaaggggcccaggtacaacttgtgctgcagttctagagggtataatccataagtcttggcagtttccatgtggtgttaattctgcaggtgctcagaatgcaagtgtgaagaaggcttgatggtttcctcctagattctggatatatggaaaagcctgggtgtccaggcagaagcctgccacaggggtggagcccctagagagaaactctactaaggcaatgcctaggggagatgtggattccagtccccaccacagtgtccccaccagggcactgcctcatggagctgttggtgggggcccactgtattagtctgttctcacactgctaataaagacatgcctgaaaatgggtaatttataaaggaaagaggtttaattgactcacagttcaacatggctggggagtcctcaggaaacttacaatcatggcagaagtgaaayaggcacgtcttacatggtggcaggtgagagaagtgaaaaccaagtgaaggaggaagccccttagaaaactatcagatctcgtgagaactcactcactatcacgagaacagtatggggggaactgccctcatgattcaattatcttcacctaggcctgcccttgacacatggggattattacaattcaagatgagatttgggtggggacacagagccaaaccacatcacccaccatcctccatattccagaatgatagattcactggcagcttgcaccttcttcctggaaaacatgcaagtactcaactccaacctgtgagagcaatcacatgggctgcatcctgcaaagccatgtgggcaaggctgctcaaggccttggaagcctatccttcacatcaggatgcaggacttggaatcaaggattatgttggaactttaagatttaatgcctgccctcctgggttccagacctgcatgggcctattacccctttcctttggccaactcctcccttttggaataggaatgtttacccaatgcctgtactaccactgtatctttgaattcaataacttgtttttttattttacaggtttatagatagaaggaacttggccttgagtttcagatgagactttggrcttttggacttttgagttaaggctggaacaagttaagactttaggggactattacaaaggcatgattgtattttgaaatgtgagaaggacatgagatttgggggtgcagtggcagaatagtatagtttggatgtttgtcccttccaaatcttatgttgtaatgtaatctccggtgttggtggtgggacctggtgggaggaggttggatcatggggctttgggtagtgtggacatattaacaatattgattcttccagtccatgaacatggaatatatttccatttatttgtgtccttttcaatttttttcatcaatgttttatagttgtcatgatccctcgtgaatggcttagcatcatcccctgggtgatgagtgagttctcactctggtattttacatgagatctgtttgtttaaaagactgtggcacctttcccctctctcttgctcccactcttgccacatgacatgcctgctcccacttaccttctgctatgattataagcttcctgaggccctcaccagaagctgagcagatgttggtgccatgcttgtacagcctgttgaattgtgagccaattaaacctcttttatttataaattcmccagccttaggtattcctttatagcaatataaaaataaactaaaacatctatcatgtgctgtggttcttactggagcaccatcaactcaacttgtagcactgaggaaagctgttagaaaaagtgacctccgtgctaagacatcaggaatgagctaggagttagccaggtgaaggggaaaatgttagaggatggacagaagagtaatcttaagcctgatgttttgggaggctttcagggtgactggaactgttgtgggagtgtgcccaaggtgactggggaggggtaaactgaagactgagtagttcagatattgtaaagcctgtgaggatttagtaggggagtgatgtgatcacattctaactatgggatggagaatgaattcaaaaacgccatgctcgttgagaggctgccacagggragaacccatagcagcctgagtcaaggtcaatgctgaggtatttgggaagcagaagcaaaagaccttcagggactggtatgcagcaatgatcatgagaatagattctgtaaccaccaggaatctttgctctgttgtttcctgatagcagaaccattggacattgaattgnttgtgatattgtacagggcattgttataacctttttaaatatcacttttctaatttgcaagatgggagtaaaaatggggtcaaaatggggatactattagtacttaccttgtaaggtcatcataagaactaaaagagaattcctgtaaaggttggttgtagtgtagttcccacatatattaagcatttaggaaatctcaaagcaaagggaggagccaagcatgtctttccaggtacaaccttgggcatctaagtgcttggtgttgccagtctctgtgttgaggaacacagaaaagggacagatttggaggaaggtgataaattcggcctgcatttgtttgagtccaaagcccaaatctcttcactacaccagtttccttaaagacactgccacttcctatctgtgtgatttttttttttttttttttttttgagacagagtctcgctctgtcgcccaggctggagtgcagtggcgtgatctcggctcactgcaagctccacctcctgggttcacgccattctcctgcctcagcctcccgagtagctgggactacaggcgcccaccaccacacccggctaattttttgtattttttggtagagacgggatttcaccatgttagccaggatagtctcaatctcctgacctcatgatccacccgcctcggcctcccaaagtgctgggattacaggcatgagccactgcgtccggcctcctgtgtgatcttttttaaatatatatatatatatttttttcttttcttttcttgttttttttttttttgagatggagccttgctctgtcgcccaggctggagtgcagtggtatgatctcggctcactgcagcctctgcctcctgagttcaagcaattctcctgccccagcctcccaggtacctgggattacaggcgcctgccatcatgcccagagaatttttgtatttttagtagagatggggtttcaccatgttggccaggctgatctcaaactcctgacctcaagtgattcgcctgccttggcctcccaaagtgctgtgattacaggtgtaagccactgcgcccatccctttaataatttttttatttttaatttttatgagtacatagtaggtacatatatttatgaagtgggtgaaatattttcatacaggcatacaatgaacaataatcccatcagggtaaatggggtatcatcacctcaagcttttatcatttctctgtgatataaacattcagattatattcttattttaaaatgtacaataaattattgttggctgtagtcaccctgttgtgctgtcaaatactagatcttattctttctatctacctatatttttgtatgtattaaccatccccacttgcatccaccttcactatctttcccagcctctggtaatcatcattctacactctatctccatgcattcaagtgttttaatttttacctttcacaaatgattgagaacatgcaaagtttgtccttctgtgcctggcttacttcacttaccataatgtgttccaattccatctgtgttgcaaatgacaggatcttattctttttatggctgaacagtactctattgtgtatgtgtaccatattttctctatccattcatctactgatgaacacttaggttgattccaaatcttggctattatgaatagtgctgcagtgaacatggagtgcagacatctcttcgatataatgattttctttattttgcgtgtatacctagcagtgggattgctggatcatatggtagttttttagttttttgagacaccaccatactgttctgcataattgctgtattaatttacattctcaccaacagtgtatgagggttctcgtttctctgcatccttgcattattgcctgtcttttggatacaagccactttaactggggtcagatgatatcccattttgttttggtttgcatttctctgatgatcaataatgttgaacaccttttcaggcacctgcttgccatttgtatgtcttcttttgagaaatgtctgtttagatattttgcccatttcaattggattattattttatttttccccattgagttatgtatcttctatttattaatcccttgtttttttgttgttgtttgtttgttttgtttttgagacagagtcttgctcttgctcttgctctgtcgcccaggctggagtgcagtgatgcgatctcggctcactgcaacctctgcctcccgggttcaagcaattctccttcctcagcctcctgagtagctgagattacaggcgcctgccaccatgcccagctaatttttttgtatttttagtagagacggggtttccccatgttggtcaggctggtctcgaacccctgacctcgtgatccacctgcctcggcctcccaaagtgctgggattataggcgtgagccaccgcgcccagcctattaatcccttgttagatggatggtgtgcaaatattttctcccacttcgctttgtcttttcacttcattgataatatcctttgctgtccaaaagctttttaacttgatttgattcaatttgtccatttttgctttggttgcttggcccagaccaatgttctggagagtttctcctatgttttcttttagttgttttatagtttcaggtcttatatttaagtctttaatccatttatatttgatttttatatatcaagatatacaaaatacaagatattttgtatatcaagagatagtaatctagttttattattccacagatggatatccagttttcccatcattatttgttgaagagactgtcctttccccagtgtatgttcttggtacctttgttgaaaatgaattcactgtagatgtatagattgatttctgggttctctattctgggttctctattctgtcccattggtctgtgtttctgttttatgccagtaccttgctgtttcagttactatagctctgtgatataatttgaagtcaagtaatgtgattcctccagttttgttctttttgctcaaaatggctatgactattctaggtctttggtggttccatatacattttaggattttttttttctgtttatgtgaagaatgtcattggtattttgataaagctttcattaaatctgtagattgctttgcrtagtgtaggcatattaacaatactgattcttccaatccatgaacatggaatatatttccatttatttgtgtccttttcaacttttttcatcaatgttttatagttgtcatggtatagatcaccacttctttcgttaagcttatttccaggtatctaattttatttatagttattgtacatgggatattatcttgatttctttttcagattgtttgctgttggcatatagaaatgctactgatttttgtatgttggctttgtatcctgcaactttatgaaatttgtttattagttctaattgttttttgggggagtctttaggtttttccaaatataagatcatatcatctgcaaacaaggataatttgacttcttcttttccaatttgtatgccctttatgtttttctcttttatgattgctctagctagaacttccagtagtatgttgaataacagtggtgaaagtggagccatgcacggtggcttacacctgtaatcccagcactttgggaggactaggtgggtggattacctgaggtcaggagttcacgaccagcctggccaacatggtaaaaacccatctctactaaaaaatacaaaaattagctgtgtgcagtggccggcacctgtaatcccagctacttgggaggctgaggcaggaaaatcrcttgaacctgagaggcagaggttgcagtgagctgagatcgcaccattgcactccagcctgggcgayaagaatgaaactccrtctcaaacaaacaaacaaacaaacaaacaaacaaacagtggtgaaagtgggcatccttgttgtattcccaatcttagaggaaaggctttcagttttttcccattaagtgtgacactaactgtgggtctgtcatatatggcttttatcgtgttgaggtatattcctcaacacattacccagtttgttgagggttttcatcatgaagggatattgaattttatcaaatagtatttcaagattaattgaaatgatcagatggtttttatcttctgttgatatgatgtatcacattctttgatttgcatatgttgaatcattcttgcatccttgagataaattccacttggtcatggtgaattattttttaatgtgttgttgaattcagtttgctagtattttgttaaggatttttgcatcaatgttcatcagagatattggcctatagtgttcttttttctttttgttcctttttccttttctttctctctytttttttttaatgtgtctttgtctggtgttggtatcagggtaatactgacttcatagaatgagtttggaagaattcactcctcctctattttttggaatagtgtgagtagcattagtattagcttttctttttaaatgatttttttttttgagacggagtctcgctctgtcacccaggctggagtgcagtggcgtgatctcggctcactgcaagctctgcctcccaggttcacgccattctcctgcctcagcctcccgaggagctgggactacaggcgcctgccaccaygcccggctaattttttgtatttttagtagagacggggtttcacygtgttggccaggatggtctcgatctcctgacctcgtgatccacccacctcggcctcccaaagtgctgggattacaggcatgagccaccgcgcccggccttctttttaaatgttttgtaaaaattagcagcgaagccatagagtcccaggtttttttttgctggcatactttttattatagctttgatctcattgttttggtctcttcaggttttgaatctctttgtggttccatcttggtaggttgtgtgtttctaggaatttattcatttcttctaggttttccaatttattggcatatagttgctcatagtagtctctaatgatcttttgaacttctgtggtatcagttataatgtctcctttttcatctctgattttatttatctgagtcttctttctttttttcctagtctggctaaaggtttgttgattttatcttttcaaaaaaaaaagaaattttcattttattgttcctttgtattgttttttaaatttcatttttgtttatttctgctctgatctttattatttattctactaattttgggtttggtttgctcttgcctttctggttytttaagatgcatcattaagttgtttatttgaagtttttcctctttcttgatgtaggcatttattgctataaactttcctcttactactgcttttgctgtatcccataggttttggtatgttgtgtttttatttttatttgtttcaagaaattttttcttttaaaaaaaaawttttaaattttaaattttttctcaatcaatgccatgccagaatttcaagaaatctttaaagttgtttcttgatttcttcattgattcactggtcattcaggagcattgtttaatttccatgtgtttatatasttttcaaagttccytatgttattgatttctcgttttattccattgtgaacagagaaaatacttaaaatgattgcagtgttttcatagcctaataaatggtctgttcttgagaatgatccatgtcttgaggagaagaatgttaattctgtagccattggatgaaatgttntgtaaacatctactaggtccatttggtgtatagtgcagattaagtctgatgtttctttgttgatttgctgtctggatgatctgtgcaatgctaaaagcagggtgctaaagtctctagctattattatattaggatctatctctatctttagctctaataatatttgctttatatatctggatgctccattgttgagtgcatgtatatatttataattgttgtattatcttgctgaattgatgcctttatcattatataatgaccttctttgcctatttttatagtttttgacttgaaatctattttgtctaagtatagctactcctgctttttttcatttccattttcatggaatgtctttttccatccctttatttttagtctatgtgtgtctttataggtaaagtgtgttttgtgtaggtaacagataattgggtcttgtttttatatccattcagccactctatgtcttttgattggagagtttagttcatttacagtcaatgttatcgttggtaagtggggacttactcctgccagtttgttgttttttggttttatctcccttccttccttcttttctgtcttcctttttgtgaaaatgattttctctggtagtatgttttaatttcttgctttttattttttgcatatctgttgtgggttttttaattcaaggttaccatgaggcttgcaaataatgtcttataacccgttatttaaaactggtaacttaactctgattgcaaaaacaaagaaactaacaagccaagggaaaactaataaaaactatacttttacttcgtccctgcctcttacttttaactccttgtggtttctgtttctatcttattatactatctatatcttaaaagttattgtagttgttatttttgataggttcatctctttagtattcctactcaagatatgagtagtttatacaccacaattgtagtgttatagtattctgtatttgtctgtgtactcactattaccagtgagttttgtatgttcagatgatttcttattgctcattaattccctttagcatttcttataggacagatctgttattgacaaaatccctcagctttcatttatctgggaaagtctttatttctccttcatgtttgaaggatatttccacaggatatagttttctaagataaacatttttttctttcagtactttaaatatgtcatgccattgtttcccggcctgcaaggttcccactggaactcctttatgtgttacttgtttcttttcttttgctgcttttaggatcctttctttatccttgacctctgggagtttgattattaaatgtcttgatatggtcttatttgggttattctttttttttttctgtcttctttgctttttttttttttttttttttgagataggttctcactctgtcacccaggttggagtgcagtggcatgatctcagcycactgcaacctccacctcctgggctcaagcaatcttcctgcctcagcctcccaagtagctgggactacaggtgcaaaccaccatgccccactaatttttgtggttttggagagatggggtttcaccatgttgccgaggctagtyttgaactcctgagctcaagtgatccacccacctcagcctctcaaagagctaggattataggcatgagccaccactccaagcatgcccatgtattttcaaatagcctgtcttgaagctcactaatactttcttctgtttaagccattctgctgtagagagactctgatgcattcttcagtttctcaattgaattyttcagctccagaatttctccttgatttttaaaatttatttcaatttctgttaaacttatctaataggattttgaattccttttctgtgttaccttgaagttcattgagcttcctcaaaacagctattttgaattctgtctctaaaaggtcgcatgtctcggtcactctgggattggttactggtttcttatttagttcatttggtgaggtcctgtttttctggatggtcttgatgcttgtgaatattcatcaatgtctgggtactgaggagttaggtatttattmtaatcttcacaatgtgggcttgtttgcactcacatttctcgagaatgttttccaagtactcaaaggaaattgagtgttgtgatctaagtctttggtcactgaagccatatatgcattaggaggcaccccaatcccagtaatgccatgactcttgcagacttgtagaagtactgccttggtagtcttagataagaactgggaggattccctggattaccaggcagtcttctattctcttccctactttccctcaaatagaatctctctctccattctgagctgcctggagttgggggaggggtgacacaagcactcttgtggccaccattgctgggactgtgctggatcacacctaaagccagtaaagtactgggtctcgcccaaggcctgtgtcaattattgcctggctattgcttatgtttactcaaggcctaagggctcattagtcaagaggtgatgaatcctgccaggcttgcgtctttcccttcagggcagtgggttcccttctggcccagggtgggtctagatatgctgtctggaagctaggacctggaattgggaactttaggaatctatttagtactttattttactgtggctaagctggtacccacattgcaagaaaatgacctttttattcttccctctcctttcctcaagcagaagtctctcttttcctcaagcagaagtctctccccatgtccaccaccaccatgagccccaggtccatggcaacaactgcctggctactgctgatgtttattcaaggcacaaggaccctttagtaagcaggtgaatcctgtcaggtctttgtatctcccttcaggacagtgggtttccttcagacctagggcagatctacaaatgccatccaggagctaaggcctggaattggggaccttaggggtctgtgtggtactttattttaccatggctgagctggtacccaaattgcaagacaaagtcctttttacttttccctctcctttcttctagcggaagctgtctttcccatggccaccataggtgagaacgtactgggtcacacctaaaagcagcactacctagctgtgtgatcttgagcgaattactcaatatcatcatctgcaaaatggaaatgatagtaaatagtacctttctcatatgattgttataaggattaaatgagttaacatgtgaacctggtatattattagctactgtaattggttgtaaaagtctggatatacctaatggtacactttttaaaaaatctttttgcctctaatattacaggttgaatgtcaggcatgccatctcttttcaaatagatttaaactaaaaacattattaaagaagaaatgagagattgctctggctacaggatgaagaaatgatcagagtcagggcaggattcaccaggagagcaactcagtagtgagttccagttagttctagaggctatgatgcagytatcttacagataagcacgcggggcaagttgctaggggaacccaggctctaaaattgcagttgaagtaggtaagctctaaaattgcagtaggtaaaaggtaatatgggtaagataattgctgctggtagaactcaatgagagggaaggcctgggggagactgtcagtagtgaacctggggcctagaggcaacaataaaagtaatgcttattttcagttcctgcagtctgtggctccttcaaacatattcctgagggcaaaaggtaactgaccttagggtgaggtagttggacgacagagtatataggtaaagcaaagaaaggcattgtagagctacacacagcatttgcaaagccataaaatgtgcaacagatgtactcagaactcccatagttcagaagcggggtggatagcaatgagagaagagaccccaggagaatggagaaggggctagattatgctgtcttgtatgctatgcatggcagcctctttttagtgcctgcttagtatttatctatccctcagggaatatgaccctattcctagctcaggggtaaatcctgatagtctacaccaatcataataatctatttcatttcctagcattggtttaggtgtgtgtgtgtaacccagtgtagtcaatgagacatagagaaaagttgcctaggaggtctttgggaaagatttcttcactctattatttatatatatakagagagagatggtgtcttgctgtatgtattgcccaggctggagtgcagtggctattcataggtattcatwggtatgaccatagccttgaactcctggcctcaagggatcctccagcctcagcctccttatagccttggacttcagctactggccaccatccctagctggtttcttcactcttaaaggatacctaaggaatagtcagtctcttttcttccactgatgttgatgtctgagatgtgatgcctggaaatagggctactatgttgtgaccatgaatggatctagcctgaaaaccaagctcgaatactccaagaatggtasagcagagatagaacaaactggagtcatttatgtcattgtggggcactgcatcagccaaacataaaggtgcyctacttgstaacctcttgctatttgagataataaatgtttcstattgtttaagccaatctgagatagggctttctgttatttgtggctgaaggcatggtaattgaaacaacatgcaaagaaacttagccttatcatgtagggaacatgagatcaaaaaaagatctttaagcaagaagtgacaatagcatttttttgcattgtggactaagcagtctgtcaaataaattcactataattttaacatttaaatgtaccccaagttgattttgtcccatgatataacaaataccatatgttatattacatatgccatttagtttgaagtaaatttacaaactggaatttaaaatgataaygtctactctrctaatgatgttgagtatgtactagaggaagtgagagtgaagaaaaatgatcagttaagtccatgagaagtaatgagaactttaatgaggaggaattgatgaatcaagaagcaatatcatctggacttagtgatgactggtggtaaaaggggaggattacaaaatgattccaaaatgttgggcttggatttccagggctctatttaccaggagaagagcctgaagaaggttttggttgcagtgaccagaaacctaatcaagctagctaaggaaggatacaggagtatctctcagagcccagagcaagaagtttcactgggcctcagccagagtagactgarccctagggaactggattctacctgttctgggtgatggcatatggtctgtcatttctgcttctctcagcacatcagcctcattttctccagactggttttctctgttgggcgtggtgatcttatagttatcccagccccagctttcttggacccagcagagactaactcaggtcttctatgtttcagttccaaactctcgggagagagactctaaatagtccatcttcgatcaggtgcccattctttgtcctgagagttctggttgaacagctaaattagtggtttgtaaggcaattcctcccaggattataagagagcatgtcctctaaaaggggatatgggaatagcgaaacagtaaattgatggaggagatgattacatttcaagtatattagtggctacaaatgatgaaacagatagggatgggagcaaatgataaattaaaatttgaatatattaattttgtggagctcaagggaccatcagtggaaaatgtcttttaagcagagatctgaactgaagttggaaaggtgacaccatcagaatgtaggtgggaataaaaaaagaaagaaggctgggtacagtggagcacacctgtaatcccaacaatttgaaaggcagaggtgggaggattgctcgagcccaggagttcgaaagcagcctgagcaacatggtgaaaccccgtctctacaaaaaatacaaaaattagctgggtgtgatagcacacaactatagtcccasctactcgagtggctgaggtgggaggatttcttgaccccaggaggttgggcctgcagtgagccaggatcgccccatggcactccagcctgggtgacagagtgagacactgtctcaaaaaggaaaaaaaaaaaagaataatgagatatgagacagacctatcagaaggatcacatagactgagaagaggagagtcaaggtttgtgctaccagacacactgatttgtttttattttatctacttttaaagtaatgaatagttcaatttttagaatcttgaaatggtatttataaagagtttccttcccacccgtgtcccagycatacatttcccttccctgtaggcgatatcatcatttatatcttttcaaagatcagctgggcgtggtggctgacrcctgtaatcctaacactttgggaggctgaggcggaagggcatttgaacccaggaactcaagaccaccctgggcaacatagcgagaccctgtctctacttatgtgattatatatatatatattttctaaataaaaaatgttaaaaaatgataatctatgcatgtaccagtaaatacctttattatttctacaccccccatatttttcaaacacaaatagtaatataccatttacttaacttatttaaacaattccttagtgatggatgtttaaagtgttttcaacttttgctattatgaacaaaacaacaatgaataactggagtgcaattttttttaaagaaatgggtgaagaagataaactaatgaagagccttgaggaggtcgtcaatggctcttgctcccacagtgccactcaaactayagtaacaggagccatccataatctccaccccagctcgtctctcttggacattgcatgctgtcatgcttctcccttggctgtcacacccccttcccattggttttccactcgcttatctactctttgccagacccctggctcttgtctaaatctatcctgttctttttctttttctttttttttaaaggcagaatcttgttctattgcccaggctgaagtgcagtggtgcaatctcagctcactgcaacctccacctcccaggttccagagattctcctgcctcagcctcctgagtagctgggattacaggcgcatgccaccatgcccagctaatttttgtatttttagtagagacggggtttcaccatgttggccaggctggtatagaattcctgacctcaagtgatccatccgctttgacctcccaaagtgctgggattacaggcatgagcccctgtacccagcctaaatatcctaagtgaggcagggcaactgcaagaagttattctgtggttacacctctggaatctagaaaggsctttaagtgtaaacccattatgaaaactaacaatctcactaatagggatacattaatatcattcctcaatatttactagccatgtgaccttggacaaactcattgacctttctgagccttactttcctcacttgtaaaatcaaaagaataatagtatccctttcatagggtggttgtgaggatgaaatgaaaagatgtatgtaagcactcagaaataatacttggcagtcgcactctttgcagaagataatgaaaagcatttcatagtaacagctcattgcatttcagctaatatagagctatccccagatgggcacctgggaattcctttccccatctttgtctttttgtcttttctattttaccctattgcacatcccccagggtccatgcttcatcctgccagagccacaggaggttcaaggccaaagtcaagttgggaagactgaaggtggcttcttacagctttccatggcggtttctgcagacaaataaatctacttcaatccacttttatactaaattatcctctttctacctagggtggggagatctctgtctccctgcagtttaatacaatagcttgaaggataaggactaagtaaggaggcagataatgtaaaagtagactatactttttgaaaccttggtagtgaagagaagagagacagaaacactaataacagggttaagattgcaatcatttgaaatttaggcttatttacagtctattcgatattgtatgttgaatgatgcagtccaagctggggaawataggcttttgtagaggagtatgcttctcttctagaccagagaggtttgttcattctggagcactcaaagcaaccaactccaacttcamcaaagtagaaaaaccagcctcttaacaaagaaattctttgcagtccttggttcccatggccaattttaaagtcaaaagacctcaatacattttttttgcttttatcaatttaatacattcacttactattattatctgccttcaaaaacatctgactttagggatgacagttttcactatcctggggarttaaccttaaaactaatargtgtctctatggtgcagccaaagttacaaagccagactgaagtctgcagataccaatgatggttggtctttgtttaaccactaatcactaagagacctsactcccaggggtcttaaatrttagggtggaagatggtggatcagtctacrgtacttacttcctgacagcaagtcagaaagttgatctttttttcatttaaatttaatttttattttactgtagtaagaacatttaacatgagagctaccctcttaacagatttttaagtatgcaataccatattgtcaactrtaggcacaatgttgtacagcagctttctagaacttattcatctcacataactgaaactttagcaactccctrttttctcttcccctccttctgcttctataaatttgactattttaggtttttcctgtaagtggaatcatgcaatatttgtccttctgtggctggcttattttacttagcataatgtccttaagtttcatctatgttgtcacatattcaggatttccttctgttttaaagctgaataatattctattgtktatatacaccacattttcttatccattcatctattgatgaacatttaaattgtttccacatcttggctattatgaatagtgctgcaatgaacataggagtgcaaatatttctttgagatcctgatgtcaattctattggataaaatttctgaaataaagaactcccacaactcaacagcaaaaaaactaacacctgattttaaaatggactaaggatttgaatatacatttctccaaataaagacatacagatggccaataggtatattaaaaaatgttcaattccactaatcatcaggaaaatataaatcaaaaccacaatgaggtatcacctcactcctgttgaaatgactgttaccaaaaagacaaaagataagaggtgttagtgaggatgtggtaaaattggaacacttgttcactgttggtggaaatgtaaaatggtacagccactgtggaaaacagcatggaggttcttcaaaaagtgaaaaatataacatataatcagccatctacttctgagtatttatttaaaaagttgatcttgattgacaacccgaagttagacaaaatgtgggaaaactcttacaccacacattcagtctcattggatggcagtttatttagatgtatcaaattgttttgacccagcaattctacttcttgtattgaaagctgtaagtacaagatgtatgtacaaggtactacagatgtatgttctttgcagcattgtttgataaatgtatccatctttcactaaaaataaaactgaaagcaaccaaaatgtttgtaagtatggaactggttttatataatacagccaccaatattacataatacatatgttaaaaagaaaaataagagtcaatttttatttcagagacagggccttgctctgtcattcaggctggagtgaagtggcatggtcatagctcactgcagccccaaactcctgggctcaagcaatcctcctaccccagcctcctgagtagctgggactacaggtgcatggcattaagcctggttaattcttttttcatttttttttttaagaaatggtgtctctctatgttgcctaggctggtctcaaactcctggcctcaagtgatcctcccatctcagcctcccaaatacgtttttttgtttgtttgtttgtttggttggttggttttttttgagacagggtctcactttgtcacccaggctggagtgcagtggcacaacgttggctcactgcaacctccgcctcctgggttcaagcaattcttctgcctcagcctcccaagtagctgagattacaggtgcctgccaccacactgggctaatttttgtattttgagtagagacagggtttcgccatgttggccaggctggtcttgaactcctgacctcaggtgatctgcctgcctcggcctcccaaagtgctgggattacaggcatgagccactgtgcccggccccagataagtattttacatatataccctcatttgatattcacaacagctctacatgtaaggtaatcatacatcttgatttgccagaacagtctccatttatacctgtcacaatataatgattagtagtgcccccttcattctcaaaagtacctctcttggacagtaaattgtgtggtcaccttatctatgaggaggttattgtcatcaccttattgaatagctgaggaaagggaagtgttaagtaactttcccacrttcacacaagtagaaggagagaccagcagagatttaccatgatgtcagaatacagttctgaatttcttggggcaaagaaatgttgcctgtctctctaggacgccatcggcttccaatcaaagcttgagaaatcagccctggaaaattgggaaatgctagtggcaggcttgcagatggaaggcagtgtaggacagttaagtctgtccatttcctcataaaagtatatcattattccacctgagaggtttttatcatcatccctaggagctcatcacttttctttgccaacctttggctccctctcaggaattaaggcctggttttacctttctgtgttggcattttactttttttttttttcccaccattccatctgttctctttccctgaactcccaacagaggtgatgctttgagggcagggataatcatgggcataatgatatttatctaacttatctatactgtgctaggatcagtccagctaaactaggtaaattcctcttgtgtttactattttactgggagccaacttatctggaaaggctgaacagtacagagaaaagaggctagaatttcaggaagttaggacatattcattggtgaatatgttggctgccatattgttatatcatgctcaaaataaccctaaaaggtaggcagtattgtcctaattttctgatgtggaaattataaagcacataaatatatctcactaaattcaaacatatgtatccattcttaactcttccttaacttggtattccaaaatgctcatcgccaacccaacagaagtcagagaggaaaacaacaacctttactgattgcagttgaaatattctacttttataaattttacaaaaacatatggccttgggccaggcgcagtggctcatgcctgtaatcccagcactttgggaggccaaggcgggcagatcaccggaggtcaggagttcaagaccagcctggctaacatggtgaaaccccgtttctactaaaaatacaaaaaattagccgggcatggtgatgcatgcctgtaatcccagatactagggaggcagaggcaggaaaatcatttgaactgggaggcggaggttgcagtgagccgagatcacgccattgcaccattgcactccagcttgggcaacaagagcgaaactccatcaaaaaaaaaaaaaaaaaaatacttgtgaacacgttaatataattcctccaggaccttggaaagttcccatgaattgagggtcctgatgtttaagatttattagtttcatgaaaaatctgtaaatccatttctgataacggagatagaatttggtagatgagggagaaattccaaacttgtgtgtcactggcagctggtayataaagaaattgatactgtaagccttcacagtggcagggtagggcttggcgacttgcctcaggctgtggatcaaagggctccagagtgtgggatctaatggcatagactgtggtccctgcagagtaggtagtgagcatggtgagtaatgtctgccactcactgcttcctgtgattaacagaacatgacaattaagcagaatgtactactggccattatggaaaaagggcctgcagaactgccaggggagtttgtgttccagatgaagggaggctgacttgggactccacagttctaagggatggcctcaaacctgtctttacataagttggccacttctgtctatttgttgcttaggtaccctcctattagcatccactctagctgcacagtaattataatcactgtgtataagtgttctgtgaattagagcttcaagataattttgaaatagttgagatgaaaagttagactagattagaaatccatctcattatctcaagaaatgcaccattacatttgccaatgatgttaggttgaatataacatcaactgtgaatataacatcaactggctgggtgtggtggcccccgcctgtaatccccgcactttgagaggccaaaacaggtggatcagctgagatcaggagttcgagatcagcctggccaacatggtgaaaccccgtctccactaaaaaaaaaaaaatacaaaaattagctgggtgtggtggcaggcacctgtagtaccaactactaggaggctgaggcaggagaattgcttcaacttgggaggcagaggtagcagtgagctgagatcgctgtgtcacccaggctggagagcagtggtgcaatcttgtctcactgcaacctctgcttcccagattcaagcgattctcctgcctcagcctcccgagtaactgggattataggcacgcgtcacgacaccgcgttgattttgtatttttagtagagatggggtttcaccatgttggcctggctggtctcaaactgctgacctcagttgatccacccgtctcggcctcccaaagtgctgggattacaggcgtgatacattagatagattgagttttaggttcctgtgggaacaccgtaggagacattaagtggtgtctaatactggaaagtgctctgtagatatacatttggagcttgtcagtgtatgaaaggtagtcmaagtcatgggaatggatgagtttgaccaagacactggataatgggaagacaatagagccaacaacagaattttgggatcactactttaatattacgtgccagagctgtttgtatatacagtggtttctttcataaatgtatttgggaggaaagcatttttagcaaatatgaaattgctcctgtaggggagtatcaagttgcctagggactgtgccctctccatttaagagtctcagccgggtgcggtggctcactcctgtaatcccagcactttgggaggctgagatgggcggatgacctgaggtaaggagttcaagatcagcctgaccaacatggtgacaccccgtctctcctaaaaatacaaaattagctgggcgtggtggcgcrtgcctgtaatgccagctactccagaggctgaggcaggagaattgcttgaacctgggaggcagasgttgcagtragccaagatcgccccattgctccagcctgagtaacaagagggaaactccgtctaaaaaaaaaaaaaagagtctcaaggttatctagttgactgaggagggtggatggtggtgacagacttcaggatttaacataatctttctggttgctccttctctgactcttttgctgactttcactattgaaaagcatgcacactgccaatcccattgctttccctgctctccctttattgtctcccttaaaaagtcagtggtgtgtggcaagcagggcatgtaccttgaaaataggcagacccggtttagaatcccagctaactgtgcgcatgggcaaattacttagtctctctaatcctctgtttttctcatcataaatctgaactaacaatatctgccaggcagggttgctgtaaggactggaaacagtatgtaaaagcaccctgcaaaaaacctgatgtactgaagctgtgcttaccatcatcagacaggtcatctaccctaaaggattttttttcttgttccttctttccgcaaaaaaacacaaagaatctagtctgacaaggattttgccctgattcaataaaaatgagactggattttcatattgttgaagagatgatgaggactcccctttaaaaccagagatgctaaaatccttaaattatctggaaagattcttactaaattttgctgataaagaatcaatactgaagatttttttttgtctctttcccttctctttttggggaaatcagaattcctgttctgaaatgtaagtagatctttatcttaaaaataggttgacaaggacatctctctcctttttctttaagcagatggtaatttgtgattttttccccctggtgctggattccgcctggaggtattaggtgtggacattaggacatggtcaatgttccaccataattccttaccagtagataccagtttctgcaaataacttctgcattgaaattttgagttctaggctgggcgcggtggctcacgcctgtaatcccagcactttgggaagctgagacgggccgatcacgaggtcaggagatcgagaccatggtgaaacctcatctctactaaaaacacaaaaaattagctgggcatggtggtggacgcctgtagtctcagctactcgggaggctgaggcaggagaatggcgtgaaccctgggaggcagagcttgcagtgagccgagatcgtgccactgcactccagcctgggcaacagagcaagactccatctcaaaaaaaaaaagaaagaaattttgagttctaatattactccttcactccacttccatgtttttaattaggttctggccattttacctagaaacaccactgctcctcacactagacacttttaacactggtagtttcattgtcttcctctaagctctttcttctggctgtccaaatttcttcggtaccattattctcctggtgatacaagttcaaaaatcaggaggctgggtggctgaaaaacatgatcaaagaccctgatcattcctgtctctctgttcactcatcttcatcttcaggccagctgccctcttggttacaaaatggctgrcagagatctaggcatcaccctagatactccaatgttcagatgaagcagacagtagtttctcttgtatgtgtaatatgaataaagaaatatttccctaaagtccttcagcagacgtctcacatctcattggccaaaacatgctcattttaaaaacaatcagtcactggtaaggagtatagggttgtcatgattggcttagattaatcaagatatggccctgagccagggatagtgtcatcttccctgatgtgtagatacccaaataaaactggagttcttctaacaagaaaaaaggggaaaatcaaaagaagtaagatatatgattctggtttccttctaccgtcttagtccaaaccccagaccagcgtctcaaggacagctgtgatagtttaccaactggtctccccacattttttccatcacaattttgttggatttatcttccagaaacactgcttttccacttagcccttttgtttaaaaatgccattggttctctctaaccttcagaaaaacattcaaacataccatagaatgtttaaaccatagaatataagagttagaaggcccagcgagctttgaatgtcaaaactagcaccaagagctagactagaaaacatggacgtgtggtcttagctaaacacctcttttgcttaaccaaaggaacagtatacagaaatctccctaaaagaacaatcttcaagctaagttaagtaactttctaaggaggtgtatcagtacagattcttaagagaatcaattttggcttgttctctctgaaggctagccttaagtttcatacaaattcttttttttttttagatggaatctctctctgtcacccaagatggagtgcagtggtatgatcacggctcactgcaacctccgcctcccaggttcaagtgattcttcttccccagcttcccaagtagctgggactacaggcacgcaccaccatgcctggctaatttttgtatgtttagtagagatggggtttcaccatattggccaggctggtctcgaactccggacctcgtgatccgcctgcctyggcctcccaaagttctgagattacaggcatgagccaccatgccygggcctacaatttttatgtgtgtgtgtgtgagagagaaagagataaagaaagacagacagagagagagagagagacagagacagagagagagagacagtgtcttgctctgtcacccaggctcaagtgcagtggcatgatcatggctcactgctgccttggcttcctcagctcaagcaatccttccacctcagcctccccagtagctgggacyacaggcctgcgcctaccatgcccagctaatttttttttttttttttttttttttgtagagacgaggtcttactatgttgcctaggccggtcttctactatgttgcctaggcttaagcaatattctcacctcagccttccaaagtgcgctgggattataaacatgagccatcatatccagccaaattctttattttcaccttccattkcaaaacagcctatcttctccttacctgtcttgamtcttaccttggtacctccaaaatcttgagacctctggggaataggggagggggaaacaaagggaccatttgaagtattggctcctcccatccctggcctctctggttattgtcaaagaatgcataactctggagagagagacccatgacagcaaagtaaagaacacttcaaatgctaaaaatggagtctgctttttgttttcacttattttcaaaacaaaattctcaaaacctaggaggggccattagctggaaaaaatgtctctgagcagcagatgcagtgccagatactgatgctgattcagggctgagygatgcatccataccaascacataccaaattttcacatgcctttccgagtgtcattcaccttttgtagaatgcagtgtgaatgatccctctaaaattgggggtaacataaaaatagttttaaatttaaatggaatgttttctgaggttactacattctctactacacaagatagaattcatggattaaaaattcacctgatttttttacataaygtacacatcattgaataaaktaattaaaacctacttctatgaaattaygtcattgaatatttttccagtgrtagtcaattctcaacttatttcttcttttaactgatttttaatttttattttttttaaaaaacagagacagggtctcactatattgccyagactggcctcaaactcctgggctcaagtaatcatcctacctcagcctcccaaagtgctgggattacaggcgtgagccactgtacctggcctatttcttcttttaaaacatttatttttactcctattaacacaaagtaacattatatgccagctgccagacttcatttttagcaattcatactttttctttttcattaagtagataggaaaagttaacaataaaagttctaaaaacagctggatgtggtagcatgcgcctgtagtcccagctcctcagaggctgaggcgggaggatcgcttgagcccaggagtccaaggctggaatgagctgtgatgrtatcactgtactccagtttgggwgaccaagtgagaccctatttcttaaaaaaaaaaaaaaaaaggaaaaaacttcttccattaccatccatcctcttatatatctttttatagaaagattttttatataaacatttataaaaataaaaagtaggcataaaattagtactctaagttgagatacatgaactaattgaaaatagtcccattcatcttattaagaactatatctctaataaaatgtttctttttaagttatttatattaatttaacatgtatgtgggtcactttgatatttttacaccaataataattgtaataataataagtttttgactctttagaggcttggccatggtagaaactattacctggctcccacaatttgttccaccctccttcgggtacgtaggtagcctacttttccccatcatccttgctgtaacatgtagtcatgtaattgttctggcaacaacwtgtgagtggaaatcatgtatgtcacttccaggcctggtcccatgaaatatcttctgtgcttttctttgctttttctccttctaccagctacacgaattgagaatraggctctaggaaagcggttrgcraactttggtaaaaagccagacagtaactattttgggctttgcggccacataaagcctctgatgcacattctactggttgtttttttgtttgtttgtttgtttgttttttgtttttttgtagccttttaaagatgtaaatctattcttagctcccagagcacacaaaaataggcccacaagctaaaccctttttctaggagacagggaagccataagatgaaaggaattaggttcccctcatcactatgtggtggggagcactttgcttacctggggacctcacccaggactattctgtgagaaagaaataggctttgattgtgttgagcagtkacatgctggacctatttgttattacaaatcagcttcataataacacaggaaataaaaaaattrcaaacatttttaatgcagagaagtataatataaaaaatgaataataagacctttaagcataataatatagtacattaagataaatatgtagaagtagaataaaaataggagcttagggaaaaaacatctgactgttaaaaaagagctcatttgtagacttttaaaatggatgtggtgggcatcaaatcgcttggatttagattcaaytggatatttcaaagcaaattgcaatagtttattttaaaatatctatattaataacatcatgaaaattacaacctttgcaattattyaaacatacgatgtaatattttagatgtcaactgaaaattttgtgaaggagtacatggttttaaaacattctgttaggggatatgccagcagaaacttttgaagaggcttcaaagaacccttatagactcagaaccaaacctcttttgaaagcttcgtagattccctgggctgaatgtacaagcaggggtttttctggtttgcctctgctcttttcgaaatcctgtgtctaggtcaccttagacagtgttcatacacaggaatgtccttgcttgtcaggagtcctgccagcggtgttgagaggccaggtgtagacctgtttcttctgaccttagattccccagtggatcatgaggatgaagctgttttctttcttcctttcaaaagtgttcccttcttggtggttctgaggattcatgagttaaatatttgttaagtttttgcaatatttggctgaaagtacgaagtcttatttattattgctggatggatgaaaggtattatacaagtgcaaagtatcatttcttcccaggacagacggcgttgtcatgcttaatccccaggcagctcatgaccccattctcttgcacggcctcctcatttacataaccagccacaaactgagttgaaaggactcctgcaagaggatttgcactttctccttttcttcagaatgtgtatctgcctaagcagtgkgataacttttttcccagactggatcgatattccttagctggtcctgytgcagcaggagtccggtgactggagagaggaagctcttgggcagtgagtaaaaaaagagaattgacttcttttttttatctgtttctgtctactcatcaggccctggacaagtcacttcacctcttgcctcaytttcttttcttttyttttytttttttttttttttgagacggagtctcgctctgtcgcccaggctggagtgcggtggcatgatctcggctcactgcaagctccgcctcccgggttcacgccattctcctgcctcatcctcycgagtagctgggactacaggggtccgcyaccaggttggacatcagcacctgtagaggggatagcaytggatatggaaaacttagagtagatagtgaaggaggaagaggataaatagcagttatggcctcaagaccaactacagcggtaggggctgtggtttgtctcattaatcgccctcttctaagattcccctgaggaggaaaggcccacagcaaccttggatgaactgcgccctgaaaaatggagaagtcagcctgtgtgatgcagtctgtacgsactgtgataaaaaccatgtgggtaaatgcttaggactttcttcaatagagtcactgtgaggacagcagtgagctgacatcttcaccagccacacctgtaaaattgcttgcactgttcacactgaaggccgtrgtttcttgtctaccaagggttgagcccagctgggtgctagagctgagccattgctgcccatcgcgggacgcccctaagggtcagctgttgccttggaagcactggcctggtcggggctgagacttttcctggccagccctccttcctaccctcctccttcactattgacagacgtgcattgcaatctgaatactctcctagcttactcaccttctttctcctctttaacttttgyaggcattttccccaatacatctctgctcatctgactcttatcttggcatctgcttcctggtggatctgaactgacccataagccacgcttactrgtgattttccaggtaatcatctatttttattcatttttttttcttgattggtagtttgaacatgatattaaacacatttactgtataaatatagatatcattgttggccaytttrctgtaattgaactctccagaggggtttcaggatggttttgctttttctagaaattgtagcagggaagcagaggtctacctttgtctgttttcagaagggcaagtttaccttcagagtttccctggattacttttaatgtttcctttccttttccctcccactggactcyagtactggggaccttgtttgtcttctttaaacgatagaagtgcaagttcaagtgaaatgacatttctagaagaatggaaattycttatttaagtgaagcccttttgagttcagatgggtatgtgataacagaaagagaagagcactcttgttcccagactagctacccactgctgcccaggctgcagagtaatgggactggtgcaggaactcatttgggattttccttggtaagattatgtggtcacaaaggaggttcccttgtaagatgtggggttcttgtatatgtgggggtatattgtatatgtgtattgttcttgtatatgtggggrttcttgtatatgtgtataaccttgtatatgtggggttcttatttcttgttccacaaaaacaaaacccctggcagtggtgaaatagaaaagactgactaaaggtaaaaacttggactctgtacaaaggcctttggtgattttgggtaaaaaaggccaagtctctcccaygccaatggcttgtgttggaggctgtaaagttactcatttagcaaagctgaccagaaagtcaaagggaggattcattagcaaggttgaaatttaccactagattatgcttgtctttccagccaaacagaatgagacttcatggcagtctttttgtggggtgttcaaacactaatgaaaaaaawwttgaaaccaaggtgactttttggtgagtggagtgtctgagggagcttatgtggagaaatcaatgtaactattgcctcagtgttgtcagagaatttattaaaagggatcccccgttccccattggtaactacttatttttttctaagaatgggatccaacacttcaaattttagaccttgagttgtgatgtgaagcaatgaagactcagttttttgttgttttttttgagacacaatcttgctctgttgccctgcctggagtgcagtggcgccatctcggcttactgcaaccactgcmtcccaggcccaagtgattctcctgcctcaacctcctaagcagctgggattacaggcgcccgccaccatgcccggctaattttttgtatttttagtagagacggggtttcaccatgtcggccaggctggtctcaaactcctgacctcaggtgatctgcccgccttagcctcccaaagtgctcagattacacgcctggccaagagtcagctcttgacagccccaaaaatctatccttagggcagatagaagagagagatttttcacatgataatgtatttaaatcaggattagacaaagaacttcatccttccttgctgaaagatacaagttgtcatatttaattggaaaaaggcagtcttttacacttatgagagaagtggatacctaaaaatctagaggcttctttccctaaaagccattaaccagtattatttttatagatttaatgccaactaaccagactctgaattattatcatctctagtgttgaactccaggctgtacaatctatacgagggataagccttgactgacactttcacagacagcagttacagaattttttaggaaggtgacaggtagatctcaagggtcttctcattcactttttctttggtatcttatcaagatgttttaattctcttttcaaatatcttcagattcttttccctctggtgaaacagatggcaggtaggaggaaatatacagaatgaactgtgaaatttctcttgtctaaaatcattcacaaaaaatgggagatgatgactcagtagaactacaacgtrcagccactgggttagtgcccatgtagtcctaacattgtttggctgttaagagcttcatgtgatacctccaagtctagaaggactcaaccagagtatcaggacagattgagacttggggcttccacgaatttggagcatagtgggatgctgggttgcctagacatcattagtaagatttttttcataattttttttttttttgagatggagtcttgctctgtcgcccaggctggaatgcagtggcacgatctgagctcactgcaagctccacctcctgggttcacgccattctcctgcctcagcctcccaagtagctgggactacaggtgcccaccaccacgtcctgctaattttttgtattttttagtagagacgggatttcaccatgttagccaggatgatctcaatctcctgacctcatgatccaccccccctcagcctcccaaagtgctgggattacaggcgtgagccactgcgcccggccccattagtaagatttgttttttcctataacaaaatgcatcaagttccaactaaacaatttacaaaataattttaggaatacaactcttaaaaagtagagacccaatgtttcatattaattagaaataatgattcacatcacagaaggattctttaatacacacaagcgctccaataatcagggtttgattgaattttcagtacctccaacacatttaagtttttatttatttaatgagagggaggagacaactaagcttckatatacattttaggagcctctgtacatcgtatggccattagatgacaaaacatttgtgaaatgatactgtaagtcagtggaggaaaaatgcctttaaaaacagcctctctttccctctctttaaaggaaaagacaaaatagtgtatgctcacagaggaggaagtaattaagagtctgattctgttaggaaactacagaagaaatataatttgaaagccggagagatactggaggggttgagtcctggtgctcttgttataaatcaatggcctttggcaagacataaacttttctaaaccttggttttcttatctgtaaaatagttctagtaaggtgtatctgcccattctcacagggttactatgagattcgtgtgtgactgtacatgtgaagttgttttgtagtctgtaaaatattntataaatatgatttattattattgccatagttgaaatactaacagcttttaatgatcataactagattgagatgtcttcaatcatatggtcaaattaggatgtattgtgtggcagatgctgtatgagaattaatctactctcttatctaagattatctagaaatatatatttttaaagaaaatttagccatttttaagcatgtgtgaattgaactggtgcccacaggcactggctttcttatactcaggtcctctctccaccttgttttggtttggagggctctcttctccttggctccaaaccacaaattaacttttttgaccaggcatgaaaagtgtcctaacttgtgtctggacaatgctgagacagagagataatagtagagcncatatatacttgactcttgtcaccaagaaaaataagacaaggaagagcagtggcttgaacagctagtgtaaccagatctgtgacttatttgggtaaagggaggagttgagtgaaattgtcaaacaataaatgttytaatcaggtggcaaactcttccaagctcagcttgaaagatcacttctgcccttgaacacaatggatattaaaaaaatatgtaccgtatttgttgaatggatggataatattgagcaccttgaaattccccccaccccaaacactgctaattagttctctcatcacacccaaaataatactaataatatggtttgtacttctgagagtgatgattcagtgttatcatgttacacatatatacagatataagcacacaaagagaaatatttatctttttatttctacatagtttttaatataattttagcatctttttattcatttttccatgtttttgaacaaagttataatgatagtattcacagatctttgtttcgtaatttttctcattaaaattataaaaattcttaaaaacatttttcaggttgtcacattgtcttcataaacactttcaaataactatcagaatcttcattgcatatgttaagctgttagatatacttaaccattctcttcttaaatatttaggaaatttctgagccgggcgcagtaactcatgcctgtaatcccagcactttgggaggctgaggygggcagatcatgaggtcaggagatcgagaacatcctggccaaaatggtgaaacccccatctctaccaaaaatacaaaaattaactgggcatgatggtgggctcctgtaatcccagctacttgggaggctgaggcaggagaatggcttgaacccgggaggcggagtttgcagtgagccaagatgacgccactgcactccagcctggtgacagagcaagactctgtctcaaaaaaaaaaaaaaaaagaaagaaaggaaatttctaatttcccgttattatagatcatggtgcaatgagcaactctgcaatatgccctgatcattaacttctaaaccatactgtatattgttgagccttttcaaaagtgtatttttattttctaggaaaatatctattacttaatatttcccatttaaaaatatttcctccagtcccttgccccaaaatgatagcaaaaatactaaaggataaataacttacataaggtactgaagttaagattaaatatcaaaaattccttttttctctagcccaaatgcatyactaaagcaacagataacatcagacaaaagatagtgccttctggccgggcgcggtggttcactcctrtaatcccagcactttgagaagccaaggtgggtggatcacacctgagatcrggagttcgagaccagcctgaccaacatrgagaaaccccatctctactaaaatacaaaatcagccaggcatgatggcgcatgcctgtaatcccagctactcgggaggctgaggcaggagaatcgtttgaacccgggaggtggaggttgcggtgagccgagatggcgccattgcactacagcctsggcaacaggagcgaaactccgtctcaaaaaaaaaaaaaaaagatagtgccttccatcatcattatcatcaaaattatcttccttatcatcatgccagtgatgcatttattaagaacaccaaagtgaaacayggcaacaaaagagtaaatgcaaaaatgagtggcagcaccaattattttttatttaggtatttgcatatttgctatatgctggacactgtgytaaacacttgggatatggtaaattctgaaaacacaagtatcacgtttgatttgtcaaggaactggtcaactcttatcctcatgttgaaccttattcaatagttttctggactcttcattattcaaacctttatctattcaaggtccttgtctgttttgctcctcttcagttgctaatggtgacccaaccctggctctgggaattttctccatactggttcagcaagtcagggcaggttctgccccaagggcttctgggaccacagtcctctaacttagccaccmcaccaagtttctaaccatacacctttgctgaaatcagtcattcagaccaagtcagcaacccrgaggtagggctgagaagcagctgaagctttcctgaggcaaaaatggcagatgaatagcaggggcaaaatccactgggttaggcatgtacagaacactcctgcatggagaacactttgttaggcatgggagaaacaaaaagaaagtgaagttctcttagacttgttctcagagagcttgcaatcttgttaaagagttgagtccagaagtagctgaaatcgtagtgaatggtgagaaattatctaacaaactgcacagtacactaatgggtgctgaaagaggaatgggcaaaatcatctaaaggtcactatgctctcaacaaggaattgtggccttcttaggagcrgtttcataagaaaatttttttttaagatggagtctcgctctgttgcacaggctggagtgcaatggcatgatctcggctcactgcagcctccgcctcctgggttcaagcaattctcctgcctcagcctcccgagtagctgggattacaggcacgcgccaccacgcatggctaatttttgtatttttagtagaaacggggtttcaccatgttggccaggcttgtctcaaactcctgacctcaggtgatctgcctgccttggcctcccaaagtgctaggattacagacgtgagccactgcgcctgacctcataaagaaatttaagctgcttctagccctgcagctatttacagtccagttggggaggcaagagatttctgaggcgaattttacaatacaatatatgccgggcctggtggctcacatctgtaatcccagcactttgggaggctgaggtgggtggatcacctgagatcagcctggccaacatggtgaaaccccatctctactaaaaatacaaaaattagctggcgtgatggcgggcacctgtaatcccagctacttgagaggctaagacaggagaatcgcttgaacccgggaggcggatgttgcagtgagctgagattgcgccattgcactccagcctgggtgacagagtaagactctgtctgaaaaaacaagacaaaacaatgtaaggcagtgttatgtttgattacatgtggaaagagtgaaaaagacaagaacaaggagaatttaggaagaagggagagattactgaacgcctggcaatggagtttggaggacaattttgagcagaattcaaatagcaaagttcaggtaggtgtattaacgaattaggccaaatatgcttgggtcagagcctggctgaagtgggagaaagatactttattactggatcatgtaagaaccagggtcagaaagctatgaagatggcagtgtgttgggaaacctttagtgccagattgatagctttgactcatatacttgtgaacagttgttaaaaaaaacttctgagctgggtaatgacatcataaaagaaggagaccagaaaacagagactggaggcagagaaaccagttaggagaccacttcaagcattttgagataaggtcctgtcgtgagagtgggaagggaagcatggattttgggggacactagaagaaagaatcaatagcatttgccgctgattggatgtgaacagagggaagagaaagggatgactcaggagaagcttcagtaggaagtgtgttgtggggaggatttagaagcaggcatggactttgttggaaagtgtttgcaaatggaaagatttacatatctatcagcaggagtgtgctctcaactgattatcttataaaagctgtggagtttctttatgagatagtcagacaaaaagtatcacacgatttaaaatggcaataccagggagcaactcctggctcacacaggatgcagtctggagaatgcactctgctctagagttacaaccctgggctgaatctcagggttttttgtttttttttaacatggtttcattgtatatatttggacaaaatactttctaactcatcgatccagtttccttatctttaggtctccatgaaacaaaacagccatatttgttgagtgctttattatgttaagcaggctttgtgttaagagctttatttggccgggcgaggtggctcacgcctgtaatcccagcactttgggaggtggaggcgggtggatcacaaggtcaggagttcaagaccagcctggcccaaatggtgaaaccccgtctctactaaatatacaaaaattagccaggtgtggtggtgggtgcctgtaatcccagctactcaggaggctgaggcaggagaatcgcttgaacccgggaggtggaggttgtggtgagctgatattgtgccactgcactccagcctaggtgacagagtaagactccgtctcaaaaaaaaaaaaaaaaactttatttgtggccgggcatggtggctcaagcctataatcctagcactttgggaggccaaggtgggcggatcacttgagaccaggagttcaagatcagcctggccaacatgatgaaatcctgcctctactaaaaaaatacaaaaattagccaggcgtggtggtgcacgtctgtagtcccaactactcgggaggctgaggcacaagaatcacttgaacctgggaggtgaagggtgcagtgagctgagatcaagccattgcactctagcctgggcaacaaagtgaaaccctgtctgagaaaaaaaaaaagactttatttgcaactttttattcttagaatgcacattctacatttaaaaaacatttcaatattttgtggcttaaagcaatatccattttatttgctcacaattctgcaatctgggctgggcttggctgtgcagctctgctggtcttactggtggtcactgatgtgtttgcagtcagccggtggggttggctgaggctgggctcagctcaggtgctgggcagctggacttttccctctctccaagtatctcagggcctttccttctccatgtggtttatccaacagggtaactggacttcttacttagtggctcaggtctcctaaaagtacaaagtggaagcttccataccttcctaggggatgggatgggaaaggcagggaagtggcacaacttcactgccacattttcctggttaaggcaaatcactggcccagtccagattaagtggaaggggctacrtaaaggtataaataacatgaggctgggccattgaaaggcagcaacgcagcagagagactaccacaatattatttccaatttgtaaatgagtaaactgtgacttaggaatgctaagctacttgcataatgtagcagatagagccagcttcaaatattgtgttctaaatcaaatatcaacaaataaaatgtgtatgtgttttcacctagaatcctgtggggtgggtactgttattgtccctaatttacaaaggaggaaacccaagaatagagagcttaaatgtcttgtctgaagtgactcagctgttttgttccagaaattatacacttatccactgtgctgcctcttacgggcagtacctgatacatacaagacatctgtaaatgttatttaatctgaagctyttgttggaatggctgggacaacagcaaatcttttgaattattcactattacatcttatatgctatttgggaactgggagtttttcagttatcctgtgttaagggcaatttccgtttcatacatctactttatctgttgcactatctatttcttgaagcttggaaagaaacgaagactgcatccttgcccatccagttccaacccagattctcactgcccatctaattccaaccctgattctcacctttcttcgggagtgaggactttcctagagtagggcrggcctcaagttttcatcttttaatcatcaagtcagccttgtgacttctgaattagtatcattaggttccagtcacttcctcttgttcgatagcttatttcccctgttgttgcaactgtgatggcttctgagagtagcttgcaaagattctactttccaaggagtgacctgtgctagtttcccctttccttttgccagtcctatgggcagaggacttgctgcacagaatcccagctactcgggaggctgaggcaggataattgcttgaaccagggaggcagaggttgcagtgagccgcgatcatgccactgcactccatcctgggcaatagagtgagactccatctcaaaaaaaaaaaaaaaaggatgatacgtgtatgcctgccttagtctaagatggccctaatttcttccagtctatgaggagtctggaattggagccacctccaagtacagataacaggggaagtggctcactttggtggttctgttttggatatggatgcagccattcagggagtggccccaaaattctaccttttccgaggcaaaactatgagtggccttgtcttttccttaaacttttctcctccaaggcagctccagattttaacttcgactttattttaccctgtaaaaatattaaggcaggctgggcgcggtggctcatgcctgtaatcccagcactttgggagcctgaggcgggcggatcacctgaagtcaggatttgagaccagcctggccaacatggtgaaaccccatttttgcttttaaaaaatacaaaaattagctgggcgtggtggcaggcgtcttaatcctagctacttgggaggcagaggcaggagaatcgtttgaacccgggaggcggaggttgcagtgagctgagatggagctattgcactcaagcctgggggacaagagggagacgtcactcaaaaaaaaaaaaaaaaaaattaaggcacaatacgtgaacttgaagaacatacagttctcttttatttaacaaacacttacgtaaccagcccggtgctgtgcgaagtgctttacattgtctcgtttgatttacttaataaactcctatttgaatcaaatggggtggagtaggggcttcctggaatttggcttacctcgccatctccccccaccctttcccctcagtggagaggcaaccagagagaaaagaaattgagctgctctgaagggcaaggcctcctyctacttcccgcagctgtttcgccagacttgaccttcttcccttagctagaggcagggggtctccatccctcgcccagatctagttggtgggaaggtgggtggcttttttcgggtcactggcgcaccctctctacttccagccacctgctcgggttccatcccggctccaggctccccggagggcggcagggacattccaatcctcccacaaccctcacggatgttgcgggggaggggggtgcaattgctcttctcttccaacacccagctttttcttctcaatctctagtggcctgagtcacccccgtagaggaaattaaggattgatgaatggtttgaaagttgtttgtttacaacccacccgttggcgaagccgcatctccagtgacagaggcactttctgggcaccgtctgtgctctagcagacaattgagagccaggcagccaagatgcctcctcgccagaccaaatatggtcacaagagctaagcagcctctcgtggaaaagctggccttgttggtgtctccccgcgccggggcgcacccgggcsggccttcgggcagaatcgcgggtcagtgcggcgctccgggtgctgcaggcctcggcgcctggctgcaggggagggcgcggtgtccaggaccggcccttcctaggcctgagcccctcatccgcgtgccctccgccacccccggccttggtttcggtccacaaccccttgatgaaacaggctcaggccactttccctttgatcccgccccaagtccgtggtaaactcaaaggaatgcagatgcaggtctgcgcgggagaggtccgcgcggccgggaggagtgggtggggggcacccgtctcctcttacccagtaaagtacccatcacgcccagggttttctggagccgaggtgggaggaggaggaggaggaagaggaggggcgagcgggggctggccggctagggactaggaggtcatacataattcaacagctcaactttcgggcccgcctctttcctgggggtgggagtttgctccaaactttgtttatgggacagtccgggagctgctgcggccgcgctgtctgcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccaggtagtgcccgctggagctcgcgcgctcatccggcaccactccagggctccaggctcctcgggcttccggagtcgagacgtggtggagttggctcgggctgaacttctttcggggggctgcctgtcctggaawcgtgcgacctttcctttgccatcctgcggttcagcaagccccgagtgcagttattccctccacccctcgccctatcttctcctcctccaggcaacttctttgcttcaagaaagttgcataattctcgaggtcaggagggacccctcccccatcctgctggtcttaccgctgagtgtctgggatctccaggcgggcaattatctgtctcctcgtttccttttccctctattctttctcccaccatctcgccctctcaccctgtaaccctcttacccacttcctccgactttaaataaaaggctgatctgaccttctttttgcagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccaccmggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaagtaagtcagcctggagccgaagaaggcaccaagtcacagtgcccaacgcgcgcgtgtgttcgtgtgtgtgtgtgtgtgtgtgagwgagagagagagagagagagagagagagaaagagagagatggtgcgtgtccttccacggttatttcacagatatggagagctggaagcagggagtgagtctctgagtgttggaattgtaagggatcagaagcagggatcagaagcagtggtgaagttcatccaccataaaacacacaggtgactttaccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaatcacaagcctgctttgtcactcttcttcctttcacattgttccagctttttgatgtcatgaattttacattagttgaaattttcaaattacaccccacaggaaaatatattctcaaacactagaggaggttgtttcaattgtggtaccctaagataactacattcctcaggagaaaccaggctggaacttgaaatgttccattgaggtcatagggtcaggctatcaaagatggaggttgtgccagcctaaccacttgtttcaggattgcctgcactgccagtgagggaaactcctctcctaagaacttgacttagacttcattttaaagcccatatttctttagtagagtagccttagtgcaaaagtgaagacactatgtacaattttaaaagtttaatcaagcctttctttggcactaatatttgatgctctgattgctatgagagagccctaagaatgaatacacagtgatggatgaagtttactatagtgagcccattgattcataccagtgaccaattcttattacttccccatctcaaggctgttgatatcttgtccaaggagttcttttgttgtttctgagattggtgtaatgctgagattctgaaacagacttgatggtcatttatgccacagctggtcttctctgggttattgagtgatagtttggacatgtgctcagtcctttgacttctaagtagctggtggagtcaagaatatgatgtaataacatgacttttgttgttgttgtttgttgtttgtttttgtttttgagacaaagtctcactctgtcgcccacgctggagtgcagtggcacaatctcggctcactgcaacctccgccccctgggttcaagcaattcttctgcctcagcctcctgagtagctgggattacaggcacccaccaccacgcctggctaatttttgtatttttagtagagacgaggtttcaccatgttggccaggctggtcttgaactcctgacctcaagtgatctgcctgcctcggcctcctaaagtgctgggattacaggcttgagccaccatgcccagccctacatgatttctttctttctttctttctttcttttttagatggagtctcgctctgtcgcccaggctggagtgcagtggcgcgatctaggctcactgcaagctccgcctaccgggttcacgccattctcctgcctcagcctcccgagtagctgggactacaggcacccgccaccaagcccggctacttttttgtattttttttagtagagacggggtttcaacatgttagccaggatggtctckatctcctgacctcgtgatctgcccgcctcggcctcccaaagtgctggaattacaggtgtgagccaccacgcctggccccagccctacatgatttctaaactgtgtttatgaatatatacacacatacgtatggtatatgatcagtataactgtgattattaaaaatatgaaataggagctaggcttgcctaatatctgaggaaaactagacgaaaaagaccctgaaacaaaagcaaaacaaaaaaattcctttatacattgtgttttgaatgattggagtagctcagaactgcctgtgaacaagggcaaaagtggaagttagccttggatttagagaaagttgctgtgatctctctgcccatccccccaaccacaaccactctccaatccaaagcagagtgcatcttcatttcactttgggtagtcaatgaaaatgacagctgaaaaaaatgtgtaagtagtaggctggcctgctctgatgctatccctggaagtattttggccaagtgactaagagaggttaagaatttgtcagtgactattgtctttaaggataagcaatctgccaagagttctctgaatttcttgtagagttttgtttaaagttggaattaggtaaatgtcatacactttgttacacagcctcaaaaggcagtgtatttcagtggattaagtagaagcttgaaaaatgatggtgactcacttggagttacttttcattatgtctgtttattactttacttgccatctatgaaatagggctgaggctagcagatacatttttttttttaatttttttatttttggctggggtagagatggggtttcactatgttgcctaggctagtctcaaactcctgtactcaagtgattctcctgccttggcctcccaaagtgcttggattacaggcatgagctaccatgcccagccagaagaagaatctttttcttgactctgttgggagttgagagctttataagttggaaatcaaaggattttagaatgacaagggtcaattttgtttagtttagtttttgactagaaaattgaggccacggaagggtgatgataggaatttgggaaagtcatgtggttatttaatggtggaccctggactggacctctaatctgttgctgtctacttaggcaacagttttcctttttccccaccgacacctttcccccatgtcacttccttagctaaacaatgaacttaatgggaaacagagcctggacatctaagaagctttaaaaaagccttttgtcattttctcaggtaagattattcctaggtatatgatgtaatcactttctgcaacctcctgaaggcacctttcctgagcattcacagctttcctgtggtgttcaggtgtcctgtggtattcagatattcctttagagtaacaatgacyagggcatggtggtgcccacctgcagccactaccacccccaccccatctctaaataaaaagtttttaaaaattagagtaacagtgaagcagattgaatgttaaaacacctagcctctgaaaaccactgtgttcattcattattcctgctgtcctctcaatctcatgaatcaggctggggtgttgggcaacctggcacactgactgaatactgatcacattaaatttttaaaaggtctctgattataaatagaatacatgctttctatacataaaccagaaaatggggaattataaagaagaaagttatctagcttcagtagaatttcccatctttactctttcgcaaacattcttgtaaaaatctttcatttgagtaacgtgattttataagaaaaaagattttatcctcctcttaaatacaattcagactataacatttggctgccacgtctcatttttagtgacaattttagtgttttgccttttctcaaatgtgtgacagaaaattatttttgtccaagtgatccatgcacttggtaacaaatccaatatacaggaggacatttgttgaaaaacaatggtttccttcacctcctcaaggctcacagagggaaacttttaatttttttcaactgtacccatatttaattcttagattgttaccttcttaagcttaagtaatgtgcttttaccaccatgttttgatttatcaacttttagcacctgatatgaaagtgagaatgtagctctttaagctagttttcttttttctctcccaggtttgatgtttataatattttaaatttgtctgttaggtcaccttttttaaataatcatctttttttttttttttttttttttttttttttttttttttttttttttgagatggggtctgtctctgtcacccaggctagagtgcagtgggaatcatagctcactgaagcctcaaattcctgggctcaagtgatcctcccacctcagcttcctgagtaactacgactataggtttgcaccaccatatttggctaatttatttaacttttttgtagagacagggtttcctatgctgcccaggctggtctcaaactcctggcctcaagcaatcctcccaccggcttcctaaagcactaggattacaggtgtgagccaccacacctggctttttcaactttggatagtatttcttgattccttatgctgtatgtcagtaatgtttggattgctaccagttctactgttcactttttgacaatgttgctttccacattgccaaagccctgaacccataacctgtatttgtgctttgccccaaagttgaccatcttattcgtatatgattcttaaagttgaaaatccataaggccgggcgcagtggctcatgcctgtaatcccagcactttgggaggccgaggcgggcggatcacgaggtcaggagatggagatcatcctggctaacaccgtgaaaccccgtctctactaaaaaatacaaaaaaaaaaaaaaaaaaaaaaattagccgggcgtggcagcgggcgcctgtagtcctactcaggaggctgaggcaggagaatggtgtgaaccccggaggcggagcttgcagtgagccgagatcgcgccactgcactccagcctgggcaacagagccagactccatctcaaaaaaaaaaaaaaaaaagaaaatccataggcaacatttacatgactacaattctgtgaaatgattcattgccttgtgtgtcaggattggattttagacttgcactgtgggtctggttttaggattcctgggccaatcaaaggatgagatatctagccccaaagtcaaatgggattttttgttttctcactcttcatcagttgtttaaatttgtgttaccttttagttttttcatatttggaccatgactttcttaaattttttccctagtatttctgattgccttttaatgtgttcatgcattatttgccattattatgatctcaaaagttttctaggctctcaatcttgtctaacctatcgagtcttctttgtctaagctgtatgccgagattcctttctcgttctgtgccgttctgaactggttattcactaagcccactacagagctgtcatcctggaacttctttccatggctggaagtgctgtttccttttcccgtgtcttcctatttttttggtttatccctcattttgctgcagtacatgcttgagtaacttcttaagaagtggtttgtaggaggtaagtttttcaagtccttttttatctgaacgtatttacttaaaaattgttctgactctggcttgttttttctgtttatctttgaatgacagtataatgtagctgttttcataagggccctttgtcattcaaaaaatactgtctgctaactcagttgtctgtaatgtgaagagagtgatacctgttgcattgtggtttgaaagatgagcatatttaaagcatctggcgcacaggagatgttcagtacaagttagttcttgctttctcttctctctctcccaacacacatagcctatttacccagccaaaatcagaagcagaaaccttggcaataggggtcaggtgatttttgactctggattacagctgtagctttgagggacaacctggatctggagttgaaagtcagttttaagtttaaaataaggagttagagtcaactttcctggttaagagaaacctaaataggaatgctcactgtaagtgcccttttgcttcagcattttgggcagaggatacccaactccatctgagaagtgtctagtttttattgtttggaatctagattgtcactacaaattgagctgtttttgtgtgtgggataggggaggaagaggaaatggagaagggggagatgagcaggaaaggtaattgacatttgttgattacctgctgtatgccagacaaggcagagagtgagagtcagcacatcccagagagatagcaacagaattatatgcatatggaactttttcataaccctagatgcttttacgtatattatttcttttaaccctcacagtgatcccatgaacaggtatatattattacctcattttactgttaagtaaactgaggctcagtgaggttaaataaatgtcctggggtcatataacaggtgagtggcagagatgggattagaactctgtgattccaaaacctgtgttcctgtccttatgccatgctgtctcatgccaattgtgtggcccataattaggtcttgtaattatgtatccttgatgatcgcataactgtggtggtggagtggtggatggatttttagagtttgcttctgaactgagtctgggttatgctatttggaactgtcattgatggtgagatagagatgatggaagaaaacccaaatataccagaaatgggtagtacacctccattgtctatttatattttattctcatcaagatttccaccaaggtgactcacaccactaatcttatcactttggggggccgaggtgggaggattgcttgaggccaagagtttgagacaagcctgggcaacatagcgagattctgtctctacagaatttttttttttttttttttttgagatagcgtttcactcttgtcgcctaggctggagtgcaatggcgccatctcagctcacggcagcctcctgctcccaggttcagctgattctcctgcctcagcctcccgactagctgggattataggcatctgccacctcgcctggctaatttttgtatttttaatagagacagagtttcaccatgttggccaggctggtctcaaactcctgacctcaggtgatctgcccaccatggcatcccaaagtgttgggattacaggcgtgagccactgcacccggcggtcatatggatttctttcagcttattctttacttgcatgctctctttcctggacttctagcttttatttaatgttccgtctaggcatagcagaaaataaataagaaaggaaaagatgatgttcacttgctcagtgctattaggagaagaagtgaaatgaagaaacatttataaagtgctgagcgcagtgcctggcacaaacaccacctttgcaagttcattcctgttattgttcgggatttagacggtgaaaggggcgatgatcttccagggccttgcctttgtgccatctaaaagatctttagccagttcagctaatttacaactagaaatcatttgaacttggctgggcgcggtggctcacgmctgtaatcccagcactttgggaggctgaggcaggcagatcacctgaggtcaggagttcgaaaccagcctgaccaacatggagaaaccctgtctctattaaaaatacaaaattagccgggcatggtggcgcttgcctgtaattccagctactcaggaggccgaggcaggagaatygcttgaatccgggaggcagaggttgcagtgagccgagatcatgccattgcactccagactgggcaacaagagcaaaactctgcctcaaaaaaataaaaaataaaaaaaattaaaaaaaagcattgaactcctgtttgtgttagcatcgtgagtatgtcctaaaagaagaaatgtgtggctggctttatcaccgcaggcagctgacagaatctggagagagaaggggaacacagacaaaccaggccaaagagctggtttcgacctgtggtcctagagcctggatcagctgccttccaccttggtttgccggaagcctttgtaaggtgtgtcctaagtcagtcatttataatatgactaaaggtctgaaatttgcagctgtacagaatgtctgtcagtttctcccattggctgtactccttctggcctcaggaacttggcacaagctgtttcctttgcctggaacattatttccctgctttttgcctgcttaactcctccattaccttcagatatcagcttagatgccacatcctgcaggaacttttccccaacttgcagctcccactctggattagatgctgctgctcctcctcccataggcccttctgtttcctcagtcattgctccactctcatattactgttttttttttgttttgtttagttttggttttcctttttttactgcactgtaacctccatcaggggaagaacgatgtttgtcttgcttggcattgcttaacttgagcacagtgcctggcacatagtaggtgttcgaaaggaatcctgtattatttatttttagccattttcattgtaaacttgcaccctggaattcgtaggagtcttccatgcttggaaatggcattccattgtatctgtgcccctttgactgcaagattaatgtcagagctccagatactaaatgcagtggagagggagatgaatgaaggctgggtgttcagagaagtctcataaaggtgcttagacataaatggaaccttcaaaaagtggcaaagatataggtaggtgtgcagacaagccttccaggaaaaacaggatgggaagagaggtatagaggcagaaatgctgagggtgtgtttttgagactaagaggagcttgtactgacttgtattaaaagataggtgttggttggtagatgattatgcatcccattgaggttctggagcctcagctagggtgggctcattgaccttttgctagtaaatgtcaactttctcactccttagttttgagatacacgagtcctagctttttgtgactgtagcgtaagaccccaccattgtcacctatgttgagatcttcctggttgtttagagaactaagcattttatgctgacttaaaagagtctggaaatnatngtctttttatctttccattcatagctccatcctatattcaatttagcaagtacagttccaaaattgtgggtggtctttacttcccaagtaagtgggataccaggctacccttgacttgggaccgcccctgctggatctatcatttctgcttgtaaatgaatagcttttgagtctgcttgttcccagaatactctcttgtggttttcggtactttctcagttcctctgaggctgatcaactagacacagacaaaactgagattctggaaccatagtcatcccaccagggcccacctaggcccagttccctgaggatgccctgcctgggcagccagtggcctccctctcaggaacgcattttctaaactcgaaagttcatgttttcaggtgacttctttaaattaaaaaaaaaagtttttaaagaggtaataaatacatttaaataccaagaacctaaaataagtacaaaggcatttactgggaagagtctttctttcactctcctccagtcctcttgtccccctccccagagcactagtttttttgttttttcagagaaactctttgtgagtacaagcatgcatgtatcaatgtagatatccacctagaccatgtcaacacaacacaatggtagtgtactgtacacactcttctgcaccttctttttttttcacttagtataatatatcttggagttcatttctcttctgtacataaacctctgttttttttaaggaccacatagtattccattgcttaggaatttaaatgtacatcatgtcccctactgatggacatttaattgtttctttctctttttaattaaaattttatatgctcaaacactgttggagggaggaaagtggaaaagaaattcttctgatcttctctgaatcccccatttagaaagtaccattgttaacactttattcagaaatattctttgcccaaagaacagctctccggttcccatctaatttgttagctagctagtcggttatctaatttatctgtcatccactgttctatctgtcaatcagtctgcttatccttcttatacaaggctgatgcatggtctaccaaattcaataaccagttagagtggatgcccaaccaataagaactgatggcatactgctgggaagtaactgattatatagcttagtgctactcaaagtatggtccatggactgatgccagtgtacagttgaattataactggcctatgaagagctagatagagaagttgagagtatttagaaactttatggcaaaatggcattgctatgacatccaagtaggtgaccaatgcaattatcttgtggaacagggtagtttgggtgtgtcactcttgtgtggtgagtcacatgtggtgtgagctatgtataagccatccaccataggactacatactggtcttgacagattggaaataaaaccccggtccttcaccacagatagtttgagaagcagtaatctgtttatctctcttaacgacctatctaatgtgtctgtcatccatctcttaatcaattcatctatttacttacctatcgttttatttttccatccatccttctagctataatttttgcatcaaccaattaatcatacctttcattaacttaataatcattctaagaggttcagtcttaaaatggaaatctatggcacaaaggttgtatataatctgttttctagtacataatatattttatgtctttgtggcttctacagtaactcattgttttaaaattttgctgtggcacatctcaattctgaacactgtacaaaaatccaatttctgttcttttttgtgactagtctgctggtaagcattgccagtgacagactcaggagtcaaaacatggtgactggagaaaaatacacatgctaggttgtttatttaaaaaaaaaatattcatttgtgatggcttttctgcagatattaaaatactgaatatctttctcctagtttgcacttgcaaagcayttcttagcctaggttttcaaaggggcacctgggcacctatcatagttgaggctgcaactgtgtgtgataacccatcagaaaggagaaaacccaagcaaatggtaaatgtgactataatgaacaaacgtaacttttactgacttcatttattttggggtttgtttttaaaaagctggcttttgttataaaaataatacatactcttaccaaaaagtccaaacagaactgaaagttataaagtgaaaagtaggggctgrgcagtggctcatacctgtaatcccagcattttaggaggccaaggcaggtggatcacttgaggtcaggagtttaagagcagcctggggccaggcgtggtggctcacacctgtaatcccagcactttgggaggccgaggcgggcagatcacgaggtcaggagatcaagaccatcctggctaacayggtgaaaccccatctctactaaaaatacaaaaaattagccaggcgtggtggcgggcacctgtagtcccagtgactcgggaggccgaggcaggagaatggcgcgaacctgggaggcagagcttgtagtgagctgagatcgcgccactgcactccagcctgggcgacagatcgagactccgtctcaaaaaaaaaaaaataaataaaataaaagagcagcctggccaacatggtgaaaccccgtatctactaaaaatacaaaaattagttgggcatggtggcgtgtacctgtaatcccagttacctgggaggctgagacacgagaattgcttgaacctgggaggtggaagttggagtgagctgagatcaggccactgcattccaggctgggccacagagcaagactctgtctcaaaaaaataagtaaaaaaagaagtgaacagtaaaagtactgcccacctccctgccaccaccacccygcaaccccaagacacacactaggtttactcctcagaagtaactactgttcccagttacttgtgttatcttccaaggatttattatgcatatatgtatatatgacttgactgataaaaacagcattagtttgtttttgcattgtgggaagtctctgttactggttgagcctcacataacctcaggacygggtagagtayagacatggattaaattctggagaactggatgcaatgcctgatgggatgtctcagggtgaaaagccttatcggggtaaccatgatctagagactgggatttgactttttggttcaagaaagtgacgtctctgctggcccaaaactggtcaggttttcgaggactgtctgatgtgagccatactggggagaaacagggatagaaattttcattacagttccagaagcacaggtagtgactggaatattctgccactctggaatgaaggtattcataagagtgatttaattgctgaaaagttgctttagtggtgctggaaaagagaagaagtgagatcattttaatcactgaagggatattagcaggtaaatttgacaggatttggtgatggattggataaaggcagcgagtaaagcaggaggaaaggaagatttgcagattgctggctgtataatgtcagggctggtggcgcctctaattgtagcaagccgtactgggagscttggaagaagtggagaaattatttaacatattgagtttgaagtgactttaagatgcccaagggaggaaaatggggtgtagtggaatgtgtataattattcaaatcctggtgtggttgagatttcttagagaggttacagatagaatgagaagaaacaagaagtactgatggaccctgtaaagagatggagagagaagagaaagagaggtaggaggaaatccagagagtggtgcgtggaagccagggaagaaagtctttcaagaagaaagaatggttagctctgtggtgtgtttctcagaggtcaaggaagataaggactgaaaaatgtccagtgaatgacttttccacgaggacactttctttcccaggataggtcataacagggcctgaggtactaattcttatgataattcagataatttagttttgagagacagaaaaataaggaaaataaagatctcaattagataaggtgtgaatacactcccacatagtcccacaagtttccatataacctatagtgtctctcactttattgccgtataccacacgtttgcttgtttaagcatcctattaaaatggggtccgaaatcagtgttttataactaactgagctaagttataagactcgggtaaaaacatgactctaattgatatgatcattacttgctgtgaggaaaattacagtctgcaatcctagcttggtaaaatcttcgtcacaatttgtagtgcacaggactgttattgctggcacacgtcataactaaattacagccataaaaatagcagattatgtttggagagtatcagtaaaaaatttatggttccaaatattatgtaactgtagtttcagataaatgtttatctttcctatctttgtttctccattcactggaactgattttgatacctggcaaaggggactcagattaatgcaagtaagttcgccaggccagtttgccctttcacaatataaggtaaataaaacatgtttaattatatcaaactggtttgagtttggctgcattttgtagttaaagcttgtattgtagttaaaaggctattctgtattttgctaatttgggagcatttggtggccttgttacagatttgggatttgtaaagacatgtgaatttagtaggcgggattaagaatcataaaagaagcagtaaacttgagtgctgctcataaaattacttaggttttctgcagatgcattctctagtgcaaccgtccccactttttgggtctttgttttaggtattatgtgaaatataaccctatgcatatgcaacttttggcaaataaggatttcttttttttttttttttgagacggagtctcactctgtcgcccaggctggagtgcagtggcccgatctcggctcactgcaagctccgcctcccgggttccggccattctcctgcctcagcctcccgaatagctggtactacaggcgcttgcaaccacgcctggctaattttttgtatttttagtagagacggggtttcaccatgttagccaggatggtctcgatctcctgacctcgtgatccacccgcctcggcctcccaaagtgctgggattacaggcgtgagccaccgtgcccggccggatttctcttacaaaattatatcatccaacttatatttgggtattcgtactttcgtgtgtgtgtgtgtgtgtgtgtgacagagttttgcttgtcgcctaggctggagtgcattgatgcgatctcagttcaccgcaacctctgcctcctgggttcaagcaattctcctgcctcagcctcccagttagctgggattacaggcatgggccaccacgcctggctaattttgtatttttagtagagacggggtttctccctgttgatcaggctggtcttgaactcccaacctcaggtgatctgcctgcctcggcctcccaaagtgctgggattacaggtgtgagccaccacgcccggccacattcgtacattttaacataaaatccaaccataaggctatattgtagaaaagcttgaaggaaagaaggcaggaatggagaaaggatcagctacctaaaagttgagctgtagccaagggtatgtttaaaacatctcttttttacctaggcttttaaaaaagtttagctatcttatctatcatctaagaaaagttaaccttgagttattgatcttgcatgtctgcatttgaagtatgaagatgacaggggctgtgctttgggccttggaaagctgtgttctcaagcaaaggtccaagagctgtaatccgtatggtacacagtggaaacattgttctttgtatttgtctgttgctaactttttaataaactattaagtagttggtgattattaacagtaggagcagaatgtagggtcattatggacaatttggagtgtcaacattaaagaaatgattttaaaggttagatcccaattgttgagactttgcctgaaactttggcaggtaagtagagtgagggatggaccagcacaaccttttgtaattattagccgtagtgaagtgagtcaagttttgccacagtgctttttgtttaacctaacaattggccggccctagttaattgttgaaaaccattaaaggactcaaatttcccagttgcacatgcattggaatgtccagcttacctcatgtgtgtgaataaagggccagtggtgtggctaattaaagtgcattgtcctttaagcaaagcgtcagtaacaaattaagttttaagagttctcgaaaggcccttctgaggactggtaaacatcttggtggctggtacatatcgtatggagtctaggtgtgaaagctgctgaaaacaagcattataaacttccaagtaagtgtggaggtgtaaactgatgccatagagttgcttcagctgaagcgaaagatcatatttactgacacttattacaaatgggtttttaaaacaatgtctgttttgtacagtgacagtaaagtctgccaagagtaaaacaaaaagttatattgtggaacaagataaaaggaccctgcataataaataatatcgaatgccttaaaatatgaggtttcatttccaaaatataaatatgagctcctaaatgaatgtttaaataatttggtttttctttgatttgccagtgacttgatacgtaaaataattttggctctgaatatgtccagatctaggccatcacaataaagaatacatctgtatagtaaatacaaaataaagcaaccacaaatgacatcatgttttagtgatagcttaggaattgttttttttattatgatagaccaaaagtagtttattggctataaataatatatttattatctgccagtttctaagagtagcatgatatctctgatccaaactgtattgattctggtcgggctcggtggctcatgcctgtaataccagcactttgggaggccgaggtgggtggattacttgaggccaggagtttgagaccagcctggccaacatggtgaaaccctgtctctactaaaaatacaaaaattagctgggtgtggtggcacatgcttgttatcccagctactcaggaggctgaggcaggagattcactagaaccagggaggcagaggttgcagtgagccaagattggggcactgcatttcagctttgggggcagagcgaaactctgtttcaaaaaaacaaaaacaaaaccaatctatattggttctaacctttatctatagacaaaagcattggtttatgaaaaccatcagagatgcaagccatagaaactttcaaaaagttctttaagatgcaactgtctggatctgataaatagtttcaattgttttgctcttgatctggatgggttttgagcagaggagattgggtgaaattaaaggtttcttaaaattgttgacactggtagagaggcatttatctgaatacagtggggaagaccagagatgttgcttaaagagattttgtaagaaaagtaggcacaattcttgtgaaaagtgggctacgtgaataagggcaatccaagaaatcatgttagtgcccctgtgtagttgtatgacttctgtactttttctttctttctttctttctttctttcttttttttttttttttttttgagacggagtctcgctgtgtagcccaggctggagtgcagtggcacaatctcggctcactgcaagctccacctcccaggttcacaacgttctcttgcctcagcctcccaagtagctgggactacaagtgcccaccaccacgcctgggtatttttttgtattttttagtagagatgggatttcaccgtgttagccaggatggtctcgatctcctgacctcgtgatccacccacctcggcctcccaaagtgctgggattacaggcgtgagccactgcacccagccaacttctgtactttttcaaaggtgaacttttggggaggtgatttcttgagaagtggggaagataatgggataagttgtaaaagtgcccagaaatatgagtttataagagaccttgagagctacatactaatgtagctgtccattagtatgaaagaagaccagacatgttgtccaagctgtctataggaaaatagaagaggtaactttaggttgtcgtggctcacacttataatcccagaactttgggaggctgaggcaggagaatggcttgaggccaggagtttgagaccggcctgagcaacagagcaagaccccatctctataaaaaagttttaaaaattaacagaatgtggtggtgcacactgctatagtcccagctacttgggaggctgaggcaagggggatcacttcagcctatgaattcagggttgcagtgaactatgattgcaccaccgtactctggcctgggcaacagaaagagaccctgtatatatatatttttttccaagataattttagtcttagtctactctgaataacaaagaagaatgatttattcatttagaggcattttaagagcagtctttgtagaccattgctagatctttttggaatgggctgccttgaaagcagagagaatgtaaccatgtgtctttaagtggcattgtttagtggttcttcacggcagcccaaagagaaagtatctggcatcagatttgctggatgtgcagagatgccagtatctctcgtttgagctagcctctgcggtgtttttgctctcaaacctggtggtagagtgacggctttgatttgcttcctgcctgaagcctgctttggatgaatttaaaaacctgtttgtttccccatcggccggctgagccttacccataattcctgaactttgattatgggggttattacaggacaagagcttctttgtaaaagagcatgtttaatactctggggtctagcgtgactagcggatataaattgtatggaagcaattaaatgcgaaggaaatgtcatgtgggctgaatttaaacataacttgcggcattgattttttttttttaacttacactaagaaggatggagagagaaaaaagaaagagaatggaaacaggccaagcgagtcagagaagcacacgcagagacaagagaaaaggagtcatttttaacatttggttaaaagtccaaagcccagagctagcattatgtgaattatactagtattatgccattgccctttaaatgaactctttaaaaacacaaatgtcagggaagtatactgtacttggggcttgtatctctttccagttgctcctctttatcttaaggcatatatgtacatacagcagtgattttttttggaatatgttaataaacaggcctgaaggaagctccgtaaacgattaaagtgcttctttccctagttttctctccttttatgctcacggccactgcatgcctcttttcttttcttttctttctttttttgacaaagtttcgctcttgttgcccaggctggagtgcaatggtgcaatcttggcttcctgcaacctctgcctcctgggttcaagtcattctcctgcctcagcctcccaagtagctgtgattacaggcatacagcaccacgcctggctaatttttttgtatttagtagagacggggtttcaccatattggtcaggctggtcttgaactcctgacctcaggtgatccaccacctcagcctcccaaagtgctgggattacaggcgtgagccaccgtgcctggttgccactgcatatgtcatacagagtagctcatctttgcacttttgattaggagtagtgtgtcatttctcacttgcctagaatgtcctacatccctatgcttggtctattaagacttagccagccccatctcctgtctaatgccttattacaccaaccaactagaagggatctcctcctactccagatccccatagtaatttgatctattggggtaatttgccacttaatcttttctactgtccatcagagtgtcgtgtaaggtttgtttgtaaatgaatgggtttatttcatttctccaacttgccaattcttagaatatggaactggtgttgtattgtccttcatgcctagcacatattggtactagggaatatttattgagattaatgttaatactgaatatgggccgggcacggtggctcatgctgataatcccagcactttgggaggccgaggtgggtggattacctgaggttaggagttcaagaccagcctggccaacatggtgaaaccccgtctctactaaaaatacaaaaaaaaaattagctgggcatggtggcacacccctgtaatcccagctactggggaggctgaggcaggagaattgcttcagcctgggaggtagaggttgcagtgagtcgagatcatgccactgcactccagcctggccaacagagcgagactctgtctcaaaaaaaaaaaaacatactcaatatgctgttaaaataatcaaaatgtgactgggtggtcacaggcagaaattgatgcttttagattagatgtaataatatagcaagtttgatgtgaaattgagtttagaaataatagacaacctttgattatttgctgtgatagagagtacttgtcctttatttttattctatatgctatgaactcatagtgacaagaaccaaatcttacctgccttgcataatacttctctcttttttttttttttttttttttttcacttgagacagtcttgctctgtcgcccaggctggagtgcagtggcatgatcccagctcactgcaacctctgccccctgggttcaagtgattctgcctcagcctcccgagtagctggggttacaggcacctgccaccacacccagctaattttttgtgcataatacttctctaatgcctggcccaaagcatggcatgcatagtagggattcatttaacttttgctgaaagaaatataaatgatttttttcttttaaatttctacattatttagattttctggtgactctttcctatgcaataagccaatacatatttatggagcacatactgtgtgccacatactggtactgtgcttagcataaaggatacatataatgtatattttactttagaatatattctattctttgtatttaattcttagcccgactataaattctaaaaaatcagtttttcaagcaaaaacaatgaagatccaagaaaggaaaatttcctggtattaattcaatatattcatctattcccagattatttccacattccacttgatggtggaaatttactaccccctccttgcctttcaaatgatcctaagatcgtaacctttcccaatggagctgaagaggtagagtaggctgtttgggtttcaaaggacttttcaggacacaaagtaaataggggaattggagatatcaacaaaactaattaagtggattgactgtgtcagtagtgagtacagagatgtcagaaaagctagttgtagcaagtatttaaacacagcctcaagttcattttcagtggtgttgccatcatccacaaacttcaaagaaagtttagccagattaatccaggaaaattcattctcctgggaacatcacattctaaattacttattcattgttaatatcttcatttaaaattttgacttgaacttttttattctttacttgtcctttaagatcacacagacccaagatttgataaggttatcatcttttcagatctcagaaaagtgggaaaatgaattcccttttgaccagaataaagggaagaagaatttaaaattataaaccaggtttactttactcatagatggtcatatattcaacattgccttttttttattttaaaaaactgcccaagtcataaataaatgcattcttgctttaagaaattcagctaaagcaatagactttcttgaccctctatccccaatcctgctcatctccccagaaggagagcccatttctcagttcagggactgtccttcagacttatgcatgtagaaaccaatgattcaagtttttcttcttctccttcttccttcttcctcctttctccttcctcctcctccctcttccgcttcctcttctcctcctactcttcctcttcgtcctccttcctcttcttcttctccttctctttctccttctccttctccttctcctccttcttcttcttmttctccttctatatattgtaccttaacttcgtttttacccaccactttaaagtattttgttctatgacagcagctagagatcttaatacgttactccatttcatggctatacacagtttatttacccgttttcctagtaatgggactgtaatgttacttaaacctcatctcaaagacctaatataaattaaattctagcttcatttgaatctttcatcactttgaagggagatttttagtaattatcaaaagatatgagatcaaacaagtccaattactaaaaatacaatgcatttgtatgataatttaaacttcttttaaatatggagacccagagcactgtatccccagcactcctgtgagctagccaggagaagaggaacattgtcacaaccacatgaagaagagggtagagcagggcccccttctgctgatttctgattatacagggctctttggtcaagatcacagaatgtgtttctccctcccatgcaagaaaggcagggattcctcctctcctctttagtcttccatccctgctcagagctttttggctagcattgtcaattcaaggtttggcctcagagtctttgatttaagttgtgaggggacagacatggtgaggatataccgtggccgggtctggagggtgagctactgagaatcagggcagggaagaggctcagtggttgctggtgctgaggtagtgtctggaaagcacatccgtgtgaaagggcgaatgccagctgagcatggccttgggtcactggctgccttgcaaacaggagctccacaggagaggtggacttgcacaacagcagcctgacagatccagggtctttcacttgcttctttgggatcctcaccaagcatgtcattcaaccatttattgtgcatggaccttggtagggaataggcattgctctgttttctgatttatttctccttgaaagcccattctcaagggcagggaacatgttttattcttcccagaaccttaggataaataaacgggaaaaaatgagtgaaaaaggaaactttggtgggagataatgaggcttttccttactgctcttatctttagaagctgggtcacagacatcttaatatgcatttacgtgtatttatttaacaaacgtgtacctagcacttactttgtgccaggcattgttctcacactgttcacatttaattatgccaagaactctgacagaaacactatttttatccccactttgctcagaaaactgatgtacagggcatttaaggaacttgaccaaagccgcacactagtaaggacttaaacttgggcagtctgggcccagagccaccctggctctccttttccctctcaccggtcttgacatggttgggtcttcattatttttccctttctggacctctcatctttccttcctctttctccattcctgttgcctccaccctactgtgtgatgtgatcatttatttgtagactgcagcacactagcctctgacttcagtcctttgcacaccacagccaggctaatcttccttcatgatggctctcatcacccttttcctgctacagaactcttcttggtgtcctgtcctgtcagggctgatctcctgcctggttcctaaacctctagaatctgacagtgtgaccctgctcatcsagcctcacttcccttgcaacccatttgctgccacccacagctcctggcagtgcttgtaccccttccctggagcaccctcactcacctcttccctgaccctccatcagttcattctgccatggatttccttctaggtctcacctcctgcctgactacacagctcttagtgtccgctccacccctgaacccagtctacaggctgttggatttcattgttcctggcttcaaaaagcctgattaggtttaaactctttgggggtctaccattatacctagcactgagctgggtcccaaaggacattgttgagtactgggattagtaggtaggacgcttgcctaatattggactttttacttggtttcctcacccttaaatgaagaacttaaaggagataatggccaagtttccttttaatttgcttaaccaattacacttgcatatatattttattttttagagacaagttctcacttgtcacccagagtgtaatgcattggcacaatcatagctcactataacctcaaactcgtgggctcaagagatcctcccacctcagcctcctaagtagctaggactacaggtgtgcgtcaccatgcctggctggcttattttatttttgtagcgatggggtcttcctatgttgcccaggctgtccttgaactcttggcctcaagccatggtcccacctcagcctcccaaagtgctgggattacagacgtgagccactgtgcctggccatacttattttttaacagcttcattgatatataatttacacagcacataattcactcattttaagtgtgtaattcaatagtttttaatagattcaggtatgtacaaccatcatcacagtcaggtttagaacattttcatcaccaaaaagagaagccccaactaactagatagctattagccatgcccctctcctccacattctcatcttcaccagtcttaagaaattactaatccactttatgtctctgtagctttgtttattctggaaattgtatgtaaattgaatcatatgatatgtagtcttttatgagtggcttattgcacttggcataatgttttcaaggctcctctatgttgtagcatacatcagaacttcatcctttttatggcttaatagtattgcattgtatggatataccacattttgtttatccattcatttgttggtggacttttgggttgtctccacctttttgaaaattacatccatttttgagtggaaaatgatcttcctttagtggcttctacagttgccaacagcagtttccctctactgctttaaaggtagggatctgggcttaatggctttgtttgcgttgtgtggatggacaggttggatgcttggtcatcaatgtcagagagcagtcatagagagtactcatgagctttgtaatcagacgtactggtttgaatcatggatctgccacataatgagcttasataacttcaggaagcacgtttcctcgttggtaaagtgggaactaccttgcctgtttccttagagtcagagctatgctagaaactacgtggccttggggcaactcaaccaatgcagagggacctcaaggctataaaaataaataagtaaataaattttaaaaagtaaaaattattttttaaaaagtactctcacgcccgtaatcccagtactttgcgaggctgaatccaggcagatcgcttgaacccaggagtttgagaccaacctgggcaacatagtgagactctgtctctacaaaacatgcaaaaaattagctgtggatagtggtgggcgcctgtagtcccagctactcaggggagctaaggtgggaggatcacttgagcctgggaagttgaggctgcagtgagccgctgtactccagcttgggtgacagagtgagatcctgtctctaaatgaataaataaataaagtgcttaaagttctcaattttattaaggtatcatgcctcacagctcttccctaccaagcatggagcccaggatcaccaccctagttgcagtacccagagtggacctacttaattttgttgggataattcatgtctcccttcgtgtgtgttaatggcctctcttgatcttggatctggatttgtgctccagtcactaccccatcaggtcatttgacaagaatggctatagggagtgaaatgtttttccctctctgagaagatacagcgggagtgtaatttcattctttgtgggataggcaaggaggatgcattgctgttttttggtaagctttacctgaaagtagttatgccagagggtaggtggtgattctgagcttgcttatggttattgaatatccattggcacttatatttggggtttgtacgtgaagactgaaaatgccttttttagtaactggctgaaggagagatgaaatgttaatttgatccaaactttgcttggagagtggtgtttcagaactgattttgctaatgtcattaagaatcaaggaacccgacaattttggattttaggcaaggcctctctctacacccagagtaacaacttaaaaaaattattttaaagtaaggaggttttagaaacataaactcttataatagtggatcttttgagagaatggaaagtaagtcattttcctcatctaaacttagcttctgcccccatgatattggtaggaggtcgagaaatttgactgtgagaattatgtgaatctttattcctcttcctctattctgaccccaggtgagtggggacagctcttgcctggcatttctcccactggcttgacccattaatggcaactgtgaaaaggtcaacatttccaggctgacatactgaccacattttgtgtgggagatctcaacaaaagaatatttgtttctgggaggctgacatccccttttgtccattaagcctgtcctttccatcattagattgtgaaccttgtcagaattaagtagagcttaaaaacaaggaaggaatgagtaaaggaaatttagtttgctacatctaaatgcaaattgtgcaaaaacagatgggtgaggtaagaatggacgtcattcctggcgtgactgcaggtactcttggtctacaccatgatcctggaaaaggaggatttaatcatctgagttattaaccgttctcattaccttaggcattgtgactctgcttcctattgatcctagagctaaggtgccccgatttatatgcaaactcttgtttacctgcccaataagtgcaaaagggcttaagcaggtgactggggcctcacatgaagtgacaagactatttctgcctagaaggtacgggagctgagcgggactgagctggtctgcaggaaaggcaagaagaaattctgattatctgtcccaaatagagccatatcctgtctatgaggtggccagctaggagagtggaaacagtttagatctttgtctttggctactggtccgagagaagttgctgttcttcttttatccttggtagaaaaccttttcttcatccctacctattcattgctagagctggaggccaaagcaaaatgacagactgtaattttatatgagttattttgggactaacactcttataattatggttcacttaaatattataatattacttattgcaaaagcaatttatagggaattggaatttttttacagaagaaaaaaacgcaccgaagattttattattctaatatccttgaagttagcccggtgtggtggctcacacctgtaatcccagcactttgggaagctggggcacgaggattgcttgagcccaggagtttgagaccactctgggcaacatagtgagaactcatctgtacaaaaaatgaaaaagttagctaggcacagggtgtgtgtctgtagtcccagctaccggggaggctgaggtgggaggatcgcttgagtcatggaagtcgaggttgcagtgagccatgattgctccactgcactccagcctgggtgacagagcatgaccctgtctcagtaataatacccttcaagtttttccctatatgtttgcatatatggttttcatattgttatacactttcatgatcagatactccatagtagatgggttggctgatatgaaaggattttttgttttgttttattcctttaatatgtgtcatcaacagtttaaaacttacagggatttttaatactcatttagtgccagttgtctttgaaacaatatttttatcaaagattgttgtgacagagaagaatatcttcatggttttgttttggtcttcacttgggtaacaagttactggtatttggagaacaggagagactattttcctcagatttcgaaatggcaaagcataggagtgaggttggagaaaccacagggtctagcgggaaagtcttttacaggccacactcaagtcctggttggggttagcttcgcttagcagattccccagcgtaggaaatactgacctagttcttagataatctctgaggagtttctctgtaagggtatataagtatcctaaatgaataggtggaaaatacaatataagtacttttgtgagcctgagggactcttctgtaagatcaaagacaaatattttagtttgaytgagaaaggagtgaaactttttaaataaacaacagtatttattttaatagggagtctgaggtctttccagtaggagttgggaaataactttttttcctcttaaactcatgctgcacaattaaagaaaaatgttttttctctgaacctttccttcaaatacttggcagagattactgccagaagaatgagatgggcacagtggctgatgcctggtaatcccatcactttgggaggacacgatggtaagattgcttgagcccaggagttcgagactagcctgggcagcatagggagacccatctctacaatttttttttttaaagccaggcagggtggtatgtgtctgtggtcccagctactcaggaggctgaggtgggaagatcacatgagcctgggaggtcgaggctgtagtgagctgttatcatgccactgtactctatctagcctgggcaacagaggctagagcaactctgtctcaaaaataaaataaaataaaataaaataaaaaaaataaaaagaatcatttgtgagacttgagagacttgtaccattggattagaatctttcttggtactaaagtctgaaagagctggacttgagctaggttaaccatccattttccctaaccttcaaaagctcacctagtctatcctgcggacaaggatatatgtgctccacgataccgaaaaagatactgctggggcaagaattagcctgtcatacaaagcaataaacaataccaagagccaaaatttgacttcagtggcagctgtttcctagagcagtatttgtttgagtttccttgttgcaaagcatgcagctcacaaagtgccccaaactggcttaataagttttgtttgtttgtttatttgttttgagacggagtctcgctctgttgcccaggctggagtgcagtggcgtgatctcggccaccgcaagctctgcctcccgggtccacaccattctcctgcctcagcctcccgagtagctgggactacaggcgcccgccaccacgcccagctaattttttgtatttttaatagggacggggtttcaccgtgttagccaagatggtctcgattgcctgacctagtggtatgcccacctcgacctcccaaagtgttgggattacaggcgtgagccacctcgcctggctttttttttttttttcgagacggagtttcgctcttgttgcccaggctacagcgcaatggcgccatctcggctcaccgcaacccccacctcccaggttcaagcgatttttctgcctcagcctcccgagtagctgggattacagacatgtgctaccatggctggctaattttgcttttttagtagagacggggtttctccatgttgatcaggctagtcgcgagctcccgacctctggtgatctgccccttctcggcctcccaaagtgctgggattacaggcgtgagccaccgcgcccggccaataagtttttaatgtcttcagaattttttagaaagcgtcaactttctttaaaaataataggaccctctcaggctacaaatataaggagaagggaaggagacccaccctggagagttttggaggtgaaccccrctgtgatttcatggacaacatggatatctctgtttggtttaatacaaactttgaccagcttgatttgggggcctcctgtagccatagcacacactcttcagttatcaccacctattcctttcttcctggcttctctggcatttccagggggtgcaggaaagggctggtttaaggcagctggcataccttcctttctctcaggcttcctcactcctaggactgtataccatagtttcttcccatcaaaatttcgtgttcctctgctcattgcatttcattgttcagcataaattcagggttgattaccccacatgacaccctacatggctgaaaatggggtggatgtttcccaaaggaaattaggattgtggtcaggagagaaggggaatagatcatgggtttaccttaacaatatgtttaccctaagaagggttgttggataaaatacaggtattcagttaaatttgaatttcaaataaacaataggtaaatttttagttttaagtatatcccagatattgcatgggacgtatttgtactaaacaaattatttattatttatctggaattcatatttagctgggcatcttgcatttttatttgctaaatctgatgaccctaggtccctaagaaacttctcatgtctcattttatgttttttgttagcttacctggcctaagatttctttgctttggagaggtgctggggagtggcacggtgggcaggatattacacttgtgtgaattaagagagggcagggcataaataaagtattggccaagcagctgcttggtggcctcaggacggagtaggtgttcaacaacctgtkcgctgtgtgccaaggttgggcaacaccttgtttttgatactattcttagatgcacctttatgctgtgtgtatttcatcaccccatgtgcctacacattcaatatgggtggttttccaattgatgctcttttgtagtcctcgtgggaagatacctctggtatcttcccttggagtatggaaaaaaaggagtagaattttacctctaaccaaaaacgctcagcctgctttgggattttcaatgctaattactttagtaaagtaaaaattatttttctatactgaacatcacatcagttctggccattttttttttttttacatactatagaatatgtatatacttgaatgcaaacattctctttaaattctagctcaaacaagatattattagcttggttttatatattgactgatttcaactggatggattttaagggaggaaaacccataggaaatatgatcctgaggcaccgaggatggttataggacgtggtctgctgctgcatgttgcattactgtatgctgggtttttggtactctttctcaaggctctgttattagttggtaggctccagtaatgaatatagaggactgacagagtgggattaacttatttgcaattgtttcctactgaaatcaaatgcacggttttcccaatttaagacttggtcccttgtaccttgatttgattcagaaagccatctgtgatgtttttgtttcctggcgcctgcaggaaaactcatttgtcatgagttacaattaccttgcagtcattgctatgtggttgtagcacactcattgctaagaatggtttatgagtgtcaccttaatccatgagctcaactgggtgtcagacgtctaggaagggagggacttggtaggtacttaaatggtaaactcagggtgctgcatggaggtgattaaggaggtggcatttggtttgagtcagggcttttagtgctatgcatagaacaacttgtttccttttgagaatataattgtttgcatgtgatgctaatttccgctttttttttttttatttggaatctcgctgtgtcgcccaggctggagtacagtggtgcagtctcagttcactgcaacctctgcctcgtgggttcaagtgattctcctgcctcagccttccaagtagctgggattacaggcatgtgccaccatgcccagctagtttttgtatttttagtagagatggggtttcaccatgttagccaggctgttcttgaactcctgaccttggatgattcacccaccttggccttccaaagtgctgggattacaggcatgagccaccataccatgctcagcccctaatttttgctttattaaaacaaaaacaaaatttgagtcactataattctgtcacagaaggcagggatgaaaaagggtagagttggccgggcgcagtggctcaagcctgtaatcccagcattttgggaggcttaggcgggtggatcacgaggtcaggagatcgagaccatcctggctaacatgatgaaacccaagctctactaaaaatacaaaaaattagccgggcgtggtgggcgcctatagtcccagctacttgggaggctgaggcaggagaatggcatgaacccgggaggcagagcttgcagtgagctgagatcgcaccactgcactccagcctgggcaacagagcgagactccgtcacaaaaaaaaccaaaaaaaccaaaaaaaaaaaaaaaaaaaagggtagagttgtctatttcactaacaaccaacttttcctgaaaaaggactttctgtaaagattaagaatggtacgggcatggtggctcacacatataatcccagcgctttgggaggctgaggtgtgtggatcacttgaggtcaggagtttgagaccagcctggccaacatggtgaaaccccacctctactaaaaataaaaaaataaataaataaaataaaataaataaaatgaattagctgggcatggtggcacatgcctgtaatgccagctacttgggaggctgaggcaggagaattgcttgaacctgggaggtggagattgtggtgagccgaggtcacgccactgcactccagcctgggtgacagagtcaaactccatctaaaaaaaaaggttaaaaatgattatgatttctttttctaagtttattaagaaacagtacgtatcagttcattccccttagcagaagcaatgttattttagaaggatgcagcaaacttgatcttatatagtcccaagtgtggctcccatctccaaggtggtagccagcctggacagcttgaagaacagagactgggctgtttggccatgaatgcagcacagaatatagattcctgtctctggcttgtgtgatggagggtggactagtcaggactgttccagctgaagatgacagaggtctagctcacactagctggtgcatgaaccaagtgaggccaaggttggctccagatccagggacttcattagtatcatttagacttctcatctctctgcctcttggccatattgccttctccattggcaggaatatggcctcaggaaggttgggcatccacatcccaaacgagcagcctctaaagggacaagagggcttccctctacccgccctcacccgcccacttcaatgtatgccagtatctgttcatttgacctcctgtgagctcagcagagaagggtactggattgttcatcattcaggaatcacagagttagaatggagaaagatttagttcctcaatggaagtggtcatggtagtggtggggagggatgtggccggacgaagggaagtgattctgggcagacgataaccacatactttctccacagagagtgatgcaagccacatgggagatagggaccctagccttaaccctgtagcctggctggagagctaagcatatatgcaagagagcacaacattgccaaaactacatgaaggtaacgaggagatgcagaattaagtgcagccatgaagcatggcccttcagaaaggactgtgaggttctggcattgtatataaattcccatttgccataaatagtagccctctagtttgcttatcaggattgtatcttctctacacggtcacatagtggatgattagccctgaaagcaattacataatttccacttatacagatttacatttacccatagaaagtatttctctcctattcaaataaggatgtcagaatgcaagttcgtagaagtgatgtcattcaatggacaaaaaatggattaattcatcagaaagaaagacaacatatattgcaaacttaaatgatgtgggatgcctttcacagctaatggcatcatagcatggcctttgggactgcccagaattccattttatagctgtaccctactttgttcatctagcccctcttactgagcatttaggttctttcccattttcacactttaaatggccatatgataaacattcttttttttgagatgtagttttgctcttgttgcccaggctggagtgcagtggcacaatctcggctcactgcaacctccacttcccaggttcaagtgattctcctgcctcagcctcctgagtagctgggattacaggcgtgcaccacaacactcaaataattttgtatttttttggtagagacagggtttcaccatgttggtcaggctggtctcaaactcttgacctcaagtgatccacccacctcggcctcccaaagtgctgggattacaggcataagccaccgtgcccagctgataaacattctcaaagatttttaagwtgcatcctgagtgcttcattagaattngttcttagcaatggaattactgaatccaaggctattattgccataaatttcgatggggatagtaaggaaagaataatgataaactcagacccactttagtgggttactgaatcgagcacattattattattattattttgagacaaggtctcactctgtcacccagactggagcgcagtggtgtgatgtgagcttactgcagcctctgcctctcgggctcaagtgatccttctccctcagcctcccgagtagctgggactacaggcatgcaccactgtgcctggctgattttctgtatttttggtggagatagttttggtttggttttggttttggtttggtttggttttggttttcgccatgttgtccaggctggtcttgaactcctgagctcaagagatctgcccagctcagcctctcaaaatgttgggattacaggcgtgagccactgcgcctggacgcacgctcacttgcttgctttctttttctttctttctttctttctttctttctttctttctttctttctttctttcttccttccttccttccttccttccttccttccttccttccttccttccttcctttctttctttctgggaaaatatggtttggttgtaagtacaaaaagataattatcattgttatatgttatttgtattatattattggtataaatttaatgtctctaataaattactttgacaattggtcattcatattttcatggtttttgaaaacaaagtgtatctttcaaataacaacaacttgatagaaaagatcattgcacctgggagaataataacaacatcccaaatttgctttaaggttatacctgaaatgtcattgtcagagaaacaactcataagtctgggttaaaacaagcctcttgctgattttgaggtgatcaaatttatcataataaaaaaatagttattaccaatcatgtcataagactggggggcatgcagtgagcagaagcagataggttgtgcaggaggagggtgtgggatatggattcataatctctaccaaaatattttttagataaaggtgagtgagtgagagttgaaataaagataaggaaagttcaatgattgattaaggcattttgactctttgggtcccagagcagacatccttatggtggcaaagaaaaaccacgtaactaattcggaaattgtgccaacaacatgttgaaacagtagtagagaaattcaaagtttaatgttaggtcactggtccatcgtccatgtacaactttgagaacacctgtaatgcattacatcagacattaaaacatatgtagttatttaaaaactgatctgtaatataactgggcatagaccatattagtatgatttctgtcttctgagtgaatgttttatttggacttcttcctctctttagatttttgctcttcctgtattttttctttctatcatctttagcaaaagattgctagtgaaaggagttgcacctggttaccttgattaacacatcaagagctctggaaaatctggttgctggtctccaaatagtcctgaccatgggaatatacaacaagctactgtggtgcagcggtctcttgctctcggggccttatttattacagcacttgctgctagcattagtcacttctgtttgggcactgtggttttctgcttccttccaataacattacttgagttaaaaaaaaaattacagaaatgtagtttcacaaagacttctgtgattagaattactgtctggaatttttaaaagcagacagcaaagaagcaaatttaagaaacttgaaaagtttaaaaacaaggactgtttctttataagggaggcctaaaaactgttgggttcatattttttgcccttttaaatgccatatttagtatacttcaaaacagtttaagcaaagcaaaagctgaggtagaaaaagcatgttattctgtgacattttcaggaccctaaagtaagaacggcagcacatttgttttcaggaacctgtggttcattcagcaaaattaattccaatacagaattgttcctatcaagggtgacatggattcttttatgatgctccagatttctggtagtttgtttgcattctctccacttgtgtcattctgagaaaagagaatagtcataggacactacagttgaaaagcttgagattcttgtgtaaaggctgatgtgtgtggtctcctagctctgcatcctagaggtgtggtttattcccccatgtggggcagatgcaattgtaactttttgcaatggaaatgctgttagtttccagacagatgggatgtgagctggaacttgaggacctagatagataaataggacctagataaaaatgatctaggcatttgtgttggctgctataaaaacatcctctgtcatgtggagtagataagatactctatgttgttttaaagaagtcttttacaaagaagatgagtgtgtgtgtgtggggggggrgcggtggaggaggggtgcagaagaacatatgagatccagctccccagaggatcttccttaaggcacttggaactaagtttgaaggcactgcccacaaattctctccttcatcaagacttgtcaatccagctaagctctgtggtcacacctactgtcatcttagaagatgaattctgtggttgcctcaatttaatggctgaccaaagaggttccaaaaagatccagttagatcctcaggtctcatatcatggaggttggggtgtccatgacctctgtttatgctctgtgtgccacgcttccctttatgggttctttatctaaaaaataaagaaactgagttgtctgaaaccctctttggaggaggcaatctggtgtagtggttaagaatatggattctgtagtcagaatgtttgggttttgcaacatctctaaactgagatgatacgaaaacacctacccaacaaagctgtttctaggatttaagaaagcgtttttctataagagtgctataagatggagcccaggaccaaaatacatcaaagcgtgtagatgttaaatggagctaagtcccaaattgggtgactaaaggaaggtgtaatgatggaatcctgggtgcttctaatggaccaccaatttggaaaacaaaatttagaaatcgatctgtgagatcctgagagaacgagaccattgatataatatgatctccagtttcagcctgtgcgaggattaaccagcaacccaagaaggcaatattactggggccaccacatttttgggcaagaaaggtaaactgtgtcccttggcagtcagttcaagcctaaacctaaagtagtaggcttgaacaaaattacctttgttgtgctctaataaaaataaacagagtgtggagattgaagaaatcatcaaccagtgctatatacctgtttgtttgtttgtttttggtgacaggatcttactctgtcacccaggctggaatacagtggtgtgatcatagcttactgtaacctggaactcctaggctcaagtgatactcccgcctcagcctcctgagtagctgggactgcaggagcatgccactatgcctggctaatttttaaattcttttggtagagataggatttcactatgttgcccaggctggtcttgaactcctggcctcaagcaatcctctcaccttggcgtctcaaagtgttgtgattacaggtgtgagtcactaatctggcctggttccttttttaataatactactgacaaacactgcctcgtagaaactcctgtcagngtgaagagttggaaggggaggggaacagtgctatttttcttcttcaagaagtttcagggggctcctcataggattgccttcaggagtgtccatactccctgcctctctggctgtttcttatcagctaaatggtacaacctccaagaggtgtgactgatggtgaatttcatctctttctgaaaggtgccatgaaaacatgcaaggctattcctctctgccattgtttctgtctgtctctcagcaggataaggtcatgacagaatggcacgtttatcttggatttccttgtttggcaagcagcctggatatctctgggttgaacgtctctgggtatctcacagacgtcaatgggttgaaggagatgttggctcttgcactgattctttcagaagcccaggaggtggtggggaggggggaggagaagaggggacaggwttgtacttgtcgtgtcactgccctctcagttggagcttcctttacctttccaggctcctacagcgtggagaggcagcctagtataatgcaaggcacagagactttatgtctaaatagagctgtgttcaagtctcgactctgcctattttaaggtttttctcctatatactcctcaaaacccctgtacttattcttcgatgatattttttcacatctgacattacatctttctctctctctttttctgcatttgtctgtaagctttagatatgtggggaccacatctttttcatagctattagattgttaaacagtttctggagcttggcttactgagcttcaaacgctggctgtgtgacattgggtaagctctctagcctcttgcctgccttgggtggtgttgtcaggattagagataaatacatgttgtatcgctggcaccaagaccagcacagatggatgctcgagagatgttgttctccttacctcaagcttggtaccagcgcctcagtgtctgctgaccccaccagcatgcccggatgtatctgttggctgcaagacattgtagmcccaggcttgtagccagcctgggcaggcagcttgttggctcaaggagtccttcgtactgttcttcagtccttcgaatgtcttattctcagacgctcttctgagaggacatgcctgcaaagagcacaggctttatctttggaatctcttgtttcagtccatccctaagaaattgacagtagcctttaaaaagtaacccttaaaagttatttcaaaagtaattatagttctttgttaattaagggggaaaaatctcccatagtctatcatttgtatatctactgtttgctttggtatacatccttccagatttttctatgtgcatgtactataataacgttgttttcttttagccaatggtggaatattctgcattttatttttgtatccataggagggatttttcagagtccatgaataatattggactctgaatattggtatgatttatggaactttattttattttactttattttgagacagagttttgctctgtttcccaggctggggtgcagtgatgcaatccctgctcactgttaacctccacctcccgggttcaagtgattctcctgcctcagcctcccaagtagctgggactacaggcatgtaccaccatgcccagctaattttcatatttttagtgaagacaggatttcaccatgttggccagactggtctcgaacttgtgacctcaggtaatccccctgccttggcatcccaaagtgctgggattataggcatgagccactgcgcctggcctgatttatggaattttaaaaggttccaaatcctttgttagaatgaggccagttagaaataatgaaaagtggctaatccgtggaaagccataagcctctagtggttttgaacttgaagaagcacagcaaagcacacacactgtgtgtgcattgacttatccacatgctactacataagcctggagagagatggggacagaaggaaagagaagacggattgcacactgctccaatccaattgccctggagtgagagtgagatgagatgaaagttcgtttttccttctgctcatcatggtccccaggagaccctcaaattgtgaccaccttgtcatggcacaaggtggctcctaaatggaaaccagctatcttctcagctatctgttccaaagcgggaggtaaaactgggtgtgctggttttaattaagagatagcatgtctaaaaatggcacataaacttaatatgcagttaggagattttcagggacattttttttctacattagtttcgcattttcttggtgactttagaaactaacccccttattagactctctggcctatgcacataaagcaacatttactccctccctccctccttcttactttttcttccactttaagcttctagtttgtgctgggactgcgggatgtagtaatgaataagtacatggcctttgtcctaaataacttaggttcagttttagaaagaaatctgaaaatgacttctcataatacctggcagaatgaaagaaatttattaaaagagaggacagcaggccaggtgcaatggctcatgcctgtaatcccagcactttgggaggctgaggcgggcagatcacctgaggttgggagttggagaccagcctgaccaacatggagaaaccttgtctctactaaaaatacaaaattagccaggtgtggtggcacgtccctgtaatcccagctactcaggaggctgaggcaggagaattgcttgaacctgggaggcagaggttgcggtgagccgagatcatgccattgcactccagcctgggcaacaagagtgaaactccacctcggaaaaaaaaaaaaagagagagagagagaggacagccattttattaggaaagtacagaggaagaaatacgtagttctagccaggggatttcattacatgggattacagagaagggtgttccctgaactgaatttttaaagatagggtcaaattttcataggcagaaagaaagggtgggaagcggacattctcaattaaggggaaaaatgagatcttatggaagctttaaagcctgagacatttgagggaacagaatttgagaattgagtctgcgatgagacaggaaaagcccacaggcagtaaaaaatgccggtggctgagtgcagtgtagcttccactgaactctgtggatgtttatgcttatttgaaccttgttggaatattcctggtttgttttatgaagggatgtctctcactgaggatattgactcagggacgtttcctctttcagtcaggatggcctccatcagaccaatattgttctcaggccatttttttgttttgttatcttggataaacagagagaggctgattcatttttctagaaaaacaggatgcactaaaatactgcaagtgacaatgaaacagacatgctcacgtacaataatatttataaagggaccaaacaatatatgtagcagacacctctgtggtgtggccgctacccctcctccatctcacttgccttgagtccttggccaagtgggttgtttctttcgatctgtttcctcagatatcaaatgagaccaataataccaactgaacaggcatgtctcaaggaattgatgagtatcaagtgctagaaatagtgctgggcacgtagtaagtagccattccaatagagcttaattatttgtgcactgggtacgaaatactgattcgtaattggagcaatatatattcacaatgatttttttaaaactttgtattatggaaatattcaaatatccataagagaacagtatgataatttcccacgtacctaccatccctccacttcagcaatcgtccacattctgccattcttattcattgatccccttcctcttttagaaatgttttaaatttgtaatggttaactgctacctaaattattttaaagcaaattctggagagcatataattttgtgtatagagagtttttaagagtctgataaatcagtgaccaaagaagaaatccttataaaaaaatggttgaaaccagtgttttgaatgcaattttcagagctgaattataggtatttctgcaaccaaattaggacatgtctgcaaatctttaagagtggcattttgaaagttcagtattgtttatttcatttaaggagcatgccacatgctggtctgcacatagattagcacttaggtgcatatgcaaaacacttttttctaatggaagatttaaaacatacctcaatactagtagactagtataatgtacccccctgtaaccatcacctaagctatctttttttttttgagacagagttttgctcttgtctcccaggctggagtacaatggcgccatctcagctcactgtaaactccacctccctggttcaagtgattctcctgcctcagcctcccgagtagctgggactacaggtgcatgccaccatacccggctaatttttgtattattagtagagacagggtttcaccatgttggccaggctggtctcgaactcctgacctcaagtgatccactcacctcggcttcccaaagtactgggattacaggcgtgagccaccatgctcaccctaagctatcgttctgatgtctccttttgaaagatgttcatattgtttgtaagagacttcttaggtcaaaagagccttaatgattttggaggaagatgtagaatcaaacatttatattacactacatgaaaagaaattcttattcatcagtgctattgcctttgaaaagtacagtcagtactgcttgatgtgggtatgttctgagaagggcatcattagatgttttcatcattttgtgaacatcatagaaagtatagtctactacacatataggctatatgcatagcctattgctcctaagctacaaaaactgtacagtatgttactgtactgaatactgtaggtattcaatggtacagtggtacaaatacaatggtaagtatttgtgtatctaaacatagagaaaggtaatgtgttgtgccacgacatttccacagctacgatgttgccaggcagtaggagttatttagctccatcatgatcttatgggcccactgttgaatgtaccatctgttgttgacccaaaagtcatgctgcacatgactgtgtgtcagtaatagctctcagaggaactgattttcccagatgaaatataagtaaaatctgatgtttgaaagcagttcaagcaagacccctcaaaagacatttaagcaagaacacatttggaagccagtactgaagtgttagtaatggatagggaagttatgtattttctcttctttcttttttccattcatctttctctctctctcatttttgtttatctgcattttacaattttttttttcaccgtgagtgtggattttctttcaccatgaacatggattatttgattgttgaaaaataacaaaagcccagctgggygtagtggctcacaccactaataccagcactttgaaaggtggaggcaggcaggtcgcttgagtccaagatttcgagaccagcctgggcaacagtgagacctcatttctacaaaaaattaaaaaattagctgggtatggtggtatgtgcctgtagtttcaactatttgggaggctgaggtgggaggatcacttgaactcagggagggtcgaggctgcagtgagccaagattgtgccagtgcactccaccctgggcaacagagtgagaccctgccaaaaataaaaataaaaaagtaacaaaagaatataagttagtaaatcaaagaagagatgccgggagtggagattggctgtattgagatgagtatgtcaggggcagatagataatgtttctgaaccagcaagcttttacccttcatcttgctgcttgtctttaaccctttccttggtccctgggtcttgcctctgcattctcattactgatggtagggagtggtactcatcttcatgacataatctcattaggccaagagagaggataattggccatagttcctaggccagtcccctaagctgtgttaggctttcatatatgattctgtctggtcctgtgcctttacatttcctggtcttgccttctgagactgcccaggttttaagaggtgggtgttgggaaaggctaggagatggtggatgctggaagacaaaacactagcagagtgtagtctctccccttatgatcctgaaagtataaaaagccatctctgctctgctgccagcctacccacctgcactttggaagaagagctgttggatatttcagaatggttttcagactggcattggaaccgtgttctaaagttaacgatgatggaaataatttagttgtagaggactctagacaggcttgtgtaaagcaagcaggtaaaggaataaaacattaaaaattgtgtaggaagagatgttttgaggtatcagtgtaggtggattgtgagtggagtgacatggggagggagttaagaggagacgatgttcatggttaaagaaaccatttatacagacgtgacgagtgcaggaattctgatctctcatatgacaaatgctgagaataactcctattttccatgctaattgctaatttactcatcacattgaatatcctgctggtggaaaaattcagtgttgcagcctcatatcctcctgcataggaagtactcagtgacccaagatgttagagtctcttttatggcacttccctgaaaagaaaatattattacttaattggcaggcaacaggggcttttaagggactcatccgaacaccacctgtttacttacaagtacaaaggacaggaaaattaattacaaatgatacctttctcttaagggttctaggtttccagtgcaaaataatgatgatccaactgccaaagtatatactggtaggtggagtttttttttttttcttttcccctcctataatggattaagttaatctgtgagaacgtttacccaatgcccattgtaacaaaattatgtgaattgaccagatttcattaagtataaaatgaatgtacctcgaacttggtctttgatgtggattttgagctactatcaggccacagttcaggtatagcaaggatatgccccaaaaaagcattcctgtttgattatttggtgtttgattatcagaatttctggtctagaatacagtccaggtggtaacctttccaatatgagtgtcttcctaaggtgggtcatgagatgggttggagaatccagggttctaagccagtctcttgcccctgacgccatatgggacatgaggtgagttgcccagtttttatcatttgtcaagtaggaatagtaatgtctgatgtgattgaggattaaatgtaagtctaggcaataatgtaaatagaagtgtttttgaaattaaactgacatgcaaacttttgattgatcacagtaatcaatcagtgaacaaacatatttgtgagctatggaattagccataaatgtgaaggaagctagagaaaaggggaatgacatttccagtaagctagcaaacactctggagctatgttattaactgttaaaccatgtagtctgggtaggtatcattagccactttgccacaactccccacctcatatcctgtaccccattcaaattcagtcctttcattgctcagactcatctcgccttggccattctgcccctcacaatatgattttcccatttctgccttttgaaacgttgagtaatcaaaacttagatcaaatgtcagttctttcatatagtcttctctgattactccagttggattgatccctctctggcctatgtcagggataggcaaactttctgaaagagtccagattgttttttggctttgccagacacatggtctctgttgcttccactcaactgtgccattgtaatgtgaaagcatctgtagacaatacatagataagtgagtgtggccatattccaataaaactttattcacagaaacaagctgccagctagacttggcctgcaggctgtagttagctgacccctggcatgggtcattgtcttgctacgcagctttcttggttctgcgtacattttgccttaacctgcatgttagtggccttctttttaaaaaaaaagtttttaaaaacttttactattattcttatttttaaagatgaggtcttgctgtcacccaggctggagcagtggtgcaatcatagcttactgcagccttgaattcctggggtcaatctatcttcccacctcagcctcctgagtagctgggatcacaggcatatgaaccaccatgcccagctaatttaaaaaaaattttttttttttgtacagatggggtcttggttcactgcccaagctggtctcaaactcctgacttcaagcgatcctcccaccttggcctcccaaagtgttgggattacaggtgtgagccactgtgcctggacagtaaggcttcttatgaacagcagtgtccaggctgttttcttcttttgagtcccccggatgttgtataaataggagagtgttcagttgatgtttgacaaatgagtgaacagtgaatgaatggtggctgctttcagaagttggcaaccctgctgtccttctggatggctgagctcttccagccttctggcgtcctgcctcctttccctggcctgccctgctagaaagagaggagagaaggcatcttttctctgtcttcctcagccacccttccacttctttgagcaactactatttacaactcaaagaattctttatttatactgtgtgagagactgtttacccgtgttgaactaacattaggtttctttaaatctgctattaaaacgaagagtggccatttgtaactttaggagcataagagctgggttcatgatgtaagtgarcagagacacccttaaagttatttcccaaggccctgggaatgcgattttcttagtttatttgttacaagggagtgttttgtacattggtagaggaaaatactatgaaacaaaatcaaacaaaaacatcattacattttaaaatcattttgcaacactgagcaggtatgaatttggtactttgcttgtaattggaaaactggaaagttgaaaatttaagtatggatattatgattttcaatttttagaagatgtatagtatataatggcagtttgcatttgatgttagaaagaatagcatctcaagggaaaacaaaaatgctttccgttccagaaaatgttaaacattcctttttttcttaggataaactcactactagctacttttcttctgcctgagcccttcattgtaaaagtgaattaatgttgtcctctgaattctgttggggaaaatgacacagaacccctgtgaatgaagaattgcttttaatttcactggacgtgaggcagaggaggaccttggaaaaggaaggttattatttcctctgtggaaacgtttatcttcgttttctgggtgactggtaaaaacaatagtttgctgtggagtttcagtaatcaaagaagaggaaatagcatgtgagtgactgcaagttggtggggacaaccctggctcttttgaaggtgaaacttactaaagccacattagctatctcctagtgcaaaggtcgagaaacattttctgtaaagggctagaggtaaatagtttagacttcatgggccataaagtccctgttgtaaattttcagctctgctgttgtggtatgagagcagccatagacagttttagaaacaaatgagagtagctgtgttccaatacaactgtatttatggacacaaaaatttgaattttcatatgtcacaaaatagtattattttaatttgttacaattatttaaaaatgtaaaaaccattcttagattccctgttgtacaaaaacaggtagtgggtaggatttgggtgcagggcatagtttgctgaccctatcctggtgaactagcgcaataatttcttaggtggggaggtgtagtggataacacattacacattctgtaccttttagtaggtaatccgattatgattagctaacccaaacttgtgaagaaaatttcctggtggagttggatggctttgaggagtccagtgttcttgtccctgccctgttagtgtaaagctgaatggcactttggaccttggctgcccatctggtacatgatgaagttggactagatgacttctagggcttcgtgtagagcttaacattttattttaattaattaattaggttttttttgagacaaggtctcactttgctacccaggcaggagggcaatggtgtgatcagggctcactgctacctctacctccaaggctccagcaatcttcccacctcagcctcctgagtggctgggactacaggcacatgccaccacagctcactaatttttgtattatttctattttttttcttttgtaaagacagggttttgccatgttgcccaggctggtctcaaactcctgggctcaagcagtcctcctgctttggcctcccaaagtgctgagattatagcgcgtgagccacttgactgatcttaacgttttagaccctttatcacttgtgttttggttcttcttctgataattattgcaatttaccttttaaaaaattatttaggcctggcgtggtgactcacacctgtaatcctagcactttgggaggccaaggcaggcggaccacttgaggtcaggagttcgaaaccagcctggccagtatggtgaaacccccatctctactaaaaatacaaaaaaattagccaggcgtggtggcacatgcctgtagtcctagctacttgggaggctgaggcaggaaaatggcttgaacccaggagatggaggttgcagtgagccaagatcatgccactgcactccatcctgggtgacagagcaagactccatctcaaaaaaaaaaaaaaatttagatatttgttgagaaactaatatgtgctaactgtgcaggctctggtgatggtggttgtgtgtgtgtgcacatttgtgtgtgtgcatgtgtgtgaaacagatggtagggtagttacaatacaaaaatgtacatattagtattctaaataaattttttttctattttgtgcagtctttcttgaagttataaaaacaatataatgggcaattaggcatttacactatttttattaaaaataataaatgtatatgaataattatactcagaattcaacaatatcagatattgatttttgcagttactttagttattcatttatttattcattcatgtaacaaatagttcttgagtacctaccatgtacttcaaggcactggcttaggccttgaagactaaactatttgccctcacgaaacttgcattctaatggaatctcctgttgaagatgctaggtagatggttttattcgtacttttcagaggaggtgtacttattcattacttatttttctttttttgtttcagttatctcttgggaaatctctgagtaatgtttttgaattaccagaggaaattttacagtcacacaggtctttgttgacttttgcagtcgcctaaagttgttaatcattgaagagaactctgattcctcactgacaaagaatgaattctatcgttttagttatattagttaatttggaaagtacttcaatcaatttaaaactttagggaagatcaattcagtaagttctttagaaaatcactacgtcaaggctgggtgcagtggctcacacctgtaatcccagcactttgggaggccgaggcgggcggatcacgaggtgaggagatcgagaccatcctggctaacatggtgaaaccctgtctctactaaaaatacaaaaatttacccgggcattgcggcgtgtgcctgtagtcccagctactcaggaggctgaggcaggagaatggcgtgaatccaggaggtggaggttgcagtgagccaatatcacgctactgcactccaacctgggcaacagagtgaaactctgtctcaaaaaaagaaaagaactatgtcaaattctcaaaggtcactgaagttaacccgtgttatcagtcttctaagcagcattagtggatttatatttatgttacacatttctcctcataaaaaaagatttcacatgcatttattcaatgaatactaaaaaagatgaatatttcaaaaagtaaaagcaactgaaaatagtaatatctgttaaaactgcgtcatggctttgccttgatatcatgagttttgtctgcttttatgagggtggcatttttgggctttacaaataaaaaaataccattgtaatagtagtattataaccgtaaccaatagtccaacaatagcgaaagcattcactgtgtatcactcccctccaggccaccccggctttgctctgcttctagtcagagtggatgcctcgcagttctttttgaataaagttaaatctgacttcaggtctttcacacacacatttgccgccctttggaatctcttccttctctgcctttatcatctagttaattcctggtaagtctcaacttgaaaggtcttctctttatggaagctttccctgagttttatgtggactgaagtttcccctgttagcatccttacttcttctgagcaactgtaattgtttatgtcattatctgacaagaagctggatgaaggcggagtgtgtattgcccatcactctattctcagcacttggtttgaatgagcctataagtggtattttacccacccctcacaaaagaagctatatcaatataagctattattcgtgtaatttagtgagaaatactgatgtttcctcaccccatagttttgtgtatcttttgtagacctcagtgtttcatgacctatatattataatgtttactgactagatttggtcagttactatttgaggaaatgctgggatttcttagaaattttaatgataaaagaatgcatagggccagaatgtttgaaaccaagactgccttagagaaacccagggcatatagcagacacatttttgacctgaaacgcttaaagcggaatgggacaggaaaatacatatgcatgaaataattagtatgtttctcagtctgtccaggctactataacaaaaataccataaactaggtggctcaggaaacaacaaacatttatttctcacagttctggtagctaggaagtacaagatcaagacaccagcagatgtggtgtcttatgagggcctattcctcatagatcatgccttctacccgagtcatcatatggtagaagggataaacaagctctctctggcctctttcatgagggccttaatcccattccatgtgggctctgcccccatgatctaactaccttccaaaggccccatgttgggaggttatatttcaacatatgaatttggtggggacacagacattcacaccatagcagtatgccacctgtgacagtacctgtttgtctttatagctgtgttctcttgtttctccagtatctcagtggtattggacaggatattagattcaggagaggacttcagaatgttaactagtggtaagaaagcagcttcatggggtggctggggcttgagggagtctgtaactcgggaccacattttagtaactagagaaaatgtttcagcaactgtatggtgataagtccctagtctaaatctctagcacaaatctttcttttgagtgctggataccctattcttttgcccattaaacacgtctacttgcatgcgccacagtcacctcaaaggcaacatgtccaaagcaaattcattatctcactctcgaacttgctccttctccgttgttatggaactcagtaaccacattgctcaaattactgcctcacccattatttcttcctcacctatcacatccagtcctccaagttctctcagtcccgcctcatacatttcctccataacctgctcccttgtctatgttttctagtgtaggtcactacactagaaaggtcatcctttgcttgtgctcctgcaatagtcttctaactggtctcctacctggtagctggtcttactctcctctgatccactctcatgctgtggccaaagtgattttctaaaaagacagatgtcttaattatgcatgtgctttgaagctcctcgtttggcatttaggataaagttcaaatgccttagcttatgagaggccctgtgaccaggtctccactctccaaccatattgatgatcttacagtttctcctgtgtattgtgctgtctccggcctctggacctttagtgctgctccttctgtctaaattacttgttttctcaattagtgacccttccctccttcagtgcacaggcttggaagcctatccatgaatctcactaccctgaaatccaagggataaggtgaccatgaacctcagcacctcaagccttccattgacatttccctcctttgctccatgggtaagaatgcagaacgtatggcttcagcttctgtgtgggcctttctctatgcctggtttttcctggcacctgtcctcccacctgccttctggcctgccagtgtgtctgatctgagcagactgggagggtgtgaagaagggccagtaccgcttcagcaggaagggcagcacacggaaggccagcagccttgggctggcctgcatctgcccctcacataccctacagagaaacactgagcagctggtcagcatgtgggctgggaggaatggggctgggctaggggactagggattaaggcagcccttgtagcagcaactgtgacacaaggagcacctggccctcctggaagtcccagggctctttctttgacctccttccttcacttcctgcattttctaaattgtagctaaaatttgagatagaaccctaagagtaaaacctggccctgctagcattgatttcctgagattaacttctcttttagctaaggagcatctctggatgatgagtagagatggaagccaagtcatgtgcccttaaagtcctgtgcaagctccttcccgggatgtggtggggtgtgcatgcagtgagctgtgagggggtggccctgtcacagggaatgaggcctcagccattgtctggcagtgttggcagtgtgattttaagccagttatttaacttctaggtctcaggtccttagcctataaagttgggataatacttatcttacagggttggagcatgaaataaatattaagagaatcaaaagcaaaaatgctttgcatattatgtaatatgaaactatttttcatgtactactacttatagtattactactatttatggagtttaaaaagtttctgtgttttgaatatatttaatgaactcagtctttctaattatctgtatgtatcatgaatacaacataaaatctatgaccgtggcaaaatactatcactgaccttagatgtggccaatgtgttcttgactgagatctgtacagcttcacatgcttttttttttttttttttttggtatgccgcttatgtagcaccagtagaggatttttttttcattgacattatcttatattcccctcattattaggagaaaatgtcagttgattttctgcgttactaaggacatgaacaaagaaaactgtgtaacacaaaactttctgtgtggaatagagaaatttaatcactgtcatgatttcatcagtggggcagttcacagctttagggcatgccaatgagctgtatcacttcagagttaaccaaagaaagaaatgtaatgggggatggagaatgtaattagagtggagtacaaggggggggtggggaabctttgtaactaaattattagcattatcatgaagaaactgtcttttgaattgtttttaagctaaagaaatcataaagcagtgtttttatgtgactatgtaattccccttgtatttgaggttaatatgctgcaaattcttcataaatcttcattaagatgtcaaaattccttgtgaagcctgtcttcatttgcattcccttgtacagttattaacaaagaccctttatgtctctgcccagcttgatttcagtcatgaactccattttccttttattatttcatagaatctggttccttgattgaacttagtaaatcatttcttgaggacttggtgggaagccagagagtggtagtgaggggggcagtttatgagcccagggtgggtggagacccttgttcctcaaagcaagacattattaactttagagtctcctcttatcagatcttaaaaattcttgcccaaagttaatagtttttgaagtttgcaaatagatttctacagttgaaacctagagtagaaagaagcctggttatttatttatttatttatttatttatctttggctttaaaattaggcttttctggccgggcacagtggctcatgcctatcatctcagcactttgggaggcccaggcaagcggatcacttgaggtcaggagttcgagaccagcctggccaacatggtgaaaccccgtctctactgtaaatacaaaaattagctgggtgtggtgatgctgtaatcccagcaactcgggaggctgaggcaggagaatctcttgaaactggacagcagaggttgcagtgagccgagatcgtgccactgcactccagtctgggcaacagagtgagactccgtctcaaaaaaaagttgggggggaagccttttctcaccaattgagtgtcagtgtggccagtgtaaacaaggatgaaaatagctatttgaggggtttggtggccactttaaagttgtgtcagggcaatgatcaacactagagtttcagttcctgttgagatctgtgctctctacctttcagtctgtgagactgagtcggaatgtccccaagtatttaggaccctgtgactgctggaatttcagggttgctcagggtccagagtgaaaagaacgctgctgccaataacgccttcccatcttgggttgcctttgttcacatagctttgcttattctttaatccaaatcatcagctcattccaaaatagttgctagcaaaaatacatgtgaatgctcattcaagaatataaaggatattaaaatatcctcttatatcatgactctgcagacggaaaattctacctgaactttgcctttggttttcttaacatttcctcttagccctacgtagatacatttttctcctgtgggggaaaatttattgtttcctcattttcccccagcattatttgagtgtctgcaaatgcatattggtagtttttctagtaggacctggtttgtggttgttaatggtaaatgtgaaaattagatgtagtccaggctcaaaaggagtttaaaatctgatagaaataagactttccacaaccactagtgtggcaaaatctctgtgggtaaatgtaacttcaagcataatgtacccatctctcacattttgctcaagttgaatttcttccgttctgaggcagccactccctctgtaccatatgattacatggcttgcttacttgctgtactgcctttagcattgtcggttgggtgttttaaacctgcacgttttatttctcaagtagaccggaggatccttaaaaggtagccaaagaatagaattatataatattttaaaaagtaaaaaaaaaaataatttttttcatattctgggtcattgtagctttgtttacaaggactttacatrttgaagaattggaggatgtattagttttgggttttttaggttggtttttagagaagtattaggaagttcccaaggggattgaccttgtagtttcaagaaaaggagaaatgrtcatgcctgggcatttttgggtgctttgtttgaaatatgcatccacttggctgggtgtggtgcctcatgcctataatcccarcattttgggaggctgaggcaggtggatcacttgaggttaggagttccagaccagcctggccaacacagtgaagccccctctttactaawaatacaataattagccaggtatgggggctcacctgtgtcacctgtggtcccagatactcaggaggctgaagcactagtattgcttgaacctgggaggcagaggttgcagtgagctgagatggctccattgcactccagcctgggcaacagagtgagactctgtctcaaaaagaaagaaaaactataaaaaattataaaatatgcatctacctcttgaaattgatacatttttgaatttggaaatgttgaataattagagcctgagcataggtctatgttttgctaagataatgtacttgggagggtggttaaaatagtcattaattttggtcacaaatttaaacagagcttgcttgacagggacagcttctctctgtttcatgcagtgtcatttggagtggcttgactgggggacaagggattaattttcaagggggctcacccacatgactagcaagttggtgttgactgtcagccaggcaacattttctttccaagtgggtctctctacaaaatgcatgagcttccttatggcatggtggctgggttccaagagtgagcattccatgaaacagaaagtaggagccatgagttggtgccggaaactggtacatcatatttaccatattctattggtcaagcagttgataatgtgaattttaaataggaaattttatgactcatggaaagactttatttggatttcatttaatgtatcaaatgggtaccccagggtggctattgccttgaggaaggtgctttatttccactaatgtataaaggaaggtgccaggcccatgaggtacaactaatgcttattatcaattttattttattcttccccttcaggtgagtggagtgagtgtcaaggacagaggactgaggtcccagcttgaggtgcttggagggacagagaagaatcagggtgaggaagctgtcaggctcctcttttcccttttggccctgtgactttattagcttaactaatacttcatagtgtttgctatgtaccaggcactttacatatattaactcaattatattcccatcggggactgtgttacaggtagaatcttaattaaagctactgctactgattcttaataatggcattacttgaagagattattattaataggcccttgccccatttgattacactgtgtgatatacagttgtcccttggtgtccggaaaggattggttccaggaccctggaagatacaaaaatttgacgacgctcaagtcctttatagacaatgtcatcatatttgcataaagcctatacacatcctctcttatactttaaatcatctctagatttacttataatacctgataaaatgtaaatgcaatgtaaatagttgttatactgtatcattgtattgttttttatttgtattcatttttacaaattgttgtactatcattatttattttgaatattttcaggccaatgttggttgaatcccaggatgtgaaacaggtgaagatgaagggcccattatataccttgtcgctatttaaagatgtctcaaactcttggaattttgatgtttttgaacatgtaacttaatggatcctccttcatattattgtagtttctcttaatactaaagtagatattattgccttggtgtattttacttttaagtttaaaaaatttttgatttaatgatactcttgaggattttagtttgggatattaccactgtcaaagctggcaggttcttcacttgattaagtcttatttccactcaacaccatttaagtagtttgagactggttataatgagcattggtacaggactggcccctcttttcagtcaaggtcagttggcaacagctatacactgtttctttattttggaaaggttttgcttgcgcaaagacttactcttttaaccaaatcctgcttttcatctgtttttgatggcaacagaccatatttcccagccatttgcaaacagtgcctgtctggcgggatttcctggacacagcccttgacaaccattactggccaacttttgaacttcagtgtttaacctggttatttgttctgtgttttctgccatgggccatgggaaccataagcttatccttttgagactagcagaaggtccaagaacaatccatttgctaattggacccattgctttccccagcccattaaccttcatgaatcaaatcttccttccaatatccagctattcatctacaagtcagtactatgcagagtgatactttctaaccaaggtgcctatggtagaccttggtcattgccattttggaatctttaccttatggactgatataatccaaacatgtcagtgtgtcataaaaattggttggccaattaaagataatttgatagtgcaaatatcattaaaattgttcttatgtacaaataataatttaaaaatccatatataatgacttacaagtaataaggccgtacttttttcactctaaaaaaaataagcaaatgataaaacattcatgctctttgacccagtggtactgattctggggctctagcctaaagaaataactcaaaacattgagaaaagcttatgcttatggatgtttgttgaagcattatttgtaatgaataaagaaaaatataaatatctaacagtaaggaattgttaattaaattatgatgttgatgaaagtttttaacggcatttgaatattgttatgatgttaaatgaaaaaaaaatggaatacagcattttccacaatatggtcacagccatggaaaaaacatgcattagaaaaaagacagaaaccagccaggcacagtggctcacgcctgtaatccaagcaatttgggagacactaggagacactagaaagaagattaaagaaaatttcaagagtgcttggcttgagtgccagtcagacttgggtccaaattcctactcttttacttatgagctatgtagcttcaggcaagtcttttaaacttttgagcctcagtttcctcatttataagatggggataataatttttccaggattattgtgagtattaaatgagataatgatacaagtaaaattcttgataatctataggcaaccaacagctggatggtggcaagtactaattcgtagcttcaagatgttctcagttgtattcttgactttggcattcttctgttacgtttgcactgatttttgacatgctgctaggagacaggtaatgtgaaggatctattggggggtttgcctttacggcttttctggtacattgtaggtcaaacaccaacacctgtgttaggccctgtcacatattcagggaccttcactgttcacctgagcttaaccaacaacactcacctgcaggcatgcacttgagtacagatgctgcttgttttgagtgaagcagatacagaaaatctttaactacaatcccatttataaaagggtggagcttatttcttttaaaaaataatcattccaaaaagatttgcacagaattaattttcaaagggtgacctctcttgtgcatttaaaatgtgattcaagcaaaccaaacaaaaaaaggattcggcctacactttcagtggcacgaagtaaagtgcacttgtgtccaaggttggactccttgcttttcttccaagcatctttcccagtctcatcatttactagtttatattttaaacttagcttcagaatgcttatgctgatgttaatgagtctatcttcaaatgctattttagtttatcttttttactttattttatttttttttgagacaggatctcactctcacacagctcacagcagcctcaccctcccttgagctcaggtgatccttccaccccagcctctcgaggcactgggacttcaggtgtgcgctgccacgcctagatagataatttttctttttttcttttttttttccttcttcttcttcttcttctttttttttttttttgtagagctggggtttcaccatgttgcccaggctggtctcgaacctctaggctcaatctatcacccatcttggcattccaaagtgctgggattacaggctcctggcctattttagtttctctctgttctttatagtggatccttaaggcatagagaattttaggaagagtatgagcatggaatagtaaagtcattgttgtcagcatacgacagagggaaagtcactgagtctttttgatccttggcttccttatcaataaaatactaatattggcactgtttacctaacagttattgtgaagccaaatcacaatagctaacatttattaaacaattatgtgttctaggcaccatgttaagagctttgcatgctttattaactttaatttcagggtaactttatggagtagatcattgtgtcctaatcataatggtagctaatatttattgatagttttctatctgccaggttttgttctaaggtctttgtgtgtcatagatattggtagaaaatggaggcaccaagagattaagtaatttgcccaagttaatttaagtagaaagtgtaggagctactattggaacacaatctgattccagacgtcttaaccactgtgcaatatctccactgtatagatgtagaaactgagaaatagaagcacagtagcttatccaaagtcacacagctagtaagcggcagatcttaccttcaaacaagattcgccattgcgcacatcattatctgttatgcaacatggcttcaaagtctgagtgatggcaccaggtactgctctgagtgctcttcagcctctgtcctcagagtcaagaaaatgtgtaccagtggcgggtccactagaagatccactgcactacggctgttgccttgtgtattcaaatccacagttcctcatgtcctgaggtcagcgagccacagagaagtgggctcaccttttctaacttaatcagtgcactgacagaggaacaggttacagagggatttctctgggaaagctgtggtgccagggcttgcttgtgcccagcaagggaattagaaatgccagggctaattccccagtggagaatgattcagaagaaaaatgaattcctgaaggctgttgtgttatcagtgccaggtctgagagagcagggcaggaatatgatggcttgtctttggaaaacatccaaacaactttcagtttcagaacagacttcactacttctcttagaacacttactgtcctttactgtaatttttgttataactggaggatagaaggaaatatgctatttgattttatgtacaaagaattttgagtccattgagctaataatgtctcccaagacaataccagtttatggagaacttggttttttgtttttgtttttgtttttttttgagagatggaatctcaccatgttgcccaggctggagtgcagtgatgtggtgatctctgctcactgcaacctccacctcccgggttcaagcgattctcctgcctcagcctcccgagtagctgggattacaggtgcgtgccaccatgcctggggtaatttttgtatttttagtagagatggggtttcaccatgttagacaggctggtctcgagctcctgacttcaggtgttcacctgcctcggcctcccaaagtgcagggattacaggcatgggccaccgcgcctcgcccaattatggagaaatttgaaccataatatgaatgttaatttgggaggaattctactgcagttcattttggaaacttgaaccaagtaggaaggattttattgttaaaaaaatctgatcacattttatgtaataaaatgtcaaacatgcaaggagagagtaatagggtaatgacccaccatataccccttgcctagatttaagaattgttaacatttggtatatttgtttaatatgttatttaatagtagtattttcaagcaaataaaatatatgatattttactcctaaatacttaaatagttgcctctaaaaaagaagaacattttcttacataacaaaattactatttacatgtgtgacaaaatcaacaataacctatttttttcttttgtttttgaacattttcaaacctgaaaaaatgttgaaagagagtttgctctttatctaggttcagcaattgttaacctttttccaaaagaagttataggcaaggctgggcgcggtggctcatgcctgtaatcccagcactttgggaggccgaggtgagtggatcacgaggttaagagattgagaccgtcctgggcagcatggtgaaaccctgtctctactgtaaatactaaaattagctgggcgtggtggtgcatgcctgtagtcccagctactagggaggctgaggcaggagaatcgcttgaacctgggaggcagaggttgcagtgagccaagatcgcgccaytgcactccagcctggcaacagagcgacactccgtctcaaaaaaaaaaaaaaaaaaaaaaaaaaaaaaaagtaaaaaagaggttataggcaatatgagattttccctaagtactttagaatgcatttcctaagaataagacattcttttataccataacaaattctattattatacccaagaaaattaaccttagtacaataatatgacctaatatttagcccttattcaaattcccccagttgttccaaaaatgtcttttgtagctctgtgtgtgtgtgtgtggtgtgtgtgtgtttgtgtgtgtgtctgttttccccagtgcaggatccaatcagattcacatattgcatttagtaataattatgtttctcctgattcaaaaagtgtctctccccttgaccattttgtttgtttttcgtcttaacctgttttgaaaaaaactttagaccactatcacacacgatgggttctttatgattaaattaggttaaaatttttcacaaaaatacagcataaatgattttgtgaatttcttattgtatcttatcaggatagaagcaataatttcttaaaatattatttaatatccagtacatattcaaatattcctaatggtctcagatgtgtttttttacatcggcttgctcaaaccaaatattgtacaccatttaaaaaaaatcgacatagaaaaatcaattacagtctttttgagggggagggggaactcctaaaccagaataagttcagagaggccccctgaccacagtcttaatttctattccttgtaaatgcctcagagtaattcttaggcttctgctatatggaaactacatccctttgtcttttatacaaattacttgaaaaaaatggaggtaatttctcttgattactttaagaaatgaagtagaatttttgtagaacagtatacaaaccataaataaacggcttgatgaatttgcacaaattgaacacacccacgtaagcaggtctctgacccaagaaacaggatttttcccagctccaaaaagcgccccttccagattccccaagggtacctactctaacatccagcgtcatgggttcatttgccttatgcaaatttcttctctttccctgaaaaaggaagcacgaagtagagaagccatacaaaatatgtatattttaattaggtattttgaaagcccaccttcaaagacattttaaatgatatactgtatatattttcacacaaaataattcccacaacaatgttttacataatggtttcattcaatggctccccctgcttccctagaattgggatttcatccaaaacactaaaggttaagttatcaatagaactcaaagagcattttgttwccatttgtataagtcgtttaatgttttttaagtccacgcatgtgttaacaaaggaggcagtcaattacaggggagcttagcaaggcattcttagagttctcttcagtggtgagcagtgtcgaagtggaatcaggaaaagagcaacccttttcactgaaggaaattattttaattagtaattctcaaagggtaataaacagtcaaatatttctgaaatctcctggctttggggcaagtaattacaatgagcatgcaattaaaaaaaaaaaaagaaagaaaactaagacgagggcatgtacaatcaattaaatagaagtaattacattatgagggcttcatgagtagtgtacggkgcattaacattgtggagacaaaagccaccagacagcacattgtatgtgcaagtcttttgaatctgaggttggttttcatggtcttctcgattctacgttgtggggctctgccactggtagtcggtaactttctaatgcactgaactggcaggagtgatggcagcatgcctatttgtggtgtctagggaagccttcttaaatcattggtatgcccagcctaaatcagatcacgcggatcctgcagtcggtatctgggtgatactgtgattggtacatgagtgtaacttggctcggtgtgcctggagttttttttagcagggataggaatctaccatctctggtgtgtttttcaatgtggcatgccccagtgacattagtggagaagggacttgctaaagttagaaagtaagattgaacagctgggttcaaggccttatactaggttcccaccagctgtttcaaagggatggagaggagccacccagagtgctttgcagcagctgtgaccccraaccaagggaagctttatttcgaaagcacactaagaatagatacaggctcctgattttaaaatacagcggacgattaaaagctttctgggtataaacagttcaggtcactttttaaaaacacaagttaatttcaagctatatggaaatttacatgtgtgttttacatatgtatatatatttatacacatacatatatgcctgtatatatatattctgatatatgccgattaatctctctaatctatattagctctgctttgaatgaactttgtcgttgggatgctttggcatcagggcttcatagcattgtacttacatttattcagtgcctttggataggaacgcctgtagtttttttagttctggtcagttgggtataaaatattgccatagtgtcagaagcacagtgtgtgttcagacaatgctgttgaatctgaagtcatgcttgtaataaataccataaatagtatattttgcaacttcttaaaatgtattctataggatagtaataattaagtgaaaaaagttacacataaaatgaattacagaaatgtgggattaagctaattgaaaactagaatcttttatatgcatatgtattgtataaatattaggagaggaatataacattcagtgttttccatacttatttgataacagaacccttttgggtgcaggggtgagggggattatcttctaggactgatgttttatagaacatcattgaggttaccttgccccatagctgtgtctcctcacagtctggttgaacctgaaagcatttgttaccggagaagtagattttaggtggaaataccagatgcagttggcagaatcagaagtgtctctccctttgctgaattcacaatgactttgtattcactaattctttctcctaccccctcccgcaatgtttctcacatttggcaacatatgataacatttgtacattttcccgcacttttgtattaatatatttattacgggtctgagtatttaaacatgaacttttttctcaagtcatttaaaatgastacaattcctaacccagaatgaaatgtttcttctaatataactatttttaatttcagaatacattgcaaaaatgttttttgtgtaaatgttttaaaacataagatattatcatgaaaaggtaatttcttagaaaaantggaatttatctctactacttttttttgtttagagaaaatttaggaaaagtgaatgtacatcttgaattttagttaagtaattacagttatatagtcaattataaaggctggttacatagcttattatagactgaacacattttatacaacagccctatttgaatattttccctagttattaaaataatgaaaacattaataaaaactaaaggcaatatgatattaaaagcattaataaaaatggaaggcaagttaggctaaagttactatcagagactggcttctgaaggaacaggttttggctttccaagtggcagggccttaagaatcacatccccagctctggcttagggttccagcattgctcatggcatattcagctgttgccttgcatctccaaatctatcttcagagtccttttacctcttccttttaggtcatagtggagagttggcgttccgctttgtatttatgtttttttaagtagtatttgtatttctttctttcctttctccctaacaactacaggatcacatggacctaatttgttttattgtcacaagagtcccttttcttgacaggatatgcctaattaaaaccagggtgttaaaaaaaaaaaaaaagctaagttttgcaggcaagttgacatactgtgtgactcaagggtttcaggagggacaaggagggatggtggtgtgttattgaagcaagaggaggaccaagcctgcaggagatattgttccaggacaaagtcaggctatcagcagtgctgacggtccacctccccttttccttccttcctaatggcccaagttatgcacgtcagcctctttgggttcacaaggcagtattgtatcatggaaaaagccctagaccttattatgagaacaagatttgactctgctntgccacatggaaactaagaacttattaagtaggtttacttcacccaactctgtttctgtatcttttttttgagacggagtctccctcttgtcacccaggctggagtgcaatggcatgatctcggctcgctgcaacctccacctcccgggttcaagcgattctcctgcctcagcctctcgagtagctgggattacacccgccaccatgcctggtgaatttttgtatttttagtagagatggggtttcaccacgttggccaggcttgtctgaaactcctgacctcaggtgacccgcctgcctcggcctcccaaagtgctgggattacaggtgtaagccaccgcacccggcccatttttatttcttaaaaacagagattagtaagcctgttatgtaatgatcaagttaagatcatttttgaagccataaaatggtatataaatgtcaactattattatcagacattaacagcatggttattgtgaatattatgactaataattaatatgaataattattattgtaactatcattattaccatgattgtcattattaggaatataagtagcaattcattcaacatacatttattatttagtgtctattgtatgctagatatggtggactttcaggacccatggtgtatagtacctggtagaggctcagccgagcagtttgcagaatcaacaggaatgaattgagaatgacttaatttgtttaatagaatgtgacagcattctctagaatttgttcctttctggggcaagtaaggaacaaatcttcctagattagttttatgagtacttacagataaaaacatatatgatgtgaataagattcaactgttayatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagttggggctactgagaagttgaaagctgctttaaagtctcctttcattttaacaccattaaaaaaaaaaaaaactcatggaaaggaaaaatctaaatgtatcctgtaaagaaaataccatttcctctggtaattatgatggtctatatcctgtttaactcattgcacggggttcctctccaagtcaatgaggattgcgtaaagagtctgaaggcaggatgtgcctcatagtgggatgagaaggagccttrtggctggtcgtcagactaaatttaaaccattatttgttgtgaatatatgattaacgtgggggttaaaaatgaaaaatacagctgcaagagtaggtttcttcctttgataaaaacagaaaaagtcaggagggacaagaagaaaacaaacacagttacgtgaggcatgcattctctttcataagaacagtcaaatatattttagcctaatctttctttctagatacaataaatgccgctcccttctggattaggcagatgacagcaataacagtattgcagctgggagtctcccaggctgacaggtgctggatataagatgccccagattgtcctgtgaagtacaggacatgctaggccctgctggatctgcccaaggagagggcagctcctgtgtctgttgacacctcgtttagattctcccgctcactcaaacagctgccagaggcagccgtaaaatattgcttaattatagaacttcccttgatcctctttatcccttccttctattgcatttttcccccttttgtgcctctctctagttcagagcacctttaggctaagcactcatgggagtattatggtggcgccttttccaactcacagttaaggcagagacaagattttcagtcctgcactatagctgtggaattattttcagaggctgtaatgagcaggtataggttcaaatgtggaatgcagcatcattttttaagcaggaaatgggttcattttggggggaggatagctttctcattttttttctgattagaaaaatartgcttattgtacaaaaagaacaaagaaatgtaaagatatgaataaagcctacttcccccttgttcatatgtgttctatttaccaaaacgggattatgttcactcccacaatatattttagcaaatacagatccatgtaatttatcatgtctgttcagtcttccactgtctgactgtaccataatttgtttaaccattctatcatcatacactaaagatagaaacaaaacygctgtggacatccttaagcatacattctgcatacttgtattggtttggagtcatgtttgtgatttacagggatgcgaaatgagatcatttatttctctaacattaaggaaatctgaattaaggaactcaagagctggtttgctggctccgctgcacctttctgcttagttgttcttactgagtggcttccattcctcataattccagctgtctgctgcagctccagccatcacgttcatatgccaggctggagaaaagatggaagggtgggaagcagaaacgtatgtctattgcttccgtttaaaaacctttcccagaagcccacacagcacttctgttcattgtctagaacttagtctcttggcaatacttagcacctaaaaagggagagcagatattccaaagcaacaaccatctctgtcattcccatctaattgttttctgggaataaaagctttgtgcaaatggacttactggatcaaagcttttcccaggtttttgttgcatattgatatactgctcttcagaaagatggtaccaagttaagtctagtaatatgcgagaataacccgccgtaagttttcaggttcttttgtgtgcattttatgggcatttttaaagctatttttctgaagctgcattttttcttttgtttattaaatcatacattctataaagagtgaggtggagattttactatttacaattttgtcttcaaaatctatgtctgtacaagtagaatattcattccaagcactggaaggacattttaatgttattcgcacgtatttcctctactcctaagaaaacttatttggaggttgccagttgaattaatacattaatcaaagtaaggcagctctctcctgttttgaaaaacttcctgtcaattaaatacaaggcacagtgtaaaagtggctctgcccaagttagtgtttagacagaaatgtttgtattacaccgtggtgtgaccatcagcagctccataaataaaggaatcatctgccggcgcttcccaccttttgggtggggtctgttttctccttcagtggaaggacattggggtcatcatcattactgctgaaatgttattactttagattttatcaaaaaacttggtgtcaccaggtctgaagggaaaaaaaaaatcaaacttttttctttttaccctcacacaccatccaacacagcacttccgattccctagcagacaccaactgggtgtcctgtaatttcattcaattctgacactacctacccagagatagtatcagatctcacaggctaagggcttagtcccacaagactgcaccccctccagcccacctttttagatgccaattgcaagctacaggtggtgacctgtgcttctgactaactccctccttggatttgatccatttgctagaatgactcacataactcagggagacacttcacttacttttacccatttattagaaagaatgttacaagggattcagatgaacagccaggtggaagagatacataggacaaggtacttggagcttccacaccctctctggatgtgccaccctccaggagccttcacatgttcagctatccagaagctctctgaaccctatccttatggatttttatggaggctttattacataggcataattgatttcatcactggtgatcagctcatccttcagcccctcttcccttccctgaaggttgggatgtggtgtgggactgaaagttcgaatcctccagccatgtggttggttccccctggcaaccagccccttcctaaggctatgtaggagcccaccaacagtcacctcattaaaacaagagaagttcctatcacccagaaaattccaagggattagaagctctgtgtcaggagccgaagtcaaagaccaaatattaaaaccaaagattctcctagcacccctatctacaagggttataggaactctagatcggcaatggtgacagagatttatttcttaatatatcacaatatcacacatggtttcccgatttggttattcaaattggtttatattagctttttttcatctttctttatcttgcgagtgttacagaataaaactcacttctcttcaaagttagaaaagtgaccagccaaaggattactatcactgagggatcatttagaaacaagtgattattctaatgctactaacttaaataaaaaaaaaaaagttggtgaatcagtagatggccgtgccgtatatattcttgcaactttcctataagtttaaaggtatatcaaaacaaaaagttatatacgcacaaatagatgttgattttatatgatttttatctgctactttcatgaagaaggatggggtttgaagtcataattgaaacaggtacatatttttgtactttgttaagtaaaaaattaaatcaatcatgtattttttattaacatccacttgtgggtacaaagatacttactgtttggagtttgcataaacatacttgtttaaaaacaacagcattttttaggctaaatctgtttttccattagttgaagtcatagaaccttcaaggcttcctgcatttctgtacctggtatgtcccctcacattttggaactattatctccttgtaaattattagaaaaattaaattagattaaaacttcttgagcatttctttattaggaaaaatggaaatccattacatattcttttgcttgcattcaatcttactgtgctttttactgcaagctgaagtcccctttctactttaaatgggagagaaaatcttgtgctgacatgagatgctcattaccaccaaggcactcattaccaacaaggrcagtaaaggaatcgcagctttggctgcctctcacactgaatctgagagttgctattattagaatgcaaaaaaaaaaaaattgtggggtgctggtgggggaactatgtgagacttgtggttagctagacctgtgttttaagaatatttttgtctctgagtcaattgttacttaactactcgactatatgaaatcaagtatatcagccaggtgcagtggctcatgcctgtaatcccagcactttgggaggcygaggcaggcagatcacctgaggtcaggagttcaagaccagcctggccaacatggtgaaaccccgtctctactaaaaatacaaaaaaattagcctggcgtagtggcgcatgcctgtagtgccagctactcaggagactgwggcaaaagaatcacttgaacctgggaagtgaaggttgcagtgagcagagatcgttctccagtctgggtgacaagagtgaaactccatcttaaacacacacacacacacacacacacacacacacacacgaaagaaatcaagtatatctgtagtttttgcagtaaattgatgtctaccattatttctctccattttcttgtgttcattgtactataaggtgtttattgattttttttctttttttgcatttgaattactcagatccctttaaacagtttggatagattttcacaagggaaaggaagggaactaatatttatagtgtgtcatgcatatccggcactgtgctaggtgctttacttttgttatttgatgaaattctcaaaacagcctcatgtaatggatgttcttatgcccattttacattggaggagaccaaggcttggagatgttacttacagtagtctcttagtcagttaatggcagaaacagatctcaaatccactntaccactctgcctcatttgggtgatattttcgactgaagatgccaagaaatacacgtaaagaaacattgtaggctgggtttgaaatgtgaaccataagctgtgtttcctgataattattttcaaggtccccagtagcactctccccttcctctgaagcctaagttggtccctttcgatgcctcagtttttgtctttgatcctccaaataatttcttgcaaaatgggamcctcactctgaaaagcacctctagtctctcttgagatgccggggttcatgccagccctttttccagttcaagttgtgtcatgcctttcaaacatgtgcaaaaagaaagtggctctgatggccagagccagggtggctcatcctcttcccagaattgaaaaaaacaaaaccaacaaaaaggaattaaatctcttcacatgaatagaggagaagctagcctaacccaaaagaatttttggttttaaagaggatttgccttcttttttgggatgagtgacatttaattcacttggccccattagaaagaagagaaaggagggcagtgcagctttagcttcgacatatttcacatttggagtggcttcggagcagccaagcactgggtcagtgtcccatttaagaacaactggaaaaaacaacatgttaaaaacgtgttaggcacagagagcatggaaaaacaattgtcaaagtattttagcatttagagtagcttagtggctactctaaaatactaacttctttttaagacttattgtgagattgaagctgattcctagatgttagatgcagttgatatgggaaacatttctaacatacagctgttgagacagagtgtcaggctctggaccatttataataacaaaaacaatagagtctgtgctgtttaccaccatactgctcgttgtttcactgccactttctccctgctcatttgactgccagctccttgagggcctaggtattacaggcactcatcaccgtatgcatgttgaagtgtcgtgaattcatcactgagtgcctagcaaatcccgacatacatatttgggtacagcatcacttcatctggatcttgggtgtagaaatagcaccatattctaaccctggaagaaactggctgcattgggcttactgaaagataatataatgtacacaaagcctagtggactgtatattcaaaagtttttcagtggtaatttttaccacactccacatttgccaaaactgattttggggagcagagcaaggtggcacgcatgtgtayacccagcctcgggaggctgaggcaggaggatcacttaagcccaactgttggagtccagcctgggcagcatctctttcaaacaaaagaaaactgagtttggaactgaatccctatggaagatgtaccccactgtaaatacttgtctaatgaaaaaatggatgaatacattccacttcctattaattattctagaattcactattcatgtggctgggcgtggtggctcatgcctgtcatcctagcactttgggaggccgaagcgggtggataacatgaggtcaagagttcaggaccagcctggccaacatggtgaaaccctgcctctactaaaaatacaaaaattcgtcaggtgtggtggcacacgcctataatcctagctactcaggaggttgaggcaggagaatcgcttgaacctgaggggcggaggttgcagtgaaccaagattgtgccacttcactccagcctggttgaaagagtgaaactccatctcagaaaaaaataagagtaataataattcaccattcataaagcgtctcatcttttctctacttctgattctcatcccatgtttttgtttgtgagaaaggagaaaagtgaaataaagactctaccaagtacatattttatacttgacatctggaaataatatcgtgaaatagactctcacattgttgtggagttccaacacaataaacttaaggtgatttatacatcttttatttattttattttattattatttttgagacagagttttgctctgccgcccacactggggtgcagtggtatgatcacggctcactgcagcctcgacctcccaggctgaagtaatcttccgcttcagcctcccaagaagctgggaccacaggcatataccaccacgcccgactcatattttgatttttttttttttagagataagatctccctatgttgcccaggctggccttgaactyctatgctcaagcaatcctcctgcctcagcctcccaaagtgctaggattacaggcgtgagccactgtgtctggactatacattttttaatagcattattgatcctggcatgagaggagaaaaaaaaatgctggtactaataataaaattgtttgcaacgcagccaaagttctttaatatggctcttggcccaaatcaaacaagcaacagaaactcccagtccttttttttttttccttcttatgttttcacaaaataggaaaaatgaggttaagcaagaattttgctcagtttgcagaggcaaagtgaggcttgccagggccgggtgctgttggggtgcgtgcagcatatgacggggtgtctctaacacagtgactgaactgttcaccttctgaagtgaggctcctgagtcacacctggggctgtcttgatgagtcaccagccttccaaagtggttttctctgggaagtggcacttcacagtgccacttttttttcccaccccagggacaaaactctggtaaatgaatccctgcaggaaccacgggtattacagtcctgatttggctcatctgctctttggggctgacagcagctttgcttgactcagcttctgcctgactgagtaggttcagacagaatgagtctgcagaaaagtcggtggtgctcagtgggaaggacgtgagggagatggatcaccacagctggccagggcagaggcactaggagacctttcacatggctgctgtgcctactgctgctaacttaaacaagtggaaacttcttggcaagtctgtgagggaagtcgaggattagagcctggtagttaaaaatacaatccctgccattcattcagaattccagagaatgctgaaattttttgaattggcaagtgaatggtagagaccggaaccatacactgaaataacttctctggtcttgtatcatcttttattagaggatcctaaaaaaatcccctatttatatatcagttattatttctgtgtcatagactgcagctatgtttgatgagctgcttaagtgaaaatctgaccggaaactttcaactataaattctttgtggtttcaaagaaggatgaactttctcatctaacacatttctgctgtgtgaagagtcacctttattatatggcatgagtctttttttttttttaatagctttggggtttaaactctgaatgctttgctaatagatgtgtcagctgtgcacattggcagcttgacttttacctctttgtatcttctattctgatgcattaaaaatagcaggagatggtgccgtttaggatttgggcagaatggaagaatcattataaccaataatagtgttttaaaagctgccttgggacaaagaattattaattagggtggtagaaagaatgacaacgtgggaggaagattgattagggtttctagaaatacagtaaaacctaagctatgtatctcttcaaccatgtgaagagctattactttatttctgattgtcaacatatcgaagttcaaaagccgactccacattatgcaaatagactgataacgttaagcagaggagatcaatgtactggatggctactaatcttaatattgtcgccaggcgcggtggctcacgcctataatcccagcactttgggagcctgaggcgggtggatggcctgaggtcaagagtttagatcagcctggccaatatggtgaaaccccatctctactaaaaatacaaaagttagccaggtgtggtggcacacgcctataatcccagctacttgggaggctaaaggaggagaattgcctgaaccggaaggcagaggctgcagggagctgagatcgcaccattgcactccagcctgggtgacaagagcgaaactccgtctcaaaaacaaacaaacaaacaaaaaacctaatcttagtattacaaacatgatcaggtcgggttgctagtttagatgtgggtggtgagctgagcatccactgcgatggggcttctactgtcatgggctccctctgtgatgtggcctcccttctgtgatgagctccctggggtttctcctgcaatgggctcccactgcaatgggcttccactgtgctcagctcccattgcattgtggttttaggtgacagcagagggactacctggagaaagtgtgcatctgggcctgggagaattagtaagtgtgcataccacccctgtctttgttcttgtggttaagactcatctctggtgttggttagcagagctaagtaccgttggcaaaacaaaaggtactactaaaagaaatgtaagatatgagtaagatatatgtcatttcctaggtcttgaaatctaaataagatcacactaatagaatgtttaatttgatttaaatgcaaacagtatttatccccaacatacaacgagaaagtaaaccaccttttgcatacttgtattctaattccagttgaggaaaattttaaaagtttaatataagtcttcggcaagactccttgccatctggtacaggattaaaaattggcatagcatttgttgtctactgacagtgggtcagatttacttggcaggccctatctgggaatttatcaacctcatccaaatctgtttcagtttccatttttaacactagtgggtctaattggactgagtcacaagaagcaagttgcaaagctgtttcatttagcaaattttaagctaattgtcttcagtatgtacatttgttttaacattaagaggatggtgaattggcctagtaaatcaaaaaagttttaaaaatctgattttctgaaataagacagtttgcttatacttaaatggggattgtaaatatcataggcttggcagctttttttcttttttgttttttaagagctagggtctttttatgttgcccaagctggtctccaactctggggctcaagcagtcctcccgcctcagcctcccaragtgctaagattacaggtgtgagccaccacacctggctagcattatctgtggaacatttcttctggaagagcttgtattctactggaagagaaaaaaggaggtagtaaggacagaggctacagaggaatttcactgaggggatgaagacagggagcagtgagtatgattgagttttaaaccagtctgccttggttttatgaccccaggctgtctttaaattctcatctcattggtgtggttctctttaactgctcagctaggttktggcaaaagaagaggcagtttggaggctgcttccaggtcccgtcctaaccactctgctgatggaggggagccctgatgtctgacactgtatgaaactctyatttattaaataaatggtgggcagaaaaaagacaaaacacttatgtttgaagacaaaatctttgcccatagaaataagcaacatgctgctaatagttttaaattctttcaaaatgaagcacttgtaatcattcctatttttatatctttgtatgcttccagcaatacaaaatacattacatgggattctctatttcagaaagtccttgttatacggcttccttcatcataaagttagtgtgggtaaattcatccaaaaacaccaggccttttcctgggtggtaagaagctggaggattctattttattttattttttttgagatggagtttcactcttgttgcccaggctggagtgcaataatggcgctctctcagctcactgcaacctccgcctccccggttcaagtgtttctcttgcctcwgcctcccgagtagcaccaccatgcctgtctaattttgtatttttagtagagacagggtttctccatgttsgccaggctagtctctaactcccgacctcaggtgatccayccgcctcggcctcccaaagtgctgggattacaggccactgtgcccggcctgattattctatttttacagataagatttttatctttgcctttactatgtttgcacaatgtttttgatttttacacctaaccagtacatcacccatcatgcataataggtatacgatctatggttgttgaaaaaacttgaaccaagtgttgccaaccttggaaggccagagctgccttctctgcactcactgctgagtgagtttgggaagccaggagaactggccatgaaatctgtaagtgactttggtggtcataatattcccagaacagacctgctttatcctcacagtgaggaaccagtatattgttagcttttttacccctgtctcatgcatatgggtagtgtgactaggatatccaattagatcacacagggtcagagctaatattaaacccgggcacccaggtatatgtgactccacaactgcgtgtggtctttgcagagcccacagagtctggcagtaggctgctgtgtctgggagatgcctatgtgagttgtgctgttatttcatgggccatggtgacccagggggacttggataccaggtgtccttgggatatgtgcctggaggtgagatagtgaatggattgtcaggcagagagggtggggggagggaaggaggaagggaggaaaaccagaaagattggcagaagggaagcccagaggccattgccctcatcaaggtgaaaggtcatgaaggaggtagaaggaggtagcagtggcttgagaggaggaaactggagcaaagttaacaccccctccgcaggctgatggggaggccagtctgaggggagggtgacttggagggtgggagtgccaccccaccaatttcaaaacattttaaccccaaacacacaatttacctgttaaataaaatggctttctacatttgcgtctttctggaggaaaatattaatccatgagggaaaactgatttcacacgacatggtttttcataacctaccatttccagccaaatatcttctcagagacgtggtgacctttcttgccccttagcaaactccatgcttttgtccaacctgggcagttctctaagcagagactcataatgtaattggaggccaggaattggttggtctttctgggactgagagaaggaggctgtctgggaagtagtggtccaaggggctcttgaaggaaggggaaaaagcccactcccgcttatatttgttacaggtaccgttaaccccacataccaccagggctctccatgggaagcacttgtagaggatttttcttttttttaagtcgaggaaaaaaatgtttactgtcaagaaaagcttttcttccccgtaggaactgctattctttttctttataaacagcatgggatcaggtgattgattccatttgtcccctgatttgagccacacgaagataggagccaaaastgtagtttatcttcaggaactctttttgtttgtttgtttgtttgttctttgagactgagtttctctcttgttgcccaggctggagtgcaatggtgcgatctcggctcaccacaatctccgcctcctgggttcaagcaattctcctgcctcagcctcctgagtagctgggattacaggcatgtgccaccacagccggctaattttgtatttttagtagagacagggcttctccatgttggtcaggctggtctcgaactcccaacctcaggtgatctgcccacctcggcctcccaaagtgctgcttataccttatgacctgtgtattcatgcatcaattttcttttttgtctttttgtaccttcattagtatttttgtttttactggttgtgaaaacaatacataatcactgctaaaaatctggaaagtacaaagcagtttagataagaaaaaaaaaattaccagtgagcctgttatttgcatatatcaccataaatagtttgatatgtttctttttccttttttgttccattttcaaatatgaaacctgtacagtgtatgtatttatacaatacacatatataggcaggttaaatatatttgtatatgtgtgtgcatttccaagggaagttatacttttaaaacagcagagagtttttcttgaagtagactaagcaagggagtgaagccaggaaggaggtgggagtagcggggaagtggggattaatctagctaaattgtgggtcctggcaaacactgagattacactgtgaaatacgagaaaggaaatgactcagtaacattgagagagggagcagagatgagacagcagagtgaaagagtgaatggcgtatcctgggtttgggaagtggtgggaagtagggggagctggagcctgaggcactaagtgattagaacaataggagaatttagttttcagatgaaatcatcaaggctgtattaagtgcctcttgtgagcaatagctcactcttacttgttgcattcagcctgggagccactcttgacaccatgttagcgcagccttacagctgatgtcaggtcgactggtctgcagagccaggaatttgggctttcttctcagagttgttttggagcaatgagaactgctcacttaagaaaggctccctcttgtactccagcctttggggaatgctgtgagtgacacttttaattaacaaatccactgggaacaaaactcctttaaatgtgttggctgggtgtggagtttgaagggtgggccgtggaggctcccactgcactgcaggagtgctgggacttcaagccatgggtaagctcggtcagaactgtcaggatgaggtccacccagaaggccccacactctgtcccaggggatttaggctggcaagctgtgctggcactcctggggcaagatgagctcatctgccacttcagatgctgggcttcctatgctagatgttcctgctcttgccgcattcaggagccacagcccacttgttcagaacgggaggggagagtgggggaygagcatttaggaatgcatcattccagctcctgtattattcctagagctggtagctgaaattctgaccacggaagtgtccttgaacatcttccagcaaatgatgtatatttccacatctcaccggggcctgtgctgatgttggttctagcacagcatcaatatccatgatgtcagagagtctaagaaaggtttatgaaagagagaaggattcttttccttctggtaccagagtgaaaactatttatgtagcacatgtctgccttggaaaacatgctgctttaatagaatgagttctgaaggaataatcaaagcatttcttaggtctaattattttgctaaagggagttacttaattttgacatcctcatcaattagttcctcacttggaaggcctgtgacaagcctgaggctggctatgagtttccacctgcccagaagttgatggattttatgaaagctttaaacagaactacaattgtgaaactgaaagtgtaaactaaaactattgtttttattattatttactttatacttagggaaatgattttcatctctttacttcagtatttccccatcttttttttttgggggggatggagtctcactctgctgcctaggctggagtgcagtggcatgatcccaactcactgcaacctccacctcccgggttcaagcgattctcctgtctcagcctcccgagtagctggggttacacgcgtgcatcaccatgccggctactttttatatttttaatagagctggggtttcaccatgttggccaggctggtctcgaactcttgacctgtggtgatccacccgcctcggcctcccaaagtgctgggattagaggcgtgagccaccgccccyggcctttttttttttttttttaatcacatttattctaaaaccttagacctttagacccaagttttcacgcaaggcaatggatgagttccccttgrcaataccttcaagtcttgcattaagaaatctgaataacaattttagcagaggaagcatttaaaaatgaggagacagactgaaaagaaaacaagacaaatacaacttcaatgcaaggaagtttctagactgattaaacataacgaaagtaaaagtggtttcctaccttaaagattcaaaggaggccattgttattcaaaagtgaggtgtgtttaacagaaacaacaatcatgctccttttgttgtatgtctaaggaaggtcaatggtgggggcctgactggaagagacccacctggttgtgaggcccaaaacaaagggctaacattcagtttcttctatcatgtttgttgtctttgatggatatggaaagatctctgatactgggctgggtgcggtggcttgtgcctgtaatcccagcactttgggagactgaggtgggaggatcacttgagctcaggagttcgagaccagcctgggcaacataaggagacacccacctctacaaaaaaawttttttaaaaaaaatgagccaggtgtggtcgcaggtgcctgtggtcccaggtactcagtaggccaaggtgggaagattgcttcagcccaggatgtcggggctgcaatgggccatgattatgccactgtactccagcctgggtaacagagcaagatcatgtctcgaaaaaacaaaaaagaaggagaaggaggagaaggaagatttctgatactgtttataaaacaaagtagaggaacgggatgaatctactcatcatatatatatatatatcacaaactttcactaaaggaagagtttgatggagtgggacagagtctctaaggtaccaggagtgacctgcaatgtgatttggaaggtggtaggcaaagctggaggccatgtccacctttcttagaatgtactggaaactctgagcagaagctcatgtttcatgttgggttagtttctctgtgattaagtcacagtaacaaactggaagttgtatgtgatcaaacatgtaatcatgtcttctcccttgtaaaccttcatgcctcaatatctaagtttctccataagctggcactagttgactttcctactattattttctaatactctgccttccagctaccctattgtcaccttgcttggtgacagtgagcttcttgagggttttatgtgtcacctttggggaccttgaaataccttacactcctactgtgagagctcactaatgtggtgttcagaagctggtttcatgggcccatcttttgcttgatgacagccaaagggatcctcattatgtcaattctatgagtcaggagagtatggggtactggctgggaaggtgagcatggctccccttccaggaaggagctcacactatggcactccagtgattggatggctgagaagcaactgaggtgctggggaatacaagctccacgggccgaggggaagttcactggggctcactgcatgcaagggctgtctggacagcgatgtcttgggcttgtgtttagagagctgcttgcagaatccccagtgtggcctaaccaggatgcagggaaaaataggcaagtatgtccttggatgaaaccaagcacaatctatcaaccactcaagcagatcctaagggaagaattagtgtcattaactattatgctgttgttggtgatgatgataatgatgctgacaattaaaaagataattaattgttttccttcttttagtcacatagaaaaaatcaccacatggcaagaccctaggaaggcgatgaatcagcctctgaatcatatgaacctccaccctgccgtcagttccacaccagtgcctcagaggtccatggcagtatcccagccaaatctcggtaagcctcaagcttttttaaaattaaaaaagatattttttttttgtagagttggggtctccctttgttgcccaggctggtgttgaactcgtgggctcaaacaatcctaacacctcagtctcccaaagtgctgcgataacaggcatgaaccactgtgcctggtggagccccaagctttgactccaagctgaagaaatggtgttcaatcaaggggtggcggggctcataagtggttctggctgtttctatgtctcttcatgcacccagacggtgtttgctccttcttcttggctgcaataccgtgttacccttctgccggctttttcttctttacttggtctctttaccaccaactcatgatactgctgcctcagttttaaactacagttctgaccttccctccaatggccttaattggggtagaaaaatcagttaggcctcctgtcttcatctagcctgaggcaagtaggacacatacacgctttgggtgactttggctcctggcgactgcctacaggtacaattctagtctcaaatccctatccttatttcccttttttcctttttttttcataattgctgcataacatgtgtcagatagcatgccaagtgcttccatgccttaccttatgaaagccttccaaaacccctgcaaaaagtagcaggctctccagtttatacatgaagaaactttccgaaagtcttgcagcttgtggagagcagagctggagagcaggctagtctgattttagaagggagttaaccattacataacctgcaggtggcttctccccatacctgccgtgggataatatggctcactttttacttcatttacaatacttaataagtgcgattttagacttgagaagagaatattttctgctaaaattatccccactagagataatcaccagtgaattaatacactgcagcaacggaaccagtcagcttttttggtaatcattcccttccttctcccccagggctaaaaataaaaaagggccaattttaaagttttagaaaagttggtgccattttcagataacatttccatttaagatcagatatccagatatgctttatacacagaacagttaattttagggagtgaaaagaatctcctgttggattttcaggaatgaacaagataaaaatggaagcgttattcctggacacccttccctcatactgtggcttagccaaagtgagtatgaactcaagtagaccctagtcagcttcaagtgtcagttcttccaggaagtctgaacctactgctttaaagcttgcagatgtacagtttccaaaaagcaaatgacatggaacaacctctgtggagttccttatctaaagggcagatcaaagaaaatgcaaccagttctggtaccagcagtggtaaaccaaagcctccagtgagttattttgtcccaaatatacaggagctcgtgtagaaatcagatgccactgtagtaaagagaccccaaattaggtggcattagactggtttttacagtttgtttaaccatttaattttcatcgaaaattctaaaaactgattattaaagttttaactttaactttgtaatcaattataatcggaaaaaaatctttcatgaacccagtttacaaaaaaaaaaagaaaagaaaaaaaaattcaaacacttcctccaatctccctttcctcagtccccaagtttgtttcctggagccaaccagtgtttctagttgtgtgtgtgtgtatgtttaatcatactaaggttagcatatcataaccactgttctgtatcttgcttttttcacctgcctgtccatacatatagagctgcttcattcttttaaaaatttgcctattagtctactatattaatatgctataattagtttatttaactaactcctatctggtagatatttaggttgttactagtgtgttgctagcatacaaatactggagtggatatcctttgtcatgttcttttatgcattctccttaatttttaaaatttgtgcgatatgtaggaagtggactaattaaaagaagcttgaatgcttggaactagatattgaaggcacatgtgagtctgcctgtatgtgcatacatgcatgcatatgcacacacacacacaaagtccaattgcactagtaaagtatatctaaagaagttgtaatctgaacattctgaaacaaatttacctgtagctcagtaaaataccttagtttccagatttctatttttatttaatttttgttattattattattattattattattattattattttgagaaagaggctcaccctgtcatccgggctggagtgcagtggcacgatctcagctcactgcaacctctgcctcctggttcaagcaattctcatgcctcagcttccccagtagctgggactatgtgcatgtatcatcacgcccagctaatttttgtatttttagtagagacgggatttcaccatgttggccaagttggtcccgaactcctgacccctggcgatccgcttgcctcagcctcccaaagcgctgggactacaggcgtgagacccggcacccagcagtttccagatttctaataaggcagtgaatttctcaagargcacattctggggtttttccaacaatatttgtgtatttgcccattgcaaagtgtgtttctagcttatggagaatcacagatgtgtctgaaggatggaaatacaacttggaatgccaagtaagttccaaagaccaggacttaatttagagagtctcaatacagtcagaataataaatgatttactcagactatttcatttcaagccataactctgcctgtggttcatagtctttattatatatctttaaacatataaaaataaaaagagcagagctgggtgtagaggtgcatccctgtagtcccagctacttggaaggctctgaggtgggaggatctcttgggcataggagtttgaggccagcctgggcaacatagtgagacccccaactcttaaaaactagaaaaagaaaagagcagattcttctcctcccactcttccttcttcttaaatctagaactttggtacttttcaatggaatgtagctgtcaaataagtgaactaaagtgataggtcttctttaatgcaaggcatttatatacatgtgaaaaggatgtcaaaatacagttaatagcattactatcagatgatagaatagtaccttttataactaattttatttatttctagagccgtgatataatcagtggcatagttaactacattcagaaacaaatcttgtatttggtccctgtatgtttctgtaggttaggtacatggacttgggtgtctgactgccagaatttgaatcctggctctgtagttactagtttggtgacccttaagttatttgtctgtgcttygatttcatcatatgtacaatggggattattaatatatgaggaacttacgagtttatatatgcaaagtgcttagaactatgattgccacatagtaagctaaaatatatgtttattatcattatttttatggcaaaaaatattttatattttatttaactatagcatgttatattttaagacaatttaactgttctttataagtgctttctagaataaaaatgatttattttgggctggttagattgcaaagtgttttaaattaggaacaatgtattcattaccttcagtgaggatagtgccctctggtggaaatgtttaagttacctctcccaggagaaacttcttatcactagacaccttatttttyataagagctttagatgccgggcgcggtggctcacacctgtaatcccagcactttgggagaccgaggtgggaggatcacgaggtcaggagatcgagaccatgatggctaacacggtgaaaccccgtctctactaaaaatgcaaaaaattagctgggtgtggtggcgggcgcctgtagtcccagctgctcgggaggctgaggcaggagaatggcgtgaacccgggaggcggagcttgcagtgagccgagattgcgccactgcactccagcctgggcgacagagcgagactccgtctcaacaacaaaaacaacaacaaaaagagctttagatgtattcctgtaatgcgacttgtaaatcaaaccatatttttattgcaagaggaaagacccattacttagtcatcctggagtgagtgactttgtaaaaacagaggattctttctgcaggttggcagatttgttgaacactgagtctaagtaaaatgaaataagctctgaaggggaaaattgcaaaaatatggttttttttttkttttttttttttttttttttttttttgcactttaattcaaatagccatctccagtttggtctagcttaaaactaaaattttagtttttgtatttgccaaatcaggctttaccaatttggattctgtctgagcagagtaatggcctttaagcctgaattcccagacatatgcaataaatggaagaagaaaagacgaccttgggggactttagacttggctcactgcaacctccacctcccaggttcaagcaattatcctgcctcagcctctggagtagctgggattacaggcgcccgccaccacacccagctaatttttgtatttttagtagagatggggtttcaccatgttggccagggtggtctcgaactcctgacctcaggcaatccgcccatctcagcctcccaaagtgctgggattacaggcgtgagccactgcacccagccagaagtttgtatgttttaagtaggttgtgggccttccttactattaatacttactaaaattttaaaaaagagaataagagggaaacaaaagagggaaaaaaatagactgcctacacaggctctgttataatgtataaaacaatgggcttgagaaaatgaagcctgctgcagatcttagtccttggttagagtggtggcgaagtgggcatggaagtgggatggagggtggggactgttttggaagaacttgaagtcagaactgagtttctcttaatttagacgtttatgtattgggttatttaacctctgagtctcattttccttatctgtaaaatggtgataatgatagtacctatctgrtaacgttgttttgagtatttaggtagtccatgtcttggtacctgatgtatagtaagctgccagcacttgtattgttatagctattattgttagccagttgcctcatttttcctcccctttctggctcctgtgtaatcagaggaagatcctttgatatgctctgttagaaagccattccattcctccttcaggaagacccaaccatggttactgcaacttatatttgtttgggcacttttgcttacaaattgtgaaactagctggtgtggtaccaaaaaataacatttaacctcggacagcaattgtgagaagatgaagaggagcaagcttgtgactgtcaggtcattcacagagggagtttgtgaagagcagtcacacttctgagttctaagtgaagaacattttcccctctgcaagtagtgaagtgttagattttcccattcctcagcagacaaatactgaaaacatgcaacaacttaaagtagctccatattttaaaatgtttttaccaaaagaaagtgtcatgcttttttcctttctttttttttttgcctttttggtgataatcctagtgatcataaaccatggtgtgctgagctgctgtcacacactaatgaggctttttgttggaatgagaccctgacctgagatgctagtatccttcctgacagtacaggaaaaaataaagactataacaacttcaccagcctgcgaaccctagccaattcagaaacttttggtaaagtgcaactagagtgtattttcaatactataggaaatttttaaagttacatatacacacatgcacacacacgcacttacttacccctttgaagatgtgccatccaccagcccagagtctaagtcctccaggtctgtgtctcgagctgtacttcaaattataaacacatgtgtgtttttttttttttttcttttcagggcatacttttcaagacaagatggaaaatcttgtctgtgctcagtttgctaagttggcttgctgttctctctaggaagtatacaaagaggcttagcattgtatcaagagcaaataaaatagctaagggatatcgaagccctgggttgcttaaagcacttagaaagacatgctgaaagttcactagaagtcagatttctacttaggcatcttatgttttcctttttttccattagtttttttcttaatcaaatttacatggtgagttcacggcagacacatctggctactgtgatttttccagctctgatgttctcactgcttttggaactttgtggtttatgcagcatagattagcctaaagtgcaccggcacatacacgcacaaacccagagacaaacaaacaaaaaaatacccatacactttttgggagatggtggaagtgaagtgttgggtgttgtgggtgttgtaggtgttgtaggattgttgtggtggaaagtttgtgtttatggaagaaaaggaacactggtgggcacaggacagggggaaaggtttctatttaaaaatgattttcttgattaaaaaaaagaaggaaaagttttctaaacactgtagaaaatcaattttctttttattttgtagagattggggcgtctcaccatgttgcttaggctggtctcgaactcttagtctcaagtgatcctcccaccttggcctcccaaaatgctgggattacaggtgtgagccactgtgccctcaattttcttagattttgaggaagctatctattgtcaaatacactctagttaatcagcattattgaaggctaccttctttggggtttcgaagaggagattcttttttttttttttttttttgagacagagtttcgctcttgttgctcaggctggagtgcaatggcacaatctcagctcaccgcaacctccacctccccacaacctccacctcccgggttcaagcaattctcctgcctcagcctcccaagtagctgggattacaggcatgtgccaccatgcctggctaattttgtatttttagtagagacggggtttctctgtgttggtcaggctggtctcaaactcctgacctcaggtgatccgcccacctcagcctcccaaagtgctgggattacaggcacgagcacccggcctgaaaaggacattctttatagttcctttcttttacggtttttaaggaatatgtgaaatgagactgaaaaaaattaccaaatcaacggattgagttccttttatgtaataaagcaggacataatagcatataaaaaataaatcttatgttttcatggctatgttccacttatcttaatgtggatgagtctttattaagattaggtgatggagacttataggttttattatatgaaatttagaaatttaggtagaaaatttcttctttgataagaaataataaaagccatgaaaaatgtctgatgccacaattttccttaaaaaaaaaaagtagtatgctaggtgaatattttgggaaccatacacaaagatgtgttagttataatagccagtaaataaacaaatgcctgaaatatgaaaataaataaatttatttatttatttattttctgagatgcaatcttggtccgttgccctggctggagcgcagtggtgtgatctcggctcactgcaacctctgcctcccaggttcaagccatcctcccagctcagcccccgagtatctgggattataggtgcccaccaccacacccagccaatttttgtactttttagtagaggtaggttttcaccacgttggccaggtgagtctcaaacacctaacctcaagtgacccacctgcctcagcttcccaaagtaagtgctgggattacaggcttgagccactgcgcctagccacaaatatatttataagcagtgaaataatggatatagaccatgtagacacatggaaaactttgttgtaacattctaattttacacagcatgacaaattgtttatgctataattatacttctatttttttgaaaaacacattgcttagattctttccattttttcacaagactaagcttcttgaggacaggaacttgatctccatctgtgtatttctagccccaagcaaagctcattaggcatcataggtgtactcttctgtagaataaatgtgttgagtaagtcagttatgtatttttaaatgttaatagtgattatagttaagcctttgagttaagggtgattccctctattttctctgtaatgcggttatattacttttgtaatagccaaaaggagaaaaaaaaaaaaaaagagtgagaacaacaggggagaaccttgagctttttgtggtggaagaggagaacagtgtgttggaaaaaaggctccaggccccatgtgtattaaagacaaaaccaagaatgctcaggcctctgcagttgagcaagtctgcctgtggcaaatagattattcactagtctctaagatcagtgtttatccaagcgtggtccagatctaccactagctggatcacttgggggcatttgttaaacatacatttttagaatacagtggtttgtttgctcccaaaagaattatcctgggctgctgctaggaggaatatgccctggaaatttctgtgtcagtaaatgtagggtggaatctggaaaggtatgctgttttcgagtgctcagatgactctgatcatcagccaggtgtgggagccacaatcaaattgtgtatgttaaggccaagtgcagtgtctcacacctgtaatcccagcgctttgggaggccaaggcgggcagatcacctgaggtcaggagtttgagaccagcctggccaacatggcgaaaccccgtctccaccaaaaacacaaaaaaattagccaggtgtggtggcacacacctgtagtcccagctacttgggaggctcaggaaggagaatcgcttgaacccaggaggtggaggttgcagtgagccaagatggagctgctgcactgcagcctgggtgacagagccagactccgcctcaaagcaaagcaaaacaaaacaaaacaaaaaaagaattgtgtacgttagcacagtgatgggaaaatgccagtataataaaaatacaagaacctactcaatcgttcagtctttaatttatctgaaaaggacttggagtatgcccaccaactttttaactgattctttgtctgaaatagacatttactagggcattgacttttgtcattttggtgcttggtgttagtgcgcacatgagcattgggtaagtgaatgctgaagcggcttcccagagcatcttgaccccaaatattccaagtaaacttcaaaaatgaggaggaaaattatagcttgggatccagattcttgaaatgtattgtttaatccactgggtaaatgtacaagtctgcttcagttttgcttgcagagagtgggcctgagaatccatcaggccttcgtaagcctaaaccgtgacgaattccagagaagcacccccacacctggggaagagggaggccttttaggaaggtgaaggctaggtcaaacttgttttcttttttagtcctttctttgtttgcaccacattaattaattagttaattaattaatttgtaatggagtctaatttcttcaccgagctgtagacctctgttgagagttttaaaaataattttgacaattttcatcctgtttgctggctgacttccaaaagtttgccctcaggagcttccttgctatggagaatttcacccagttaagggtgaaaggcaggcagtgggattcgaggtggtttgtcattcagccacttgttccaaattgataagtgctgagtgatattttgacacttctctttgatctcctctttggcgtccctggtaatattgctcccgcctgtgtgtgatcatcacctctcccacccaggtaccaactgattgatttcttcttcctttctggaagtctaaatttattccctgggtgttttgcagttgctggtggtcaagaacagctgttcttccatgctttattctgaatagttctccaggatgaagtcagcaaaacaatatcatttaagtgaagcctcaggaaaacaaaagccttgattgtctttctccttaagtgctaaaaagaagatcacccctccccctttgtgtgtgtgtgtgtgtgtgtgtgtgtgtgtgtgtgtgtgtgtgtctgtattttaaggcagaaaaaaaaaaggttctaaacatttttgaagcagcaagattcaagaatgttatttttttccatattacataattgctatttggtcactgtagaaaatgctgattggcaaaacatgagaaaataaaaagccatggtaccattcaaaatgacactagtgtgttttcatatattttcttgactttcttcaatgcaaacataaaaatagttggaaactcctctatattcttttttgtagcttgtttttaatataccatgagcatcttcccatttcagtaatttttttttttttttgagacagaatctcgttctgtcgcccaggctggagtgcagtggcaagacctcggctcactgcaacctctgcctcccaggttcaagccattctcctgcttcagcctcctgagtagctgggactacaggcacacgccaccatgcccggctaatttttgtatttttagtagagacagggtttcaccatgttggcgaggccggtcttgaactcctgacctcaggtgatccgcccgcctcggcccccaaagtgttgggattacaggtgtaagcaactgcgcctggccagtaaatatttttctataatattttttgatgagttgttttaattagaaaagtaacacacgcatatggcaaaaaatccaaatagttccaaagggtatttatgaaaaattaggtctccttcccaccatgacccccagcccttttctcctttccagggaaacactactaccagcttcctgagcattattctagacatgctctacatacacatgcatgcttgggcatatacagtatgtctttttaaaacttaacatatcttagagagccttccaaattagtacttactgatttgttcattgtttgtcagcaatatgtaatgttccactccgttgagatacngtacttggtttaaccagtcctgtgtgctggatatttagtttattttctggttggtcactattactaaacaatgccacagtgtgcagccttggacataaatccttgtgccatatgctgtttatgtataggataattttgcagaagtggaattcctggatcaaagagtatgtacatttaaagtttttaaaactgttgttccatttctttccaaaaaggtataccaattgacacccctaccaataaagtgtgttttcttccccgtaccctggccaataatatctatgattaaacttatagcctttactattctgatagctacaaactagattctcagtatgttctttttttttaacttatgaatagacttggacatacttcttttgttcataaaccatcacatcatgttaatggctgcacagtagtccttttgtgaatttatttaaccaataatgccataatttatttaaccaattcttctattgagagacatataggttgattctattttttatcattataaatgatgtttcaatacattttcttgcacacacatacatttttgtgcccacctttaatttcctcacttttccagtttctttggaatgtttctgaataaaatataaacatttcttaaaaaatacaattttgacatggtttgcttttatcaaactaaggaattgtctaaagatcctggagcaggggattttttgcgggggggggtgttactttcttttaaaaaataatgtaacattaccacaaaaagtgtatttttaaccagccacctagctttcccactaactctgtttttcagcttgtatatccatatgtttttgactaagccataaatggaagtttcgttggaagttattttgcttcccagtacatgtcatgcatttcattccatattattttcgtccttttccttttcagtattatatttctcagataccagtgaagagtgagttgtgagttttgaattttgccaagacttaaatatttgcagcgctggaaagaaagaaagttaaaaaaaaattaatgtggctgatttagtcttggttcacaaggccttcatttagctgcttcaaagctcacacttcaaatgtcaagaaaaatattctcttaatttctsccgtatcaactgctgtaatgcctgaattaattagratggaactataatttctctccaaatggaattggatcatcccatcctaacaaaacaaatgctcagggcggctccatgctggaggtttctggacaccttccctatatcatttctgcctgggtcactgcagcctagggctgccccttgggagacttctcttctgggatcctcagcatgtcttctttgcttgtgctttctcctctcctctgtgtctcctctagttttaagtacacattatatttttcctgcaatttgagggaatctcagtgtcgaaactacgatatattaaaatcagatggctttcgcctgaggcattccctatttcatatgtttgcattcactggtgccttctccatcctccactcttagcttgctcatttttcctcctatcaagaagacctaaatggagcaatgtctcagctctgaccctgggatgtaaggacctttcacaacagatctcaagcttgacagtcaactctcttggtgtcccaggtccttcccaagaaaacctgcaatttcctattctggntgtctggtcctcaggggcagctatccagtggcgtttcttctgaaagacctccaaccggtctgttggggtagctctttgtcctgtcttcctaggctgtctatgttttaaaattagaatcatttaacagttggggttggggatagaggtgggaggctggaaggaactatgagtatgaggtatcagaattatgtagcacagattgcagctgggattctgttccatccaaattccaatcagttatcaaaagcattgtttaataggagtttcctcaaagwtcaacagtgccacagaacaatggcccatacataacacagtttctctggtccctgccggactgagaattctgtctccaggaggtttgaggtatgtgtagagaggttttatttttttaaatgtcactatttattttgaaagaattgtaaacttacagaagagtttcaagtttagtctaaggaattcccatataccttttccccagatctgcctttgttaattgtttgcttataaacatagccacggttgcatctatccatctatccatctatctatctatctacatatttttttttctgaaccatttgagacaaagttggagacatcattctcctttacccagaaatacttatattttctcaaaagactttttctttttttcttttttcttttcttttcttttttttttttttttttttgagatggagtcttgctctgttgcccaggctggagtgcagtggcatgatctcgtctcattgaaacctccatctcctgggttcaagcaattcccctgctgcagcctcccaagtagctgggactacaggtgtgtgccactacgcctggcaaatttttgtatttttagtagagatggggtttccccatgttggccaggctggtctggaactcctaacctcaggtgatctgcctgccttggcctcccaaagtgctgggaatacaggcgtgagccaccgtgcccagctggacattttcttatataagcacagtgtaggtatcaaaatcaggaaatttaacattgatacaatactcttatctaatagcccagattcgaaatgtcttcagttgtcccggtgaygtcctttgtggctatttttgtttctggcccaggatgtgattgaggatctcacattgcatttagttgtcctgtttccataatctcttctaatttggaacaagtcttcggtccttgtgttctggaccttgacatttttgaggaatatataggccagttattttgtgaatcatttttaaatttggatttgtccggcatttcttcgtgattttggtttaggttataaatttttggcaggaataccatggaagtgatgttgtgttcttctcattgaatcctatcaggaggcacacgatttgttccactataggtgacattagctttgatcacttgatgaaggtagtgtctatggaaggtggggtgggggcagcagagcatgcttgtgccaaatggctcctctaatgaatatgttctgtaaagctaatgaaatatgtggaaaggctttttggtctaccaggtctctataaggtatggcctaaaatcatgtaaactcttcccctcgggatgactaacaagtaaaatttccaacctgctcagttaagcttcacagaacattatttatttgacacataatatatctgtgcagctatatacacacaggtaggttttttttttaatttatttacaaaaggtaggctatgtttattagagtcacaagcagttgactgtctcagtgtgactcaagaccacaaaaaacccatttctccttcacttcattctgagtcctagactggcaggtgtactgcttggggcccattcacaggtttacaagtttctcattgagggcaatctgtgactgacacacgagtagttttaaaatgaaattatgatgcttccattcatttgttccctactcttgcatcttaaaaaacatataattcttttttttttttttttttgagatggagccttgctctgtcacccaggttggagtgcaatggcgtgatctccgctcactgcaacatccacctccctggtccaagtgattctcgtgcctcagcctccccagtagcagagactacaggcacacaccgccacgcttgtctaatttttgtatttttagtagagatggggtttcaccatgttggccaggctggtcttgaactcctgacctcaggtgatcctcccgcctcagcctcccaaagtgttgggattacaggggtgagccactgtgcctggccaaaacatgtaattcaaaaggataaaaataaataattgaattaagttggggtaaaggactgtggctgagaaaaaaagccagggaaaaaatgcataccatggggccttgtgtggttgctagaggtacctacagatttggctgtgagattcctgggggatcttgtaaagaagataatatgctctgttataggagtcagatcactcaagagataaaggctttcatggtgttgaagagaaatgtagtttttctagacacagagatgtaagagggagttctcctgtacttccccgtaagtcatctagactctgtgatctaggggacaatgtccttaaaaaagaaattacagtagtggcctggcacagtggctcacgcctgtaatcccagcactttgggaggcccaggcgggcggatcagctgaggtcaggcgttcgagatcagcctggccaatatggtgaaatcccatctctattaaaaaatacaaaaattagctgggcgtggtggtgggcgcctgtaatctcaactacttgggaggctgaggtaagagaatcgcttgaatcagggaggcggaggttgcagtgagctgagaccgtgccattgcactccagcctgggtgacagagtgaaactctgtctcaaaaaaaaaaaaaaaaaaaaaaaaaaagaagattccagtagggaacactaggagttttatggggaagttttctatagtctttttaaatactgggtagtggcatgatctcagagcaccagccagtgttcacagaagaccaaaatgagtgyatactacatatgcattttgattcaaggataacatttagaaaatccagaactgtagtttttttgttgtatgttttgttttcatttttaagaaggaagctccttttgacacaccttctcaaataaaatttagagctacaggcttttattttgttttgcttgggatcagaatctcctctttgtaagtgtttaaaagcagagctgctttggtttctgtctgttcccccatccttgccccaaaccttattcctttccttcccaaagatcctgaaccactttacagggctgagagacaacaaaccgagaggcattgatcccaaggagtggcctctttccttcatggtttgtttgtttgtttgtttttgagacggcatctcactctgtctcccaggctggagtgcagtggcgcgatctcggctcactgcaacctccaccttccgggttcaagcaattctcccgcctcagcttcccaagtagctgggactacaggcgygtgccaccacacccagctaatttttgtaattttagtagagacggggtttcactatgttggcaaggctggtctggaactcctgaccttgtgatctgcccacctcggcctcccaaagtgctgggattacaggcatgagcccctgcacccggcctgcttcacactttttgactcacttcactgtgtgcccccagagtctctggatttcttcagaattttaaattttaccatagagtgtgaaataatctggcagtttcccatgcagtccaggcagtcagctggaaggagatttctatcagtctggaatagaggccaaccacagtgctcaccacaggcaagaggcctcaagggacctggtcccggcccctcaccctctgctcctcagccacatgggctgctctgattttgcacaagtactccaagctcacagtttccaccttaggatctttgtacttgtcccccaccctgatttccatacttcattcagatttagagcacacatcactgcttcacagaggcctttcttaacttccctgcctaaaatagctccacatttctttgttcaaatcccttatcactaaaattattctgtacatttgttatagcctgtcttttcgttagacgataatctcctacagggcagggaccttgctgtcttgttcatcattgtatctctacttcctagaaacaggggaaatgaatagctaggtgaaccgtagatcattggaaagaaaaaaaatcatctatagttctataagcgaaacaccaccactgttaatattctaatactttttcatttcaaaggtaattaactttttgggggtcactagaaatcctataagatatatgggtacagtcctcaatgaaatgcatatttatacaggtttccaaaatttggcatatacttctaccagatttcctaatcctgttacccctggttacattcttctttcgttttttttttttttcctgagtggtcctggcccaatgcaaagcacctaaaccacactattgtttttgcttatttgattgctgaaaaaggctgtttctttaatttgcattagtgtgattccttacgaagctgataatttgccatattttattactaattgcatgttctcttttatgaatcgttcaagtcttttgactacctcttggaatcttagtatctgttacatgatctccataataaagatgtttactaaaagggcatgctattaaaaaacacatgcacacattaaaaactagcaactcacgctggcaacttttcttccattccgtgtggaacacagctgtagattcgttttctcttagcttgggcaactgccatacttcgcacctggagtagttttaaaatgattcaggaaagctaaccaataaaaagctacaataaactctctactgactaaagaaaaataaatgcatgaatcagagtttccatttcctgctggataaaagtatacctattgtctgaagataacaaaacagttgtagttgtactgctattgcccaaccatggaattatattcaaaatcacaaggacaactttgtgaagcagcaaagtgaataactaaatttcctctttttcacaggctagataattgtttttctaaattcactaactccatagaggtgcttcctgccacgggccacttgtgataaatcttgagatatccctgcaatcaaatggagtcagagtagcacattctgatgctgctttaggtggaagaaagagttctttctttacaggaaaaaggatccagaagaaatcagcctgccagaaagatgtgatttttttttttccctagacttccctggatatattataatgatgagaactaatgtctgaatcctttaaatgccaataaaatatacatttggggtaatgcagttattatgaaaatataaaagccagtgttacaggcatttctattttacacctgaaaaaggagagttgcctagatacttgcacactggtgtgtggactacattattgtttggatgggcaggcaggatagcaagtaggaaaatcatttcctggtgctaaaaattcagggtttcctgtgaagtaaacgaagcttgggttacaagtctaaaactagacaggcttggggcatctggaggaccggaggcccatctggcaagctttggggcacctggaagtggttttaaggcttgaaacagtgaagctgggaaagtgtggctgaatcaacatatattccagagctctgtgccttatcaactgagccggctgagaaatttccttgcagttattctcacccagaattggaataaagggctcagtgtgaagttgggatagtacaacttctcggtttaatactttacagatttttggaaccaaatgcaccctgaagtgaaaagctgctttttttttgctgaccttgttggatggctaatactgtttctgggaaataagagaaacaagcggctcattgttggcaggagctgagagagacacaaggagggcgagagacgcgtctgcagccctttttttcccttcattgtatcgtgactgagtcaaggctggattgtggctgggtttttcttcctacctctgtagacatatgttttccatcagacagggctgcgtgacacctgacgttggccagttcacatgagttaagccatggacggcgcataaacagaggaaaagacccgcagctgcacccagacactcttgatgctgaaatatttttcaaagcttgatgtggctgggtctgcacataagtcagaaacgatttacacctgtatgttttggcttgcttctttcagttgcatatcattattcccacaaagcctctatggccagaaggtctaccattggctgatggcagcacctctccttcccatatataagcctttctaaattatgaaatgtgagttttcaaagtttatttgatttttgtcttttttttttggaggattgaagaacaaaatgctctaccatttctataaagtgaggtcacacaaatggtgtcatcaaaacatgcgattcacgttgatcccatcattttaaagtaaataagttaattaaaatagtctgttagactttttcatgaaatagggaaaaggaaacactacttggcctcatcaccaaatttaacttatcacgtatattttgatgactacgaaaaaggattgggcagtgattggtgatccgttggtgatcattgggcagtaattggtgatccatgcagctgatgccagctgtagtattctagcaggcgttccgggtttcctaggtttgtcgcagcctgttcctgagatctgggctgaggcatttaatcttccaatattcttcatctctaaaataastgaattagtctaaatcattggttttaaagtctgtcccaaagtcccatgctagaatctcagggggatgtgagcagaagctaaccttagtgttcagtttccaaaagctgggccctgttcantgtgttttaaacatttgtttaaagtttcagcatgacacttgagaaatgcctgaagggaaagcagagtgaaagcaagaccaagatgatttagagaagacagtcaaaggtgctgactttaagtgctaatttcctcagctgatgaaagaaccctgggacataaggatagcctctgcttcaagccgtacacttggctctggagaaggattctactactaaagaaaagtttgagaaccattgctctaaatggactaagacccttctatcctgaatttctatggtgatagcacaaactcgggtaaatacatggccctcacctataatgagtgctgtggggaaagtgatgagtttgtaaatcatgtgtgaaactcagaatgaaatggggctaagcaggcaactatgctctggaagtaagaggaagcagcaactagaatgtggtaccctttggatattcccctatgaaactctagaggtaagggttaaaatgcatcctctagagaagatgagttatgggtgaggcgttgccagtttttttctcagttctcatcttgattatgtttctatttgaaatttaaaaagcctatgatgatcatcttgctataaatggaactgatattttgttaccaatttctaacctcccttaaccttactttggggagaatgtatttagtgcctactctgtgccttaatcagatttgaaatgcactaaaattatttttgttccatttttgtaagaaaggaagatccatatcattgtgattggtcctgaggggtagggggagactttgctctttcccaggtcttgtttataaagagcacaagtccaggaacatgagagttagttcaaatcacaggaagagaatagttcaatgtttcttaaaagagctttacttcagatgtatggctcaaccaggagtccaacaggaaaggttttcctgacttttgcatttaaccaagtgcatgtttatgggtgatataatgcagtcataaaataaatgtcataaatagtgcttgatttccttcaaaaattacagacaaaatgagtatgtaatattcccattccaattatcacataatatggatacaaaaggacaaccaccaatttttaatccaaggaggacacactgacagctaatctggatagcctgacagttctgaataatgaaaggtcattttgtactggctcctggttctctttttaagggaaggcattagggtggaaataggaaatttgagttctgctgccctgagttagccctaggtctatggatggccataggcctggagtgaaaaaccatcccatttgcctgggactttcccagatttagcactgtgacctgtgttctgggaaacccctcagtcccaggcaaaccaggataattggtcaccctctgtgacagagaagaagagaatgaggtgattgtaaagctttgcattctaacttttggaagcttttatgctcccctctcatgttgggtttaggttcctggaaagtgtttctgatgaagtttatatgaacttactggcccaaatatcaaactgaattaaacacttgttccaaggaggaagtttcccagatgccatatcaagtgtattacccagtgtatgcctttgaatgttgcatatttacctattttgaagagactgcattcaagttttaaaaacaatgtcagcctctacctgttctactctttttttttttggagacgaagtttcactcttgctgcccaggctggagagcaatggcgtggtcttggctcaccgcaacctcctgcctcctgggttcaaacgattctcctgccgcagactcccgagtagctgggattaaaggcatgcaccactatgcccagctaattttgtatttttaatagagatggggtttctccatgtyggtcaggctggtctcaaactcccgacctcaggtgatttgcccgcctcagcctcccaaagtgctgggattactgcctgagccaccgtgccggctttacctgttctactcttaaaggatgatgttagaagtgttatttggaatagttgatgtggttttattatagaagcaagctttttaaagaaaaaaaaaaactaaaagatagataatttggaatatatgtaactgaagttaatttagcaaggctttgctaactacctgtgaaaactgatacggaagttaagccatctttgaaattttctttttaaatcatcacgtgcttatggaaaatgtcagcagatattcaagcagtcttttataacccttgcttttcctgtattttgttttgctttgtttttctattactctgtatcttgaacagcagtccctcattctaggcacatgaaactgctttgttcaacattccctgtccgcttttttcccttctctggctccgtgtcctaaacagcttctttaattaattttaaagagctaagcacacagtagggacttaatataatattcattcatatttaatttataattcagtactctgccaagacatccactgagttacagtggaccagcatttcctagtattcctatccagaagaatatcagccttgcaagtttgagaaacgagttgttgaattcatatatctctttcagaaagtcttggtaccccctattactctaaagactgacaaatcttccaataaaataaattattttaactttctttagcccaacatttcccagtcttattagaccagggaacacttctagaagcaatttaaaaarttttagcttaatatctatttattcccctgggacacattatagaccagattttctcttaaagattgtgtccatttktacataccccaaccattgactattaaattaatattgactattaaaaagagagtagccagcaaagttcctggtattcactgggcacgttaaaatttgctgtttttcaaaccagttttagttttatattaaaattgagaagagagttcctatacactcactcacccagtttcccctgttgttagtgtattacattaatatgctacatttgttataattagtgagccagttattattaaatccatactttattcagatttctttagtttttatctaatatctttttctgttccagagtcccatacagaataccaaattacctttttgttttgttttgttttgttttttgttttttgtttttttgagacaaggtttcactctgttgcccaggctggagtgcaatagtatgattatggctcattgtagtctcttcctcctgggctcaagtgatcctcctgccccagcctcccaagtagctgggaccacgaatgcatgccaccatgcccagctaatttttaaaattttttgtagagacagggtctcactatgttgcctaggttggtcttgaactcctggcttccagtgattctcctgcctcggcctcccaaagtgctggcattacaggcgtgagccatggcgctcagcccccattacctttactcatcatatctccttaggctccttttggctgtgacagtttcttaaactttccttgtttttgatgacctcaatagttttaaggagtgttgctttcgtattttgtaagatgcctttctattgaaatttgtctgatatttttctcttaggtagactggagttataggtttttggaggaagactacagatataaagtgttattctaattacatcacatcaagggtgcacaccattatcatgacttgtcactgttaatgttgaccttgatcacctggccaaggtagtatcttccaagtttttgcacagtaatgttgccccccaactcccatcagccaccactcattcaatcctgtgttctttggaatgaactcactatttgcagttatgttgcctcccatccccccggcctttgagcatggtgtgtctacataaatgattttgaattcctctgtaagggagatttgtctctccttcatccatttatttgtttaattatctgttcatatgaatatggatttgtggaaattacatttttagtaaactaatgaaccacagtctacagcctgtgaaaactccctattattgttggaaccgaagtactgttaggaaataggtgctggggatggaaaaagtcatggagggcttggggaggccttacccattcacttaaatggaattgtgcctctgacacattaacaaaaccacatattctaaaaaattcacctcaaagtgccaagagtagagatacctccactgagaagtttgttgtcgaaaggagagaggagggagatacaacaagaaacgcatactagccgaagatattcttcttcaccttccaagactcacatgtgaactgaggagaaggatttgaagggagccaagtaatttctgtgtcttcctagcacttaggtgtgacttctagccactgggcgccagctgttctttccatgatctactcagagccagccccttgcaggcctgtccgctatggttttcgtagttgagcctacccttatggttttgttttcttcacttggcattgtatatgtgtatgtgtgtaactaaaacctattttaaaaatgagggaagcaagcccaggacatagaagagcaagccactgaaacctgccgaggccaaaaagacgtttgtgaaacattccaggaggtgctctgggcagcctctgattcactggcctccctcatcgtctgcagctcctggcttagggaagctgccaaaagcactttctctacgagctgtggctctctgtttcctggtgttgcaaaaggcaaaagttcaggattgaagcctttaccttttccatgtttgcttcttatatagcaaatcttgtgctggcttagaattgagtccgggcgactttcttgccttgagcatacacttagagctttgtagaaatgaccaagtgtatattgccccaggcagcactaaccagagggtcatgtcctacgtaaataaccccaccccccgccccattcccgtgttgactgtttgcttcaccaaggacacagtcattgaatcaaaagtgtgtttgtatctcagatgccttggcactggcggttttgtgtgtgtgtgtgtgtgtgtgattttttcctttatattgaataatgccaattaaatgtttctggtcacacatctgcagagcatggttttatcaatttccaaacacagaagagaaagccaattattaaaaaaaaaaaaaagaaaaagggaaaaggagatgaaaacaatgaaaaagaaaaagataaatgggaatctaaatttaaattctgactctcttggaaggaaaaacaaaaaagatgtccctgctttagctttgatgcattcctgcttctatggagaaatcttctgtttgggttattcctttctggggggactggcaacggtctagagctgacgaggtctttagcctttttgaggcagtttgtggcagtctgcccttaatccggcttggcctcagatactgcatttggaatactctgccttttcttttctttttttttaagctggagtttcgctcttgttgctcaggctggagtgcaatggcgtgatctcgggtgactgcaacctccacgtcccrggttcaagccattctccctcctcagcctyccgagtagctgggattataggcacctgccaacaagcccagataattttttgtatttttagtagagacggggttttactgtgttggccaggctggtctcgaactcctgacctcaggcaatccatctgcctcgacctcccaaagtgctgggattacagacgtaagccacctcgcctagctctttttttttttttttttaatggaactattgttctctccctaaaatgttctggaatattatcccaaggagtattttgttcatcacaaatttagatgttttgccttcccatgctctgctgaggactttgtttctctttttctctgccttaggcctcctctgccctcagtgtcaaaagcggtggttttaaggaacctcaaccacaagtgaagctcatgagctccagtgtcaatgatggttcagtatggtttgaaattaaacaactagagggagcatagtggcaaggtgaatggtgggttcctgggttgagacaagtcacctggcttctaggataccgaccggttttatgaccttgataaaattcactttctctgagttttggtttcctcatctccataaggagaggttgcaccaagcagactctcagctttgacagtcttgattatatcctaagctgtatttgttgtttttcagataatttggggcttctttctttcactctaccaacaaaatattgagtttgaagcttacatggccatgtttttgttttatgctttaaaatttttattttcacttatgttttacattaaatgataaattcatgtgggaaaacttaaaatagtacagaaaaggaaaaggaagatctcccatccctgatacccagtttcttctgccgaggtgctcgctgttgccggtctcaggtgtgcccttctgtggagatttgctgcacatgcataacatgccccaccttttctaaccacaactagtaacatgctcataatacagttctgtcctttgggtttttccccttctggacgatctctaagaaacattggaatcatcatacagaatttctctaaatgggtggaccatatctcccactgatggacattaagatcatttttaatcttttgcaattataaacaatactgttttgaatatccttgtacaaactgctctgttgatatgtgctttactttgaaaacaaagctatcatctaagttccacccttttccagactctacagttaataatgagagatgtttagtctgaaagatcaaatctaaattaaatggaagaaaccagtgtttccaccattacctcctgtgaatgtctcaagtaggggcaagtgttttaaagactcacatagatgtggcttgggaagagctcctctccaagtctgaaactcctccagattaggattcaggtattaataaaatctgctgagcaatatctggttgctatgtggctttcagtaatacagtacactgcttgagagtacgcccaatgcagcattttgtacaccgacaagggcagtctacctaagtgactgatgatagtcctactagaatttgttatgtcagtaagtcacctgagtcagttataaaattttccaaagtatctaagttataaaaattaacatagggctgggcgcggtggctcatgcctgtaatcccagcactttgggaggctgaggcaggtggatcactcgaggccaggagttggagaccagcctgccaacatggcaaaatcctgtctctactaaaaatacaaaaattagcggggcagggtggcacacgactgtaatcctagctactcgggaggctaagacaggagaatctcttgaaaccgggaggcagaggttgcagtgagccaagatggcaccactgcactccagcctgggtgatagagtgacactctgtctcaaaacaacaataacaacaacaacatagggttaacaacctgtgcctttgaagccttgttttcctaacctgggtatttctgatatcagaactattgggcatcttttttgtctctagtagttgtgtcagatactaccatattaaatataactactagtaagaacatacttttatagaaggttcagaaatgcctgttccttgaaataattatcattcttccatctgcgcctctcttccctggcttgaaataggtttcatgaattaaacccttctggatgtctggattttgtcttacttgaatctgtacttaagggaacttttcccctgcgacaccatctgtgcaaaaccctttacctcccaccccaggccttcaagtagaagttgtaattatactataacaagctctagaagtgaaatactcatntcaggttttttggcatcaatcatgactgtgctttttctcttgttcttaatctaagagtgtaagaaatgcccaactgattttattcattcatcagatcgtttcctgagctttccctgtgtacctgggattgtgccaggaggtgagagtccttggtggcaggcttaattctaagggggaaacctaaactgtctaggcaatatacactgatatcttcccttttactagcatgttattgggcccagagttgtaaatctatccaggctttcctcgagcccttcctcttagtaacgcaagcaacatttgggtccctattttgatgacctgctgtgtgtgtggtactttcttgcaaacaattgaaggcagattgtctttacagggttgctctgaggcttcagcagttgttcctcttcttcagtctaagatgtgacagaaggtggctagggacagttggacggggtacaagaggatctcgattttggtcttggctctacttgccactaaccagggcacatcccttaacctttctgggttacagtccctattccataaaataaggggatggactagataatctcccaggttccttatgtagcctaacagtttcatgttccataagccactcataaaaatccatctcatttcttcacacctctcttccaccagtccgttagttctcatgaaggcaggagctatttttccaagtttaagcccagtgcatgacacgcagcaggaattgcaataacaatttcagtgagygtatggacaaaaaagaacatttttatcccaccctcacctccatcctggagaaatctttgccattgaattcttcctcaaagaaatctattcttctctagaaaagcttcagtgttggtattgtctttcaaatgtacatatatgtcgttcaaatatacacatatattatacatttaatacatatatttaatatatggagatttgggctacttaaattcatttaaggagatttacttgtaaatcatatttctacataatatgcatagcaaactgaagatgaaaagtatttaacttaagccaccaggcgtggtggcttccacctgcaatcccagcactttgggaggccaaggtaagaggattgcttgagcccaggaattcaagaccagcctaggcaacatagtgaaacctcgtctctatgtttaaaatatatacatatatatgaaatattataaaaaatatacatatattataaaatgttttaaagttaatgataccaaatatagcaaaaattgagaatttttttctcagaaatgaagtgagtatataaaattataccttgttttctttgaccctgacctaggaggaaatagactgaaaagcatggttttctttattacatgacattgcccagcagaagttaagcaaatttgactggtaaacaattttgagaaaaactagcacttttataaatgcatttttgcagaaataccaattataaaatttatttaaggattttaaaattatttttgtaaagtgaagttcttttttttttttttttttttttttttttgagacagagtctttctttgtcaccaggctggagtgtagtggcgcgatctcggctcactgcaacctccgcctcccgggttcaagcgagtccctgacctttgcctcctgagtagctgggactacacgcatgcaccatcatgcccggctaattattttgtattttaatagagatggggtttcaccatgttggccaggatggtctcgatctcctgacctcatgatccgttcgccttggccttccaaagtgctgggattacaggcgtgagccactgctcctggccgtaaagtgaagttctatatgctgaaatttcactggttgttaaatgcagataaatagagcattttaaaaaaattgaaaatatttctcatgcgtttatccaggcacaacatgtttagcatttctgcataatttctttctcactaatttctccctttgaagaaacaaacatttttttctcagtcagatatttgttcctgagtttagctcatagctcaggcttccttgcagcatgcttttcaaacaaaggattaatggagtcctccttatatgtcggctcctgatctaggtgctttgtgttacatrttgtttgtcaattcactggtttgtgtaccaaagatcacatgccctccttacctctgccataaacacacaaattaactgagaaagtatacacatgcacacacacacacacacacaaatgatctggtgaaattatctcataacttgtgataacctttgtggaatttgctttagaccactatgttctatgtaaggcttaaaatgtactctagacagggaggtgtgaaatgagattttaacagaaacaaaagccgaggctagatgagtcaggattggggccagtattcgagcctccgtgaattgaattaaggtaataattacttaaacagtaatggttaacaggaaagtactttggaaggaatctcaggaatctatactccaaagcagaaaacattctgatggtctatttttgataaggtattgtgggccctggtcattaatctgtatgttcttccctcttgcagtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggtatggctttccatggtgtctggtggaggctccctggccttrgtgccaaagctgatgggtaggtagctgcttaccttcagggtaattcttctagagaagaagagacaatagggctcaaagccctactccaagcctcttgattaaaatccagtttcttctctcagtgttctgcctgccttttcagaacgaagcttaagggtacaaggacgagctgtattagcatggctgcctttggcttccactgctagtctttagaaggagagaaaggagaaagtagagagacaagagtctgttgttgtgtaacaaattatcccaaaatgtagttgcttaaatagccatttcattatatcgcacaattttgtgggtcagaatttagaaggggctcacctgggatattcttctgctctacatggcattgactgaggtcatttagtggtattcaactggtaggtgggttggtctggatagttcacaatggctttacctaagtgggtggcatgatggtgaggattgctggaagactgggctaagctggaacaaaagcctgggatctatggtgtggcgatctcagagtagtggtactcattccatagcagctgggttttcaagaaaaagcattctaagagacagnaagtagaagttgccaatttcttggggcctagctctggaaacggtcgtggagtcgcttttgccacactctcttggtcaaagtagtcacagagaaccccccgagattcaagcagatagtggagtggatgttcctcagaagaaatgacaaaggatcttggtccaccacagagcatgaaaaagagggaagctgaagggagaatgagaagggaaagtggtttgtatatggactccaacagagtgctctgcaaaactgcctgggcatcaatcaggcacttttgtaccatactccattcattcagttttcattccgtcagtcaggagtntgttgccgtgtgccctctgtgggtcaggctcagtgctgtacttcaaaaacgaatacaagagaattcctaaaagaacccacagtgctctccctgtttcagtggcttggtctatggaagagcagaattctttcttctgtgttgctaaactaatataacccatgttttcaggtctcatgctttttttctggctacatttttggggagaaaagcttcagtttattgttttaacttttcagactttgttttgtgactcacatgaagcaagatacatgaataacttccttttgctactttagagaaattagagaaataagtagttttaacattccagagaactttcttggaggaaaggaccgagcatgttagggtaaatgctgtttttttaaagctacatttgatactttcaaaaatacacattgacttccatgaatgaataatgtatttctcatcaaatacattccaggatataagaaatctatattgtgtgaggtttaaaatgcatggtaaattaaaatcatttctcagatatagtctttgaaaataaggaaaatgaatataaattgtgctttgttgctcagctgaactttcctccaaatttgaggaatacaacttaataattaggtaactacagttgtgtcttttaccctgaggatttatgtttgaactttcacggttatttcaggctaacggttgtttatactgattttagatatatagtgtcatgtttcttgatgggaagtaattgtattgttaattgttttctgtctttgaataataattttatttggaataatttttctgttttataatgtaaggtaaattaaacagtatcccaacagcattttatacattctcagttttatacttaaatgagctttagtgagttttttctttacacaaagttgtgaccattctgcaaagaatgacttgcttctctgtttttgcgggtgtgtttctctttctcttgcttctcctccttctttcccacagaaagtatttctgaaaaggggtgggaaaagtgccccaaattgtttcctttattccagctgtaggtgcctttgaaccaggatgtagtactgatggttcatattacagaaatgccaaccaagttccttaaatgctgatccttggaggctgtggaacgtggggcgttgtgctgcatcatagtgagcaattgcattgttgcattgtatatgaagcaggagaaaagattgtccagatttgctcacagggactcatgtagttcagccttgactctgtgtgtgtgtgtgtgtgtgtgtgtgtgtgtgtgtgtgtgtgtgtagttaggaggagatggaatggtggagtggttggttctggtgttctgatgcctttttatttttgttagggagtacaggaaaaggtctaaatagactttttaatcatggcagattttttccccatgcagaagcagcatgctcctgattgtcaaagatatgatttaagaccatataataaatggcattggagtgttctataatagttttctggggcatttgccaggacacctgattattcagtattcaggtgtgggctctgtgtttcatcttggtggattttttgaactcttttggtgattttctgcttcactttttgaacctaagccatggcagcagcagggaaatggactggaattaaaagtgatctttggctcacttgtttagttgccttccagcatctggtaggaatttggagagatgggggaagtggtggttctggtgaaatttaaagattatctgtacamttctgtttgttctctctgtcctacccctatgtcctgggtagtcaacaactgcctgaatatcccttgctcagtggacagtttgtaattacactggctctcctcttgcttgtaggcggccttaattgtacagcctgtcttcttggggcccaggccctgcaggtaggcctagacctacctgcccttctaccaactgagcctgtctgggagcaaggccccaggctatgctctctttctgtagtagaaagggaggttggcaaaatttaataagtagatgaatttatcccctaattactaataaattatcacgctgtctatagttttatcattcttgaatgatacgacgaatctgaaagatccctgtggagaatatgctatataaatattgtttcatttttcttcctgttccttctgctatgccgttgttccactaggcatatagtttgatgatgttgtgccatgaaaaaaacaactccttggtccttgttgcatgatttgatgtataccacaatgccaaagggtcacctattaactcattggcattgaaatcatgcgagaacattaacaaaatggatctgaggaaactttgattacaaatctaaagtgagccttcattatttcagtatggaagctcatattttttttccttccttcattcctttatctcttcattcaktcaatcaatatttatttagtagaaaataacagacaggtaaatgggatgtgactgccttcagataacttgtatttttgcagaaaaggaaaaataattaactttaatccaagttaaagaccagaagagtaaattaaaaccattccctgcttcacaggggcccagtggctaccatctttgactttcattactggaactgagaccagatgcacctgagcagagttctgtgaaagtgagcatcagatactcctttttctttccagtgacccctcaggttactggctacagaattaggatcaaaagagccagtaaggtttggtatctctgctgataaggaatcttctgaagcaggagaatttccttaaatgcagtccctccaatctagcattggctggtgtagcaacagagctgagctacttgtatctgataattgatgaattatcttggaatgcggcagacacttcaagtggaggggtaccaggaatctaacatggaagacataaagagtgcatttctgtgaaaggaagtcttttgtctgtgatagagttttcttttatttttactgaatttcccaaaggctgtgaggctacttcaggttcaccaaagaaatggcaactctagaaaaaaaaagcaattcttattgaagttttgctttctcttcatttttttaaggaaattaaaatttgrtttgttgagtttttttaagtagaaaaaaattttaatttttgactaagcgtggtggctgrcgcgtgtaatcccagcacttcgggaagccaaggcgggcagatcacttgaggtcaggagttcgagaccagcctggccgacatggtgaaaccctgtctctactaaaaatacaaaaattagccagacataatggcgggtgccggtagtctcagctactcaggaggctgaggcaggagaatctcttggacctgggaggtggaggttgcagtgagctgagatcgagccactgcactccagcctgggcaacagagtgagactctgtctcaaaaaaaaaaaattaaaaatataatttactgagttactttagtgattagcatttaaaaaagtgtttttgctaagtgcaagaaaccagacttccccccaaaactacatcctgtatgattccatttatgtgacgttctggaaaagcaaaactatggggacagagaagagatgagcacttgccagggttgacagtacagaaagagtagactccaaaggggcagcactgaggaattgtggggcagatggcwcagttccgtgtcttggttgtggtggctatttcacagctctgcatttgtcaaaactcagacatgtataccacaaagagtgaattttactgtatgtaaacaaaaagaataataaaagaaaacgaattgctacacacaaaaagacaaaacgtatgtttatggtacrgaatgtataaaatactaaacaacaaagaaggaaattataatcacctatactcttacctagaaagagtggctgtaaatatgctgatgatttctttctagtctttttgtatgtatcatgtgtatcaatgtgtctactttgttttttaaaacacaaaagtggtagcatactttaatactgctttgttgcctcttcttaatatattgggaagtcatttttttattctgtgtcagccatgaagttgtgctgtgactttgtatgtacccattccaaagcgcctagaatcctttctacaacaggccgtacataaatttttaaatgtcatgagccacacacacccacaatgactacagagtattctgttgttacacctgaaaaattcaacgcaatatttgctcagtatcctaaaaggcayaattgcaactttaccaaatgaagtgggaaatcgtagtcacaggtcagacattgagaaacaggcttctcaatgcctgtttatctaaaagaacaattccttgacatgaaaacaggcatatggctttacctgaagagagtatttcttttcatgtgtgttattcatttaaatataacggtttggggccatctttctggaagattttracctcgaggaccaggacctggaagacgagtaagtggcaaagccttggctcccccttgtcccttcacgggggctgccttgtagagaaatcattattcccaaagcaaattcagccctgcttttaccctcaaccttttctttctttytttttttttttttaatttgggggttgggggacaggagaatgcagtttgtcaaacaaaaatgctgactaagcctggcctcgggtcgccgrggcaacagggacgagaaaagagggaggcctcggaattcttttggcaggtctgtgggatttctgccaggcttgacagccaccaggcgcggcgggccagctggctgacctcgcacagccatcctgacagagggctcctggagggggacacacctggctgtgagcagcactggcctggggaaggttctgaggccccccyctttttttttttgtcatgcaaagaatagctatttagcgagctaggagagtgtcgtattggagcagatcatgwagcataaatgtaggctatttcatagcctttgcttcagaacaggggactatttaacttttagaaaagcatttcatagcattaggtttcagagttgactgggttaacagaggtcacgtagtctaatattttgtgaatctataaatccctccatataagcttggctatttaagttcattcgttcatatatttgttttacaaatgctctaggcattaaaagtacagctgtgaacaacagaccccagccccttccctcacagagcttccattctagcttgtgtcaagcgttttatttgcttacatgtcccagaaataatccattttccaaaatgtcccagtgtgcccttgttgttgaacaatagtatcaattcaagtctttttttttctttttcttctctttttgagacacagtctcacttcatcacctaggctggagtgctgtggcacaatcttggctcactgcaaccttcacctcccaggttcaagtgattctcatgcctcagcctcctgagtagctgggattacaggtgcgcatcatcacgcctggctaattttttgtgttttagtagagacggggttttgccatgttggccaggctggtctcgaactcctggcctcaagtgatctgcccaccctggcctcccaaagtgctgggattacaggtgtgagccactgcaccaggcctcagcctttttttttttttttaagtgaagacagacgagtatctaaattataatgttttctttaatgtgatttgaaaggacaacagaaaccagttgtggaataatacaaatttgctttatgcactctgagtaaaaagagcaacaaatagaccatagataataatgacaaacttagtaaatggcttcctaaaagtatcgcagtttcgattgttcttttgtagggacagtctggcagctgagcattagtgatgagttgtttcaaaaaggcagtctccgggaagtgtgacagtgcattttagaatcccttggcaccgaattaaaaagaaatatacatcagtaatttttttttgttccccccgccgtcccccgtaaagaaggtaaataattcggcattctctctctgaagtccctcagggttttggcagagaaagcaatttctctgcatccagaataactattttaatgttaggatttcaaaatactgtctttttttttttcattttctttctactcaccccaccctttataattaaaacaatccaatcttccatgtttgtagagtccctggccacacacacttaaatcaagcagagcagcctctgaagagctgattgtcatttgtttcccttttgaagtgcattctggtgagggcaggagctggctggcagagtgttccctcagccaaggcgggacagagctgcagatgctttcagctgctgtttactttctcacctcctctgttggtttattccacaggcaagctgcaggccaaggacctagaaggagaggaggtttgaggtttgcttcctgggacaccttcagctcacaaataatcatttgtctttcacatccttacttctccagctattttacacatcacccgtcctccagctgctaggaaagggtattttttagcccataaataattactcacttcagagagctagatagttgaccacaaactcaccaagagattcttgagcccttattttgcaagtctttccaccccragcttggacatagacaaaaataaatttgttggaggagggttgggtcagggtcagcagggagagctttccttctgaaaagtgcccttgaaattggaacttgtaactttgcttgatgggttgtgaattcctaggacatgagctccactcatatacgttgaaaactatcattgaatacatccagttcattctgttgccctgttcagggaggaaaactatgttcaggaaagttaaatcggctgtttcattaaatttcctctgaactgtctgaggtagaggggttggtctttctattttattgctgggaaaacaggctcggaaaagtgaagtaacttgcccagttctcacagccagcaggtgaaagggttgacaatttgaggtctgtcaacctcaaccctcaacttttctttctctgccacactgagactttgccacactcttaactctgagcctcagtttcctcatctgtaaaatggagacaattgggttgtcacgaggaagagatgaaataacacgtttttcttttcttttcttttctttttctttctttttttttagacagagtctcattctgttacccacactggagtgcagtggcactatcttggctcactgcaacctccgcctcctgggttcaagcaattctcctgcctcagcctcccaagtagctgggactacaggcacatgccaccatgcccggctaatttttttgtatctttagtagaaacaaggtttcaccatgttagccaggatgggaaataacatgttaaagggcttagaacagtgtttcacacacagtaagcaatatgcaatttttagctagtatctctgcctcccacaccatttaacactatcagcagcttgttctgttaactgcgtcaatgtgccaggtccattataagtacgctttctaatctttatagcatcccagcaagatcagtcttataaaccaccttttttttttcaggtgaacaaactgtcaagaaaggttaagaatttagttcaagatgccacaacatgtagtaactgaactgggatttgaactccaatctttctggttccaaagacagttttgctcttgtgccatgctgccttttcggtgccaagctctggaccccaacttaaaccccaactactgtttcagaaatccggtggctaatagcctggagaattgagaagaaggcagttcctgccctgaactgataagtaactagaaagcccttcatcgtatctgcctcaaatctaggctagaagagatcttccttctttcctgtgacagttcattaataatttgagagccactgtgtgcccttctagtcttcccctgtggttaaatagccccactcttcttcataggatatgatgccctgacccctctctatcctgattggtctctggtcactctttgaaaagatttcagtaagataaagtgttgggtagggacctggatgcagccttgcacttgaaggttgattggaggaagaggtcagttggactagctagagaagcaatgatgacctgcttcttgagacagaaagcaggttttgagcttggtctaggaaactgaaggtttgtttggagggcagggtggacacagaggggaccctggaagggatctgtgaatatacatgtttaactggagcacagtgggaaatgagtgacaagccagcttagcgtttgttttcctgcctcgactagagggagcagaggaaggaaggggtgctgagtgaaggcagctgcaccaccgatgctcagcggcagaggccttgagttatgccctcagccagccttgaccaactgtcacccctctgtttccatggaagcttacttcatccagtgcctgtctttgtctttgcttcagctgctttagtttcatccattttgactgctgctgtttggtctaagtcagangtttgcctttcatttttacccacgcaagggtagtggatgtcatgtggcagtccaaatcctactgggtctgggctttaattttatacctaaatttagtttaaaacaaaaccctcccctgtttggatggcaacatgttggtgaggttagcccttttattttcagacctcgggttttgtacagtttctttttctctttcagttcatgagttggaatagggaagtattttcattcaaaaaaaggctagaatttttaaagttctaaatatagaactcgtattataaaatttaagtgaagtaaaacatctcactactttccakttatattcgaacaaattttatgttatataaaaatggtttataaacctctccttgtttaaaaaaaattgttttcttagccttggtgaccattatgatgaatttcacactttggtttaatccctccaaggtgaaagttgaccaggaagaaacctctcaccacttaaagtggatcagttccacatgacagtgtgacttttaaaattgtttattttgttttttttgagattggaattcagaaaatgaaataataataattccttcagtatttattatgtgatcttgagtgcctggcactgttctaagcaccttgtagtgttatcccgttttatcatcacagcagccttcttgggtgggtgctcttattatccccactttacaaatgaagaacagagggttaaataactttctgttagatagcaggaccaggtttccaattcaagcatctagctcctggccactcggccctcctgttcatcctatgtgaggagcaggaaagagtgcagcaggaccatttcttgaggatggagcctgcacctggctagttgggttgtatamaataggctattatttctctcatatttgtggctgaggtgagattgcatgttcttagtttatatttccaagtacccactgtatgcctagcactgttaaggtagttgggtacaggagtgaacatgacaaacaaggccccttccctcgtggagcttacattctagtaggaaagacagagaatgaaaacttaagttgcactgaagaaaattaatgcagattaagagacagaaaatgacaggggtgaggccattttagacaggggtgaggtaggagcatctctgaagagatggcgtctgtaggaggcaggcgttaagtgagggaataagctttaggaagactcgaggaacaccttgcaagcagatagaacagttggcgcaggtgcaggaggtgggaggagcagcagagaaaccaggagactggaagggggtgaaggaggggagcacatcagagacatgggaggaaagggtggccagggctgttatgcagggtgtggtggtctgcagtgaggacctgcctctatttaccatccaggtggaacaagaagcaggtcgctttagagcagggggtcacgtgagcttcactttggctgctatgtggaataacttgtgacctaagaatgattttggaataatcttagacaaagtgtcctattataaataataactttctaactcagactggcctaatttatatttcaaagctattattcaggccgggtgcagtggctcacgcctgtaatcccagcactttgggaggccaaggtgggcagatcatttgaggccaggagttcgagaccagcwtgggcaacatggcgcaaccatatctccactaaaaatacaaaaattagctgggcrtggtggcacatgcctgtagtcccagctactcggraggctgaggcacaagacttgcttgaacccggtaggtgaaggttrcagtgagctgagatcacgccactgcactccagcctggctgagagagtgagactccatctcaaaaaaaaaaaaaagcaatcattccgggtacattcaacaccctttctgatttttctcttatttgttagtcagttgaaggtagaaaatgatactgtgagccccctacagacagaaggcggcatttgcccttaggatgacttggtgattaagtcttcagggtagttagggaaacatcagtgctggagactagagcttctgttctctttgatttagaatagatggaacaaatgtgaaatggcacagtgaaacatttcctccaatatagtataggtttttcagctttggttatcataaataatcctttaaattttatttatatattttatttatatatttagacacacacaagcattattttatgttttatttactggaaatagctaggagtaatttaaattaataggaaagtttagaactatttattttatatctaatttttgatatttgttcttataattttatatattattacagataacaattcatgtgtgttatatatagtgtatttttttatcccatgaagttccagaaatgattcttaccatatataaatttagaactcctggaaattgcagattcaacttgtattttttttttctttttttgagacagagtctcgctttgtcgcccaggctggagtatggtggtgcaatctcggctcaatgcaacctccgcctccccaaattcaagtgattttcctgcctcagcctcctgagtatctgggaccacaggtgcatgccaccacacccggctaatattttgtatttttagtagagacagggtttcaccttgttagccagggtggtcttgatctcctgacctcgtgatccacccgcctcagcctcccaaagtgctgggattacaggtgtgagccaccgcccggcctcaacttgtattcttaagacatatgttgataaagttttttcaatacaaaggaatgcagccatctcatcaacttttaaattaaaagtgtatttgtttagaggtaaactcccacatttattcagaatggttgaaaaatggaatattctagtaaagttcatgtttttggataatgagggttatgagtcaaaagattcttgcatttatggttaataaagnattagaaatttaccattgatgagatacattttttcaaactgtggctcagggtgtatgagtgtgcttgagggatggggactggtgggactcaggctttttatgccagattcaatccctgttgttccttctgaggctttcaggaaaactttggttggataataaggtttctaatgcaccctgcctgccatgttaaaaacaactatcagaaaataatttgatttttctaggtttattcagaaggcacttccaagatttagatgatgaaaatcactttttaccaaaaaaatctccagtttttggtttgctttttgtagattcctgaataaaatttgttagttaagtatttgattatttgcaatctagatgaacagaagtgagccaaagaccctttccagctagatttatttcagtataagttaacaatacagtttttttttwaatcaatcaggtctctcatggtttgtaacagtgcaaccaactctagtaactgaaaatttttatagccgatgacttcactaggacttgtctagacagcagctaccctctaaagtcacatcatgttagggctggaagagatctaacgaagatactgtaatttagaagtcctaaatgttctgtttgccattgtagccatggttttagggtttgagggacagtgagaccaatgacttcagcatggaaagtgggaaactgataggcataaatatggggaaaggcctaaccttggtttgggatgcaaatgtaaacatacaaaagtattctctggaaacatcagcaaatttgaaaggaatttgatgtctggttatgtttgtcaagatggagagactcctggagattatacctagagaaagtagttgcagtcagtaaatttgtagccttttggatagactcttcttagcaatgtaatgctagcttttataaaataatgcttgtattatttgtttctgctaatgaaatccatatgctgtgaaacagttacttgtctgtgggatttggattggatctacatggttccccaaccttcagcattttagtcaacaaagtagtcaaatagattgacttttttgtttttttgttttttttgagacagcgtctcactctgtcacccaggctggagtacagtgtcgtgatctctgctcactttagtctcaacctcccaggcacagggctcctcctgcctcagcctcccaagtagcaccacacccaactaatttttgtattttttgtagagacagggtttcaccatgttgcaggctggtctcgaacttgtgggctccagtgatccgcccacctcgacctcccaaagtgctgggattatggacgtgagccaccacccctggccactgattgactttttaaagtaaactttcaactcattgttttgctttcctgtctgtaaacataaaactgccagatgcaatttaatgtagagcctggactctgtaattccacagttttactggcctgtaagtggcaaagaccagaatgtactttatagtccagaggagtctgattgctttgattgatgtagatttggtttgagaacctgagatagaaaaagccttgtctctgacaaagtgttttgagagggctttctatgatttgggtgtttaaataattgcatgggtgggatgattgcaacattaagtgcccttagatcaaataatagctgagcttcccattaactttgtgaatgtgaagtgacttatgtctgtaagactttcttcggagaaagaatactaatggttgcctggtgattttgacttgctgggagtaaatacacagtgctttgtatttggtgaaaagttttgatgtgaagtacactttgctccatgccttgtgacaatgagtgcatgactcttgcttcccattctgactgtaggaagctgccctctgtcgacagctccccatggaagctgagactcttgccccagttcaggctgctgtcaacccacccacgatgaccccagacatgagatccatcactaataatagctcagatcctttcctcaatgggtaagttaatatttgggggccacttatttttattctctttattatgtgatctagactataatagratctttgtttacattgggaagaggtggggagcttgagggttgagggtgagaataaagggaggaagtgggaggagctggcagaaaaaagaaaagcaggggaaatcatctgcctgttaaaaaatttccaaattaaaaaattggtgataggacgtagagtaaacccctagtcaagaatttgaaaatgggcatgaacttatatttttaaacatgrtggtgtcgtctagtacttatacttggaagaatcttctggttttatgtaaccaacaggggataaaagcatgccatatggcaaattgagaacagaacaattaagagattatgttcggccaggcatggtggctcatgcctrtaatcccagcactttgggaggccgaggtgggcagatcacctgaggttgggagttcgagaccagcctgaccaacatggagaaaccctgtctcttctaaaaatacaaaattagcagggcatggtggtgcatgcctgtaatcccagctactcgggaggctgagaattgcttgaacctgggaggcggaggttgcagtgagccgagattgcaccattgcactccagcctcggcaacaagagtgaaactccatctcaaaaaaaaaaaaaagaaagaaaagaaaagagatgatgttcagggtgaaatgtgaataagatctatagtttagtaaataatattctacagtgtcagatttctgattttggtaattgcactatggttatgtaagatgttatcactggggaagctggtgaagggtacatgggaacgctctgtactcttgttgcgtcttctatgtgagtttaaaataatttcacaatttaaaaagtaattaaaacaaaggagcaaaagggaaagagaatttagccagaaatatcttcatgagcagaagtagtttttaaatcaaataaaaagggcaattctgtatttcctgtgccttttattctgcccttgcagagacgtctggcaaacaaacaatacaattatgaacattattaaagatagagataaaaacaaatagtagctgaaataataattaatggaggttttaaattgttgattttaaagtatttgaaacacagagaagtacaaagaataacatgaattacccatgtacccactacccagatttgccatagttttatttaatcttactttttaacaaataaaatattacaattaatatttgaagccatccccccaccactgaaatctcgtttcttttcccttctgtccccagtggtagccactattcagaaactggcgtgtgtccatcacacagacttttataccccttactgcccgttagtgtatgtatccataagcaatattcaacatagtttttgttttttttttttaaagttttacataaatggtgtcatactctgtatgttgaagaatgttcaaatggttattttgaggtgaaaaggaaatcaatgtcaatttactgtgaatggccacacatgattattttcattttcatgagggtatgtatttcaaaattaaaactttccttcctccctaacctggaaagttgggcagcatggcacaactgcactagtttagagcttttgtgactgtgttttaattttgagatttatttagtgggctcatattgaagtttcttcatcttttgctttgcagagggccatatcattcgagggagcagagcactgacagtggcctggggttagggtgctacagtgtccccacaactccggaggacttcctcagcaatgtggatgagatggatacaggtaggagcaaagcctgcaagcacttacaatgggtttgtgttttttaaatgatctcttcggttatctcaattttatttttcttttattttatttttataatttcaagttttattttatatttgggggtacatgtgcaggtttgctacatggttatgtgatgccggggtttgggatacgattgctctcgtcacccaggtagtgagcatagtacccaatagtttgtttttcaccccttgttcctccccactcccagtagtcccgagtgtctgtaaaaatgttgaaaaaaaaaaaaatggaatgcttcatgaatttacatgtcattctcatgcaggggccatgctaatcattccagttttagtataggtgctgccagagcgagtacggtcatctcaattttaaaatccaaccagaaacactcaatctcaacgacaacataaaataacagctgaaaagccactgaacccccaggcactattaataaactgtagccccttcctcatagattatacaagtatagttttacatctgggcgcaggattttaaattctgttgttttttttttttaattcatctttgctccatatagtcccttcctcacaattgcatcaagacaccactgtttgtttgccatgtttccacattggggtatttatgctgttctagtttttagttgtaatatatgggccaccctttctcctggaaagtgacactggtttatagttctagtatccaatttttttcatgtcattcactgcatttgaaaagcaattggcagtgggtatttggaatgctgagcaactcagaggattcaaaattgtcacttccaagttccaacatggtaacgacatcctccctcaggaattaaagagaagagagtcagggttactcttaccttgtccccagcctgtgcatccttcaggtccagcctcaccaggcttcccgattacctttctttttctccttttctcaaggagtgagacttccaattgcagaaactgaagttagtcttattagccttacctagacttaattatgaaagtcataaactctaagaagatattctagaaccaaaaataaatgacagccagggtgtccactatttggagttattcatgaaagttccttctccattatcattgacgaaagtaattgttttgtgttgaaaataaaaaattccttcccccaaagtgtttgccatagtgcctgtagttttttacactctactctttgatggcttctctttgtgttgtgagtctaaattgttggaaagatcaagagtcaaactcatagccaggtgtcttacaaatgcagtacattaaagctgctcccctggcgtctttcgtgtaggttgtcatctttgcattgagaagattgcaaagactatcttgtgaggagtgacacaggaatagtttgcactgattgttttactgttcttcagtttattacttcagttcttcccccaccaccaccccctgccacctttatctctctctctgctttttgagtgtgagatttattttgctatctttggaatagccttaggaagtggctccttcctatgtttaataattctttactttcatcttctaaacactgggaagccagtaaggataaaaagcaaagttaaggaaaaaagctcaggagatctaaatctaagtttgacattcaaaaaaaaaaaaaaaaaaccataaaagaggatggattctactctatgtctctttaaaataacctcaagtgggtaagtagggagtgttttattttgaagccgtaatgtggaattaaatgacgtcctgaaaagaacatagttttagccaacaggcagcctgatttgaatccttgcttctccattcctagtagcgcctttgggtaagttgcataacctccgtgagcctcagatttctcacccataaagtgggagtgatatgctcacggcagagttgtgaggagtcatgagatcacagagaccagctcaaagtgctcttctccagtaagaagactgatgtcatrcatacaatggacttgataatgtcagagtgccacgttaacctggttaagtgagaatcagctcattgagtgtgggaatgtgagtgccaagttaacctggttaagttagagtcagctcattgagtgtggggccacctctgtgaagtctttgtaggaactggacatacatcttctcaaggggagaaatgttaattatacagtagcaaaatgagggaagctgtgggggcaggcagagctcaagtgtggctagaaaagatctatcaggcctgtggaccacgcgctggccacatgctgaagggaaacgagccagctgagcactccatttgcaaaacatacatggaagcaacagctgggcttggtgcgaagatccagtaaagggaataacatgagcaaaggctgggaaatcatccatccttccagaatattctgcagtaatcacacccttttaagaattgccttgtggctgggcacggtggttcacacctgtaatcccagcactttggtaggccgaggtgggtggatcacctgaggttgggagttcaagaccagcctgaccaacatggagaaatcttgtgtctactaagaatacaaaattagctgggcgtggtggcacatgcctgtgatcccagccactcgggaagctgaggcaggagaatcacttgaacccaggaggcggaggttgcagtgagccgagattgtgccattgcactctagcttgggcagcaagagcgaaactccatctcaaaaaaaaaaaaaagaattgccttgtgtttgtctcttccactttttaagtggataaactgcaaagaccaaaaagattactatgagattgcagagctgcttctattttaagattgttaactttaatgaagaagcttagccagtatcctcatgccttccatcctgagaagaaaggataagagtaatttttttttttttttttaatacggggtctcattctgtcacccaggctggagtgcagtggtgtgatctcagctcattgcaacctctacctcctggattcaaacgagtctcgggcctcagcctcctgagtagctgggattacaggggtgcgccaccatgcctggcactgtttttttggggtttttttgtttgtttgtttgttgtatttttagtagagacagggtttcaccatgttggcaaggctgttcttgaactcctgacctcaggtgatccacccacctcggcctcccaaagtgctgggattacaggcatgagccaccacacccggcctaggaattctttaaaacagagattttgcttggctaaaaattatattcttgagtatttgaaagttaaaatgggaaattagtaaaaatgaatgattctaactggagatgaagagaaaaaaaggcatccagcacattagatcagattgttttttagacactttttaaagcctcatttttatctgttacactctagtaagtagaagaaagttattttggattttgttttttcgtttaacgttatttttcaatatcagtaacactatattgaggtcatattgttgaatttgatttaatttttcagtttactaccctttgcaatgaaaatactgtaaaatgttacccaggagtcatttatattttgtgacttctagaaaagccattgtgttttgctatcaccaaaatccaaattggatgatggttccttcatcatttggaaggatataatttttctccctggaaaacacagattgctaaagtgaactttcggcaattttgcttaaaatagtgaaacttccctacacacgtttcaggaaggctactgcacttgtaacacacaaaagataatttaacaagtttttaaaaaatgacgttatggtggaagctggccttagttatcaatgcttctcaatttttgaagtagatattatctcttcagaaaattgtttgggactttttgaattaacctgttgttttgatattgtgtaattaatagtggctgaagacctgggtttttctttctctcaggacaatgaacatttattatatttttgtatgtatataactttgtatatatcaatgacacccagagccatggatatgtggcagacactatatggcactttactctaacttttgtaaaaggagcatatgatcccaatttctagatgggtaaactgagaatcaggcaggttaagtgtgtctaagcttacacagccacaaagctcgatctaatgacaccaaagtcagtagtgcattctgtcccatactatgacacataaagaacctatattcttcatgtcatatcccagacacctacttttcctctagtacagcattttctcacctgtgttctgtagaacttcagttttatttgaatacacatactgccaaaataggtttaggtgattaaatgggtttaggaaatagtgtcttaaagaaaacaaaagatttctttactctaagacttaaagccttaacatgctcatatgcactgtgctcatatgcttgtgagaaaggcagatagttgtagggtgtaggtattacagaaagagggaaaacgtctgcagaactgcctttataaatgatgcctaaagtcatcaatgaagacaactttttaatagcctggttaaaagaagcttcacaccattctctttgaacataaagaaggatggtatgggtaaacctaagcttacaatgaaacctgtagattatagttctgtaataagctgtttattacagacaaggcctctctactcttttgtaaaacagttcttcacacctttgtcatgggaaggcacagatcatagatcagatccacagtgcctttcacatgctcctttcttatctccttggccttttccattctggaccacacctatccagaaataattttcgatttcttccacatctctgtacctcttatgagtaagggtcaataatgtggtagttgaagacatgaaggtgagggttatgtaaatacttgaactgttcctccttcaagagcctaaaagaaggaattaaaatggtttcttttcattttgttataggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctktaatcactaccattgtaacttggatgtagccatgaccttmcatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccatgctggctctgatggctcttattagtctgtatttataaaggcacacagtcctattgtagcttatctttcgttattttactgcagagcatctagacaacttagtccctccagcgggaaagtagcagcagcagcattagtcacaggtcttacactacagatcttgtgaaagagaccagtttggtactaattatgagcattttattcaaacaaaagtttttgaaatattacaactggggatttaaaaaattgcagcttagaatctgatggtttttttttttcttgatgttgtttgtttgtttttgagatcgagttttgctcttgttgtccaggctggaatgcaatggcacaatctcggctcactgcaacctctgccttctgggttcaagcgattctcctgccttagcctcccgagtagctgggattacaggcgcctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactnnnnnnnnnnnnnnnnnnnnaaacctccattaattattatttcagctactatatgtttcttatctctatctttaataatgttcataattgtattgtttgtttgccagacgtctctgcaagggcagaataaaaggcacaggaaatacagaattgccctttttatttgatttaaaaactacttctgctcatgaagatatttctggctaaattctctttcccttttgctcctttgttttaattactttttaaattgtgaaattattttaaactcacatagaagacgcaacaagagtacagagcgttcccatgtacccttcaccagcttccccagtgataacatcttacataaccatagtgcaattaccaaaatcagaaatctgacactgtagaatattatttactaaactatagatcttattcacatttcaccctgaacagcatctctatactttactgtctttgtttgtttttgagatcgagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcyaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcrctctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaayttggttgaaaagctctctgcagaagaagtgatctagactgacagaagtgttgctaattacaagttgtgttctcatgacgtaattagaaagtaacttctcaaagtacaacttttatgaaaaarataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttccacttggagcttttgacttttcattatttgtctgtgttccttttactaggggatttgggtggtactgaagacaggcttatgtaaccctcctggcagacaatgaaagaaagaaaaatctgcaggcaaacaatttcttggctcacgtgcctggccttcaacattctaaatgttcacagaattctagtttccactttatttacaatgtccactgaggtttttaaaggtgtatatatacacctttaaaaataaaaacatatacctttaaatatatatatatcacatcattgtcctcccaacaccctcacagatttgacaagaccatcaaaaatacaggattcttgctgggcacgatggcttatgcctgtaatcctggcaatttgggaggctgaggcgggagcattgcttgagcccagcagtttgagaccagcctgggtaacattgtgagaccttgtctctacaaaaatatataaacattagccaggtatggtggtgtagaatatacaacaaactcttataaaccaatagaaaaaacaaacagcccaatagaaatatggatcaataatgtgaatggaaagtttatagaagatgaaactggctggtgactaatttaccaacctcattccaaatcagaaatttagataaataatgactgaattcccagtggctcataggcttgctggaactctttcattgacctagactctgcaaccttttcctactggctgtttttgaaatcggtttcttgtaacttaaaagtttgagttgataaaaccttgaactgtaattagcagagaattgtgtttagaaatatttatttataggggtcacagatagaatatgctggggaagcttacgtgtcctaaataaccttttctgcttgtaagtcattaggtcaaagtaatgcatggcacattggtttgcagtttgaggaccagaagtaaggtgacaactctcctggtttgcccaggactaagggcttttccagattcaggaatttcagtgttaaaactgtccaatcggccaggcgcatggtggctcacgcctgtagtcccagcactttgggaggcagaggtgggcgaatcatgaggtcaggagatcaagaccaacctggccaacatggtgaaaccccgtctctactaaaatacaaaaaattagccgggtgtaatggcgggcgcctgtagtcccagctactctggaggctgaggcaggggaatcccttgaacccgggaggcagagcttgcagtgagccgagatcatgccactgcactccagcttggtgacagagcgagactctgtcaaaaagaaaaaagaaaaaaaaaaaacaaaacccaaaacaacaacaacaacaacaacaamaaaaaactgtcaaatcaggaaacgttgggaagtatgtatcatgtagtcattggcaggatgggctacataatttgcgggacctagtgaaaaataaaaatacggggccccctgctcaaatttaaaagaacttcaagatggtggcagcagagcattacaccaagcgtggggctcttctgagtgtggggccctgggtgggggcaaaggatttataaaaaagaaataattataagcattaatctgggaaattatcagcattttctcctaaaacagcctctcaccaaaatttccaggcagctagtggtgtttctcatagttggagagagtcaggtgggtctgggggccctggccctaagtcagatttggtttctcctgagggaactaaagaatacagaattcttaagaccttctttcattgacatcccccaatattctgagtcagcaataccaaccaaccaggagggagagagagagagtccattaattgaatcgtcagtaagtacttgctgagtttctggcatgttgaaggcactaaatagtcataggaaaaacaaggatgaagaaaactcaaccccatggtttaatcggggccatacattatgggacaaagagttataggagctcaaggtagagaaggaaaagagttgtgaacagtcgcaaataggtcccgatgtctgagccttattcaccaaggagtttcccaggcatttcaggtaaaggagacagcctacccgaaagcacagaattttaaaagaggagtgacaagaaggtctatggccctggagagcgagagtgtgagggcaataaggtgggagctgagaccgaacaaggttgatggagagtaatccgtgaaaaagtttgtatgctttgagtcagagttggagtttatcctatacaatagaagccacaggaagatttttaatagtagagtgacttaaagaaaacaagtgaaaaagtgaagatgaaccaaaatggagaggagttggcggccctctccttgtacaaggatctatttggtactatgagcataggaaggaattgaaaccatggcctctgcctccacaaagcttatatactactgtgtatttagcacaaagttaatgctaataaagattaggagagaaagatcatttggggcttggtggtgaggtaacatcagggaagccaaggcagagacttctgggaatggaaaactggtaaacaaaggcacaggaggagaaatggaagggaaacaatatatgctgacaacctactgtgttctggagctaggcgtcattacttcctatatgtgtgtgtatttttattggaataggattacactttaagagtcaggtaggcagaattgacatctttataattctaagtctttcgattccatctgttttctcagctttctcagaaatgagatctgaagatgagtagacaaacaaatgaaaccctcagtaacctcagtcttggaagtcaggcactaatgccagcactatcagaaataatagatacaattgtaatctcctgagatctgcttaagctttttaggtctcattctttattctctttacctataaaagcctccctttgctatggtctaaaactctcccattctatcttcttccttagtgtttgaacgaatgttctacatttgttcatgtacacaaacacacactcttttttttctattttttttttttttttttggagatggagtctagctctacggcccaggctggagtgcagtggcattagctcagctcagctcactgcaacctctgcctcctgggttcaagtgattctccttcctcagcctcccaagtagctgggattacaggcacctgccaccacgtccagctaattcttgtatttttagtagagatggcgtttcactgtgttggccaggctggtctcaaactcctgacctcgtgatccgcccgccttggactcccaaagtgctgggattataagcgtgagcccctgcacccggcccacactccttttcttaaagcacttctgagtctgatagctataacagacaggaggttgagaaactgatattttaactctgactctaacctttataaatggcataacttcagcaagccaaattacaaagcatatttctcactacccaatcagaaaagctgacacttctaccattaggattagagtactctttccagaaaaagccccccacctccaccaaatatcttccctggggaatgataatgtgatcaattgggctacaaatggagaaaactaatttgtgggcttagcagaagttaacagtcattactgtctgcactctagaatgagaaccaatttatgggattagcatagagcaaaataagagtttcagagtaccaaaataagggtgaaacattaattggggaagaggaggcccggcacattccacgtagcatattgagtcctggagaaggtgaggtgtgtgagcactagtaaaatgcatgtgtgggcagtctcctttacaattcgcgctgggcttcattatgacaacaagttaagaagttcagtactgtgcaggtattcattaatgccgtggccttagccaagtttcttaaagtctcagaacttaagtttctttctttctttttttttttttttttgagatggagttttgttcttgttgcccaggctggagtgcaatggccatgatcttctctcaccgcaacctccgcctcctgggttcaagtgattctcctgcctcagcctctggagtagctgggattacaggcatgtaccaccaggcccagctaattttatatttttagtagagacagggtttcaccatgttggtcaggctggtctcgaactcccgacctcaggtgatccgcccgcctcggtctcccaaagtgatgggattacaggtgtgagccaccgtgcccggtgggaacttcagtttctttacatgtaaaattggcataataaaaaagggaggggtacaatgagagagtggtgaagatgaagagaagtgacttatgtgaaaaccagtcgttcatagatggtcaataaatattcattcccttctttgagcttttccttctcttggcccaggccatgtctttctccgcagcgtttaccaccatctaacagtgagagataacttacttttcgattgtcccccattaacttgtcagctgcatgagagcagggattttgtttgctttgtacctagcaccttgagccatgcctaacacggaaacctttcctttggacagtgcaatcttgggcttgtttgctgtcacttccatgacttgcatttatgaggtttttggaaaatgttccttgatgagaaaatattcgagaaaaattggattatttagaaagatgggcaaacctgctcgcggagaaattatctgcttagtgacctgttatctgctgccctctaatggctgagccgagtcaccattagcaggcggcaggtggctttgtcatggtgtagtgagtgaccagagcctggctcagggggtgcagccgaccagggctgggaataggatggggcattgctgaagggggaaggagaaagacatgcagaatacagacgtgtttgtttccttctttgcactgacctatgtgtcctttggtgaggagttctatggcttttgagtcagaataaagttattaagtacaaagagaaaaaaaaacaaaaaaaactaaagtcattttcagagcagggttcacagtagagtcaatggctcacctgccttagaatttcccaagttgttggtgtaactgtgaatttctcagacctcctgaacctgaaagagactgaggtctgagactctgcatttgttcggtgagcttccatgtgattctggtgcagtcaagtttgacacctaaggagtaatctccaattttttttttcatcatggagccccgatgtatgtatgtttgcttgtttattttttaatgttataaattaaatacaaaatgactgttctagtgtattgtgtacattataaaacattcacaaaaatggaaatttttaaagaataaaaaaatacattaaagtttacatatgaacttcccatgccacattttggatgagtataatttatgattaaatgttatgtaactgatccttagggtgattatgatggcacaacattcattttcccaagtttgtggccccaacatcaataggcagcaggattatctgcagaggttttatttctgcttcaatagcatcacgggaattctctttcttcccctctccctgtttttctacctctccacaatattcacatttgatgctgggaaaagttgtcatgtttactctctttaccaagctgatgctcctagtattgcaatttcttggtaggaaactgagtgtggactggtaagggtgttggcatcatatagcctgcaatgcccaggtgcttaagcaaacacaaatatacacccttgggactactccaagactgaaccagttgcaaaatcatctcctgtgaaaccctgcctagaaaaagctttcaatgcataattagactctaatctggctcttaatttttctggggtcatggatctttaagaatgcgatgaaatcttcaggctctccaaggctgggaaaaaataattcatgtgaccgtaggtactatttaagagagtgtaaacacttctgcagttctcaaagtgtgg

SEQ ID NO: 10680 - DNA, 43868 bp, Homo sapiens
  misc_feature (1)...(43868): n = A,T,C or G, or insertion/deletion polymorphism (see Tables 1-2)
tttatagttttggcttttgcatttaggtttatgatccatttaatttttttattgtggtgaaacatgcatgataaaatttgccattttaaccattaaatttaacattttaaagtgtacaattcagtgagtttaagtatatgcacaatgttgtgcaaccatcacccctatctatttccagaacttttcccgtgacccattttgagctagtttttgtataaggtgtgaagttataggttgagattcatttgtttcacttgtggacgttcaattgttccatcgccatttattgaaaagactattcttttgccatttaattgtcttttgaccattgttgaaaatcagctgaatttgtaccttttcaattttgttgtggggctagtatttcagaaaccacataaccagcatgtgctgtaccctctgattaaactgttgtgcttttgaactactggtttgtgaggtaagccatcatggtactgagaggtgggtctgaaagcagttaggggtgggaggtgcattgactgtacagttaatccaaggagcttggctgacattttgaggacagtgggagtttgcactaaaaggtcttaggcagcagtgacctgatacgattcacacagtggaaagattgctctggctacagtgtggaaaatggatcgaggtaggggagaatcaacactagtcaggagtggctggaggaagtggacccattgaataaatacaaagaaggccaaaccacatggatctgggaatcaatcagatatataagagaaagcagagaagaaaaaagcgggggccaggatagctcagtacatggctgtgcaactcctaaaggagagaacaaaggagctggggcaggggtcttttggaggatggtggcggggaggtgatgagtacagctttgactgggttgagtctttgagttgtcgctggagtgcccactgggagaggtccacaggcaaaaagatttatgggtctgtgacccaggaaaaggatttgggttaaaaatgtagatgtgtgagttgtcagcatatggatggtatttgaagccattggagtggtgagactttctcaagaagggacagtggagtaagaggaggggagaggccaaaggagaaatcctaggaacatcatcaggaaaagggtggtggtgagaggaagagaagtgaaggatacaaggataggacatccaccaagacaagcggaaaacaagaatgtcacagaaaccgagggaagagaatcttacaagaagggggaagttatgcaaaattacagaatattcaagaaataataatgcctagggcgtgttctttctgcaggaccctactatcctcaacaaggaaagcatcaggaacagtgaggagggagttttggtggtgtaatggtggtggaagctatatctcagtggaatgagcatgaataagagtgaggaattgtagacagcagctgcagacaactcttgcaagaagattggctgtgagaggtgggaacgcaggggctagctggaggggacctggcactgaaggagggcttcttgacaggagtgacttgagcatgcttaaatgttgatgacaaggggtcagtgaaggaaaggagaggggtagtagaaggaacatcatctcagaggaagggggagggggtccggagcatggtggaagtgccaactgctgtgttgggagaagaggaaaaggtggttagagatgctggtcaatgcattgttgtggcaacagggagtagagaatttacacttggtggctctatttttttctctaaagttgatggggagataatctcctaagagcaagaagggaggcaatagggcagaaagtttgagaagaataatcattgtgagaatgggagagaaagctaattaaagagcatagaattgctggggagggttgcgagcagaagagaggttggagactagcacactaatggcctcaatctttggggttggtaattttattcattgttgctcagcagcccagatgtaagagccaagaagaatagttttactgacccacgcagatataatctaagaacagtgggcaggagagttgatgatattgggaagagtgatttaaaagaggggtcatgggaattccatgttggatagggaaagaaatgatgactgagggaaagcttgagaaggacagactagagaaatcaagggtctgatggagttaaaagaaaagatgaagtagaagtgggagaggcagaaagccatgagaaagccatgccatcagagtgggtgtgtgaatttatgatttcagacgggaaacagtgcccagtaatgacatatccaaggtgcagccagggaagggagtgtctgaagcacatggaaatgaaggtcattaaggaggtcatggcaatgagcttccaggggttaggatggctcatccacactggtgacaggaggactagaggtagggaagaagactgtgagtccagggctgaagtttcaaggaatcgaggagtgggcaggaggtcaaggaaagtcaagggtgaggttggggtaaacattgatgactgcctgataaatctctaatgaacacatggatgcatgaatcagtgaataagtgagcaaatgaatgcattaattcagactaatctggcacattctgggaatgcctagtcataaatcttgagattcccaaagaaaacaccaggctcagagaaggcagattactaggagtgtagaggcctcaggttatcgtaagagttgaagatgagcaaatcttttcagcctatcctatctgagaagctgtttgcactctccagaacagcccatgttcagtacggtagctattagctccttgcagtattcagaacctgaaatacggctagtccaaattcagatgtgatgtccaagtaaaatacacactggattttgaagacttagtacaaaaaaagaacataaaatatctcatcttgaactattgattacaagttaaaatacaaaatttttggatctatggggtaaaataaaatattattaattaatttcacttgctttatcaattgatttatttttactttttacatgaggctactagaaaattttaaattgcatatgtggttcacaacatatttcttttgggcagcactgtcccaggcgttggtcggtagcctctgtaatcctgaagaaagcactatgccgccccaatatttgcacatgttcaaccaataagttaataaatgcagccactctgttggaattccacatatatttgttgtcataagtaaaattttagccctcaagggcttaaatttcttatagactggaaatgtccctttaagagagcatcttaagtctctcaaagtattgcaaaacctcccacttgctccattacataggttctgcaccctggaaaccatggtagtgatggatgcaggtgctcatacttggcttcattgttagcacagctggaatgaattgagggaatcgtctctcttcttgggatatttctgaaacaatgaggctggagactgtgcagattgcacttgtaattttcctctgactggggaagcctaaggctccactccttcggccaagtctccttggaacctgtagttattggcttgcttagtaatactcattacaatttggagggcaggagctctattttagccagaaattgtggaagaagatcctacatcagccacgtctggagctgcttttctgcccaaatccaaaaatgtaatagtaaacattgagagtttatactgggtcaggcacaatgaggaaactgaggccccaagagcttaggcaacctgagagattccacaggtaaaaagtggcagagccaggatttcaactcagttggtctaactccaaagcttgtgatccttatatcaccctacaccttccaacacggctgattatggaccaggaaacaaaaagagggaagcctcacttaactggccgcagaaaaagcctctgaaagaacatagatcagttgggctgacacattgtgcccacactgtgcactgaacagcccagttgagactggatcctttagcagaggttcccaaaccgtgcattggaataagtaagtgtttaagggcctcattccagggctgctaaatcagaactctgggagtagggcctagaaatttgtattttgaaagcattttcccagtggagataagggaaccgttacccttgattaggatctgatttggaacttggacttctggataactcatggtacaaaatggaaggagggtacaaggagggttttacttaagctacatcaaaggagggggcctgacctcgggagcgcctttggtagatccaccatttgtgcactaatttctaagcagcttcccaaccttcagattgctgggcctctgtttcatctcaaagggataagtgctgttgcctgaaggcaggcagacattgccacctctagaactaagggtaagtagtgggaaggccacaatactaactctctccttcttcctcctattagcctttcagtgttatgatgtacccagctggtccaggatctggtgactccccagaaggcttccctgaacaaccaaggctccagccacaaactggaaatcgtgcaactcagacactgggtactgaaactgggtgcattgtccagtccctccttcagagcctgtttggggtagaagattgggggagggggactggggaagagagactcaaagaggtcgcaggtggcacagaagtgatggcagaactggccttcatttagtgacatatgctttgttcaaccagtcagtaaaggcttatgtggtggctagtagtgctagcgaatgcagattcggccgcttgcaaaaccaacgagcaaggtcgtggtatggtagaaggagactgactttattataaaccaaagctagcagtggggaaaaacgatccaggcttttgctttaatggagctgcttcacatttccaagcaaaatgcgaggctttaagaagttttggcatggagggtatgcaaggggtgaggcagtgcaggtcttcatgacgagttctgatgacttgtcttgagttactgcccatctggtgaatgggctggcatcatctcgggctgggctgagttataaattaactgtagccttgaatcaatctcctggtggagatttccacagatgcctatattgtttcaagatttagtctctggaacttttaagcgaacatacaattagatatgctaacagtgtgtatggggggtgctggggtgtcggggggtgcctagtggttaactgaacaaaaataaagaaatagaagtatataacaagaatataacttccaagctgggtacttggttacaataggtgcttggattgtattagagatacctcaaagtgagcaaacaaccagccagaactggtccctggccttgtggaagtttctctcttctgtctctctcctctctcccttctctctctcctctctttgtcctctctcctttctttcttgacttccttaccaatgggaaaccctgtttttctagattagggaaaagaaggcccgtttagaaagtagggaaggagacaaagtcttacttcctgaagcaaggtaggactcaatttgtgacctagaatctgagacagggaagtagaggcaggaaaacgggggaaatgggggaataactcgcttcctttctgggtcgagaagggctagaagtcaaggttcagtggagccttagagaaagtccagctcttcattttacaggtgaggaaactgaggggcggagaggctatagtgtggtaacaaggtggacacctagtcagctgcagaagtgggaataaactgtggcctttgaataacactatggggcctccagtgaggcgctcaattttaattcgggacgcctgggtggcagccgggtgctaggggaggctagttgccatgggaaccggctcctcccacttcctgcgtgcgcacccgtagacctgcgctcccaataaagttgttgttgaagcgcggcggcggcaccacgtgggccggaccgggccgggggcggggccgagctgagggaggacctgctggctgcagtgaggagcggaggcgggcgcgggcggccggccatgatcgcgtcgtgcttgtgttacctgctgctgccggccacgcgcctcttccgcgccctctcaggtaccggccaggcgtaccgacagacaggagcccggccagggcccgcctctgcggggctccgcgggcctggggcggcgtgcggttggccgggcctcacgactaccgtgccccgggcagtgccgaggtgtagggaggcggtcctgagcccctgccccgcgggcccctcctgacgccacgaggcctggacctggccgacgtccctcgtgggcggcccctcctcccgcctgttgtcagatggcgtccagccgcggttaaggtggagaggagctgtggacgggcagggccctttcctggccctgggggtgcagagaaattgtggggtcggccaagtcagcaccccggcgggtcgggaaggggtagtagctcggacctaggcgagtgcccaaattctcagcgggcgaggcgggtcggctctgggaggtttatggccgaagtactggacgcaccgatcttccccaggttaacttcacactcgcctttcactgccacctggcagctctcgctcaccggtgtctttggttgaaaaacggacgttcaatcagagacacatttagatctcagctttggagcattcctgcccccactcccggcggtttagagggagatgtgctggggtgggggcaatgcccagtcgatacctcaaagagggggtgtttatttcgttattgtttcataatttgtctgcattctctatttctgggctttgaaattacggagggttttatgcgaccatcagtttctgagatcccatggaactcgcagactttttgcctttaatttatgggacaggaccaagaagtacttaggaatgagggctccaattgtatattctgtggttttcctttgtggaactttacacaattggtacgcaatgtgtgtgtcattgataatatatatttcatatagaaatattttaaattttactgtgtatctgccattagaatgcaaacttcaggagcgcagggccacgtccattttgttcgctgtatctctggtgttaacacattgcttggtatacagtaggcactcagtgaattcaggaatgtcttgtgtgtccatacttctgaggaatgtggraaactccacagaagtaattgtttccagagaactaaacatattcttttaactatgttgctgtttttcctggagctcttctaatgccttagtgatacagtatactagtccagaggtttccagaccagtagagttctagggatctcagaggagggcccccccccccccccacctacacattacagtagtcccacttatatttacttggcatatttggtttccagataagatttttaaaaaacaaaagcattctgctgctgaaaatccaccaccaccaccaccaaaagacatctaccaaaattgaaagctagtaacttcgtgcatatgaaccaaagaacctctgccatctggtatacacagaggatatttcaaggggcagataatcaggaagtccttgaggctaaagctcaacgacccagcccatacataggtttagagcagggtttctcaatctcagcactgttgacgttttggaccggatcatttggtgtgggtctgtcctgtgaattgttggaagttcagcagcgtctctgtcctctaaccactagatgccagtagcaatgctgcagttgtgacaacaacagtgtctctgaacgttgctaaatgtcttccgagggcaaaatcaccgtggttaaaaccattgtttagaaggacataaatatacatagaccccaaacaagatatttgaaccgtctttcaatatttgagccacttttaaggtttcttccctttaaaaaaaaattgccaataaaatgagtctagtgattgagggccagcatcgtgcatgttactcgtcctgtgctgtaaataaatggttgagtgtgtgagtgtaggagttgtttgctctcaccaaaatactgtgctcagagtttgggggctctaattttagagtttttcccactttctttcttgcctgttggctgtcattggtggctgcagtatcagagagatgtcagctgtctcttactgtcgattgttggcaccttgtaatttatagcctctgatgtgttgtggaatgggaaagcagataatgaagtttgtgaagattttattacaataagtagctttgagaaaaggcttaagggcccttgctaagatgtaaattgtatagatttttgagactgtctactttaggactttttcttttggaatacattaatagattagggaatttatacagctagaaaagctcagagattatctagttcaaacttgtctctatttttttaaatttaaaatttatttttttcttttcttttctttttttttttgagatgaggtctcactttgtctcccaggcgggagtgcagaagggcagtcatagctcactgcagcgtcaacctgggctcaagcaatcctctcatttcagcctcccaagtagctaggaccatgggcatgtgccaccgtacttggctaatttttaattttttgtagagatgaagtttcgttatgttgcccaggctggtctctaactcctggcctcaagtgatcctgctgcctctgtctctgcctcccaaastgctgggagccaccacgcctggcctcttgtccccattttacagtcaagagtaacttcatctgactaggggcattgttcaaggtcagttttattaattttggtgctagatcataacccacagttctgattaacagtcagttgctggttgcaatgtaatgtgattcttagaaccaaagagtttgttaatagtagtcttaactaagtcatgtaaaaggagtgtgggtatatgtgcccatctgtgttctagattatgtgagacagctgttctttcatgcactgaatatttatcagatccctgccatataaattagtcaacacttgtaaagaacagtgcctggcacatagtgaatactttgccctgatgatgatgatgatgttcaggcattaaggtaggcaggctcagtgatggtacaatgatgagcaaggtggatatgggtcttgcttttattgggcttatgttttagctgggagaatagtgtgggttggatgacagtcttataacctggtattttggctttcctcctagatgctttcttcacatgtcgaaaaaatgtccttctggcgaacagctcatccccccaggtagagggcgactttgccatggcccctcggggccctgagcaggaggaatgtgagggcctgctgcagcagtggcgagaagaagggttgagccaggtgctctcaactgcaagtgaggggccccttatagataaaggactagcccagagcagcctggcacttctgatggataatcctggagaagagaatgctgcttcagaggacaggtggtccagcaggcagctgagtgaccttcgggctgcagagaacctggatgagcctttccctgagatgctaggagaggagccactgctggaggtggagkgggtggagggctccatgtgggcagctatccccatgcagtcggagccccagtatgcagactgtgctgccctcccagtgggtgccctggccacagagcagtgggaagaggacccagcggtgttggcctggagcatagcacctgagcctgtgccccaggaagaggcttccatctggccctttgagggcctggggcagttgcagcctcccgcagtggaaataccatatcatggtgagtctgacaactggttgagtgagccaagggaacagggtgtctcaggtgtgggcagagccattgctaaagagaagattctatggtagggagctctgccactgcattctatttttctaagaatcttggcatgtcagatctagagggtccttacagatcatctcatccagccccatggttttaaaggtgaaataatcagagtgcagagaggtagtagaacatgactaaagtcataaagccaggtaggggaagaactgaaagcatactctagttctgattctccacaatgtcatttctctggtggtaaccctagggctttctggaggtagggatagagaggtctcagggcctctagtctctgtctcagtcacaattacctcagttttatttgtgttgtatattgagagtccyttaaaatttgaagaatggcgtcaatagatttgaaatccactatgctgccacatgccataggggagatggggacacaccatagtttctagtcccacagactcttccaggtttaggggtcagaaaacacccagggctgcaattactctaaaaatgtctttaacctcaggtgactgttaagcacactcatctgagtgattctccggagattcatggatttatcaaaaatgagagtgtktcagcttccatatatggagcatctattagatgctaggtgctggggatgtagtggtgagcaggccaagattgtctctggccttgtggagctaaccatgtcatctgaagaatgtccatagaaatcaattccccacagagagggatgggtgacagggaagatggaaaaaggaacttcaggcataatattactgagtcaggagtggagatggcagcacctctgcattactcatacttgccattgagtgcttctcccaatcctttgcagaaattttgtggcgagaatgggaggatttctccacccagccagatgctcagggcctgaaggcaggagatggccctcagttccagttcactctgatgtcttataacatcctggctcaggacctgatgcagcagagctcagagctctatctacattgccatccagacatcctcaattggaactatcgcttcgtgaacctcatgcaggaattccagcactgggaccctgatgtgagtgaagagggggaattgccatcttgcattgttgstggacctgggctgttgcccagtgctcttagaagatgagttcaacccatagttgttcaaatgattggagtcctatctagggctggagcttgcctgcctggtgtcagtgagttgttggcagatgctgagaagaatctccctagatgtgcacttcccagcacctttatgcaggaagggaggcttgagggattcaaggagcaggaaaatccantgcacatctctaatctcttcagcttaagtctgggcctgttcttgctgttggtgactctgggaagtttcagtgtgacccagcagcttcccacctggcctcaggacctgctcctagagggtgggggtcacattccagcactctggagtgattgggtttcttgtcaatttcccagatcctgtgtctccaggaagtccaggaagatcattactgggagcagctggaaccctctctgcgaatgatgggtaatgcagctccctgggatgcttgccagcttttctttccacagacttgtctactctctcctgaagaccccatcctttccttttgtcttagtaaaccctcagtttcacctgtgagctagctccttccatgtgtgcctgagaaagtagaattctgcagttttatagcaattctgacatacattgctatttgatccttgaagtaaccaatgtggtgagactgttattcccattttacagatgaggaaactgaagttctgaaaactcatgtgacttcctcagaatcacaaagctacaaagctagtagatgtggagctaggaatccagcttgtctgactctagattctgtgctcttttctatcatgttacattgcttcatacccttccctccttgcccttccagcccctcagtcagctggttacgatgtaagggggaacctgctgaaccaaggaagtggcaaaggctcctttactgagtagcaggaacaatgcctcaggggcatacactgggactgctggtgctggttggaagggattcaggctttaaggactctgacccatctctttggtgggattttccttgcaggctttacctgtttctacaagaggaggactgggtgtaaaaccgatggctgtgctgtctgctacaagcctaccagattccgcctgctctgtgctagccctgtggagtacttccggcctggcttggagctacttaatcgggataatgtgggcttagtgttgctactgcaaccactcgtcccagaaggcctgggacaagtctcggtggccccgctgtgtgtggcaaatacccatatcctttacaacccacgccggggcgatgtcaagctggcccagatggccattctcctggcggaagtggacaaggtggccagactgtcagatggcagccactgccccatcatcttgtgcggggacctaaattctgtccctgattcacctctctacaacttcatcagggatggagagctccagtaccatgggatgccagcctggaaggtgaaatgggagaggccacggtgtgggtgggaacatggtctaagagagattcaggcgttagcatcagtgcttcttctgtggcagggacctcagtacacctgctctggcctgctcctcctttttcttgttatgttgaatagcttgtacccaagcctggaagttaagaattcttgagtacttcggcatattggaatttttttcagtttttatcattaatatttttaattcacaagtaatacgtaagtacatacttgaaggaacttaaacattatacagtaagacacaggcctgttttattacccacattccctattctattctcttagagtaacataatgaccgttctaagtttggtggtagtcttttagcttgttttctttgcatttacagtgatatctatgttcctatgatattgtaatcagtgtttacatttgttaagcacttaagtgtgtgccatgtgctattttaagcactttatactcattaactaattagttttcacagtttccatcatggcttccattttataaatgaggaaactaaagctcagaaaagtgaagtaatttgccctaggttatgcgggtagttagtggtggagccaggatttgtaaccaggtggtctggctgcagagctcttaccctcaaatactgtgctgtcattgcttataacagccaatatgtaatctaccatgtgtgttttataaacatgatacactactgtatgtttcatttgtagcttgttttttttcactcagcaatttgcatatggatctcattccttctaactgttgagtgttgatgacaaacacctcgtagttttatcagcttgtgctgatttctttatgtcacttaatctccttgttcctctattttgcccctactgtttcaatttattgactaacttttggcaaggcacaatggtggaaggacacaaaacgattgtattactgttgcgcacatgggattttatgtaaatgagccagatgtgtgcagagaaaggcatgatcttgccctaaaggagctgtaatcaaggaactcagggaacgaggaaaagaatttactgactgcctgccacatgacaggcactgttaggcatagtgaatgagagcacttgctttgaagccagacagtcctgagttcagatccgtgctctgccaccttgagcaaattacttaacttttttgaaccccatttgcctcatctatacgatgggggatataatgggacctgcctcagaggtgtttttttgggtggattaaataaaataatgcgtgtaaagtgttttccagtatctggctcaaagtcagtaaccggtagtgattattaagattcttaatygtacatggtattattatcccattttatttatttatttatttatttatttatttatttattwattttttgagacagagtctcgctctgttgcccaggctggagtgcaatggcacgatctcggctcactgcaacctctgcctcctgggttcatgtgattctcctgcctcagcctcccaagtagctgggattacaggtgtgtgccaccatgctcggctgatttttgtatgtttagtagagacggggtttcgccaygttggccaggctggtctcgaactcctgaactcaggtgatccacctacctcagcctcccaaagtgctaggattacaggcgtgagccactgcgcctggcctatcccattttatagtaggagatattgaacccaagagagttaactaacttgccaaaagtcacacagctattaagtggccattgaattgcagatctgttttacttctgatgacatattgaaaatttatgcccttacagggcaaggggattctgtctattgctgctctatccccagcacctagctagtgtcttttggctttcaaatatttgttgttgttaaatggcataaagggacttttgctacacacgttggagatgtgcagatgactgatgttgccgaatgtttcccctactacgttttgtccgttcccaggctgctcattggctttgaccgaggatggtgacgtagatacggtaaagtgctttggtgctttcccatttggtttgaccctgtggttacccagtaataggttcaggatattagaccttgatccagaagatccaaagatgaggataaacctttaaccattgcaacttaaagcccctgagagttgatattccctgtggaggagaattgtattgatttttcagaggtaaaatttagggaaccacatgttcatactattcgattccccttgattcagtctcttacccctcctcctgtttcatggacatttcagtgttgccagtgaaaaagtaatggttttaatttggtccttatttttaacctgcccctgagacttatatgcttgtttataccatgtacgtagtgtgtgattgtatgtgtttgtatttgtccacatgtcccaaaacatgggctgttacttcctttttctatcttggtttccttattcccacccttctttttccacccaggtatctggacaggaagacttctcccatcagctttaccagaggaagctgcaggccccactgtggcccagctccctgggcatcactgattgctgtcagtatgtcacctcctgtcaccccaagagatcaggtgagcacatgtcacattcttggttggctgtgtcttcatgcccattttgggagaaagctggtgtctcaacgacaagaaaaagtgtaatccctcatttctcttagcagattcctctgttttctcactatcctcccaatggctgtccaatgaaatggacaactttaaatcatagcctttggaaaatctccttgtcttctgaatgcttcctctgtgtacctatgctggaagttgcttggtactaaggaggtctcagcatgtggcttcatcgtctttctttcactatatgtcttttcctggtttacagagagacgcaagtatggccgagacttcctgctacgttkccgcttctgcagcatcgcttgtcagcgaccagtaggactggtccttatggaaggagtgacagatactaagccaggtaatgggaactaatcccagtttcttggtcttctttcttcctcattcctgatattggtcagttatgtggtttcctgctcttttctaagtataattcttagagattagcttctggtaatacgtatatttagaaggaaggttagttgagttcagtggccattgcatggatgtgcagtgtgataagagngccggaccaggaatcaagacacctgggttgtaactagctttgagagcttgggtaagccatttaacctttttaagcttaagttgctaatgactagcatgtgtacagcatatataggggagaagttacacatgatggggctttgaaaatcataaggtgacagtggttctgattttaataaaagttgttcctactgagaaatttcagattgaatatagcagagtatacttgacattctccccttcttgtctctgaaaccacttcaaagcaacaaggagaatggaaaaaagaaatgtaaactccattgtagacaaaactgggaaatttgaagatatctgacaccaagaaccacaacacagaaggaatgcctgcaagaagcactggagatcgtgcaggggtgctagaggaagtatagagagacttatctgtggggatatgtggatctcagaactagctgagtacttttttccatgtggagcataaaacccaaatcccttttttttttttcaacaagagtagaaagcacaggtcatgataggagagtctctggacccgttttgatcctaagaggcagtggaggagggactgatcaaggatcaagccatatttccattaagcaatctgttcaagtggtagagagggtagatgagatacttgtagagctgcctatctcttttggcttgggagagagaaagatttaaaaggatgctgacataaccctgtgtcaaaaagaaaattcccgttacttgaaatacccagtccttcccttatataaactttgtacaaatagctggtgcagaaaaaccttaactaattcaaagctggttgtcaaaaaaggaaaagcatggaatctgtgctaaaatactgcaagaaaaaaggaacagaaaaataaaaggcagataaagaatgtttaacttcaaagataaaaataattgccatggagctcatagaaattacgattactttctcatgaataaagaaattgtctttattttttattttattttatttttttttgagatagagtctcactctgtcaccaggctggagtgcagtggcaccatctcggctcactacaacctctgcctcctgggttcaagcaattctcttgcctcagcctcccgagtagctgggactgcaggcacatgctgccacgcctggctaattttttttttttctttttttgtattttagtagagacaggggtttcactatgttgtccaggctggtctcgaactcctgacctcaggcagtctgcctgccttggcctcccaaagtgctaggattacaggcgtgagccaccgcgctgggccaagaaattgtctttatgaaagaaagagcacaaaaataaaatggctgcctttataaaataagttcaggcatgtggcaagacatcagaagatgaaatgtaagctgcagagctcagaaaagaagtggaataaaaaataaaaacattacaaaaaataaagacaaaattgtatgcagcacaagtaggaatagataactgtggaaaacaaggtaaggaaatccaaacaaaacaaataaaaaaaacagtgagaagttaaaggttagaaaggattagagagaaaatgacagtagtgaaagataaaggagatttaacttatacataattggagttcccaaagaagaaagcctataatataataacacagaagaaatatttaaagataattatccaagaaagattttcccaaaacgaaaagatgtgaattttcagatcgagaagacatgtgtctcagtaaaaaatgatacaggagccaggcaccctggctcacacctatagtcccagcatcttgggagaccaaggcagaaggattgctygagcccaggagtttgagaccagcctgggcaacaaagtgagacaccgtctctacaaaaaaatcaaaaaattagccaggcatggtgatgcatgcctgtggtcctagctacacaggaggctgaggcaagaggattgcttgagcccagaaggtcaaggctgcagtgagccatgttcgtaccattgcactccagcttgggtgacagagtgagactgtgtctcaaaaaaaaaaaaaaaagatgtaggagaattaatactaagacattccagtgaggttcctagaagtcaaagatgaaagaatcttttgggcagttaaaagattgaggtactttgaagcctaacggtgatgaggttgacctcagacttttttttttttttgagacaaagtcttgctttgtcatccagactggagtgtagtggtgtgatcgtgcctcactgcaacatctgcctcctgggtttgagtaattctcctgcctcagcctccccaatagctggggctctgggcatgcgccagcatgcacggctaatttttttgtatttttagtagagacagggtttcaccatgttggccgggctggtctcaaactcctgacctcaggagatctgcccacctcatcctcccaaagtgctgggattacaggtgtgagccagtgcactcagaagacttcggacttcttmatattgacatccaactctagaagacagtggattaaggtttctaggaaaggatatatagttcaagaatattatactcaactaacaacatttcttcaagaaactgctagaggagtaactgaaggcaatggctgggaaaactatagtgaaaggactgctgatgaacactgaatttattctcttcttgtaagaatttaacttgaattggcattttgcacagagcaacaaatatgtcagtggcccagtttattttaattgcaaagtcaaagtattattacagctatggcagtagcaatagtgataacaatgatggccaccctgtattgagtgaaccagcaggtagcaggaattgggttaagtaaattctgtgtcagtcaggttcagccaggggagccgtagctcagtgatttaggattataaaaacagtaacaggatctcacttagataatttcatagtaagaataggttatttaaatcagtgatgtacttgaatgaaacataaaataaatagtaacaaaattaaaccaagacctttaaaatatatactgacaatcactttgtaggtagaaaagactcattctataggggcaaagtagccagttcaccagcggtgcaaaataacagtattttcaaaattgagattagatttgggtaaacatacttattctccacatactttgaatgtacccttctatttgttcaatgctcctacccagggctgaacaggctcttgatgaatctcaaatctaatttttttttttttttttttcatgacagagtctcactgtttcacccaggctggagtgcagtggtacagtcatggctcactgtgtagccttgatctcctaggctcgtgtgatcctcccacctcaaccttccgagtagctgggactataggcacatgataccatgcccagctaatttttgtattttgtagagactgggtttcaccatcttgcccaggctggtcccgaactcttgagctcaagccatcctcctggctcgacctctcaaagtgctagaattacaggagtgagccaccatgcccagccaactatctttattttaaaagggccatgaatgggccgggcgcggtggctcacgcctgtaatcccagcactttgggaggctgaggcgggcggatcatgaggtcaggagatcgagaccatcttggctaacatggtgaaaccctgtctctactaaaaatacaaaagattagccaggtgtggtggcgggcgcctgtagtcccagctactcgggaggctgaggcaggagaatggtgtgaacgcgggaggcagagcttgcagtgagccgagattacaccgctgtactccagcctgggcgacagagcaagactgtgtctcaaaaaaaaaaaaaaaaaaaaaaaaaaaaaaaggaggccatgaatggagtacaacgagatcttagtgtgtgagttcatttttctagaggctctgattagatatgctaacaatatttccagttcagtaccagaatcatccaacccaactgtgcatttcaaaccatgacaacttaactgtgacactagcttgaatggggagcctctgagtacaaaggaagattcagtgctaggtagtgatggtttgattttcccataagctgacattgcattgtactggagcattctgtgccatccaatgtgtataataaaatacattgtgattcttactatttccaactccctttgtttttttttttttttttttgagacagagtctcactctatcactcaggctagagtgccgtgacacagtcttggcttactgcagcctttgcccccgggttcaggcaattctcgtgcctcagcctccccagtagctgggattacagacatgcgacaccatgcccagctagtttttgtatttttagtagaaacggggtttcaccacgttggccaggctggtcttgaactcctggcctcaaatgatccacccacctcggcctcccaaagtgctgggattacaggtgtgaaccaccaggcccagctcccaaccccctttgtaatggaataatttgtaaaaagggtatttaatttttaagtctccctcattgtcagcatttctattataaatgatttcttttttccagtatggttcttaaagatattgtcttagtccatttgggctgctgtaacaagataccataaactggatagcttttaaacaatagaaatttatttctcatggttctggaggccaggaagttgaagagcaaggcactggcagaggctgggtacagtggttcacacctgtaatcccagtactttggaaggctgaggtggaaggattacttgaggccaggagtttgagaccagcctgagcaacatagcaaaaccccatctctacagaaaattcaaaaagattagctgggcgtggtggcatgcgactgtagccttagctactcaggaggctgaggtgggaggatcacttgagcccagaagtttgaagttacagtgagttatgattgccctactgcactcccgcctgggcaacagagaccctgtctttaaaaaaaaaaaaaaaaaggcactggcaaatttagtgtctggtgagggcctggttcctggttcatgagcatcatcttctcagtggtagaagaggaagaggaaaggggtctcttgggcatcttttataagagcactaatcctatccatgaggactccacacttgtgacctaatcacctcccaaggtgccacttcatcaccgtgggggttaggatttcaacatatgaatttgattgtggggacacaaacatttagaccatagcagacattaaaaggaattactgtgttttctttctcatagacactggcacattacactgaatcttggggctttaagtcttttaacaagtaagagcaaaccatgtgcacaatttagcacattacagaaaaggcaattgctaatgggcgatttttgtaaactcctagttaacaaactgaccggaaggtcacacagtcacacagcaaaggctaaggctatctggtcagttctctttcacacagtcacacagcaaaggctaaggctatctggtcagttttctttttttttcgagacggagtctcactctgtcacccgggctggagtgcattggcgcgatctcagctcactgcaatctctgtctcctgggttcaagtgattctcctgcctcagcctcctgagtagctgggattacaggtgcatgccaccacacccagctaattttttgtagtcttagtagagatagggtttcaccatgttggccaggctggtcttgaatcctggcctcaagtgatcccccggcttcggcctcccaaagtgctaggattacaggtgtgagccactgtgtctggcctatctggtcagttttctaagcagaaaagttctttttagcttgtttgtttttnaacaagcctacayctaacatcataaagagcaggaaagtcctaaatccagcttctttactggctgttgtgtgatacaactgaggatcctcttcccaagttcttgcagaggaacttgcatgcgtggctgctactattgctgaatgggcccaggaagaggctgtagctcatgtagaggtagcagcttatgtgacctggagcagagtaggtggaagccttgagtcctgtataactgccagagcagtgctgtttgttcacagtgctgcatggtaagaatggtgtctagggaaatcatgtttaagatcctgcaggtcactgtgattttgtgtgtgtgtgtgtgtggcatattgtaatgacaaaggatgtaacttaaagatactagtgttaaaaatgtttatgctccaaataacattgcatcaacaatcacaaagtgaaaccataggctgtaacatggagtaatagacaataactaaaggtagaaggctttaattgatctttctgagtctgcagcagatcaagtagataaaagatgactaagaatatagaataactaagtaacatgtcggatgataaatctgattcatatatatcaaacaccgaacattgacagcagagaagacattttctttttaagtattcataggaaattcttaggaattgatcatatgttagatcataaagcacatgcaataaacatataagttaaaagtgaaaagctgggcacagtggctcatgcctgtaatccagaactttgggagactgaggcaagtgattcccttgagtcctggagttcgaaataagcctgtgcaatgtggcaaaaccctgtctctacacaaaatggaaaaatagaaaaattagcctggcgtagtggcatgtgcctatactcccagctaccgagaggctaaggtaaaaggataacttgagcccggaaggtcaaggctgcagtgagctgtgatcacacccctgcctgagtgacagagtgagaccctatctcaaaaaaaaaaaaagaaaaagaaaaagaaaaaaaatactatgaactggacatttaaaaaactttttgatcaaagaggaaaatttaaacggaaattgtggaatatctagaaaataacaataatgaaaataccattatatttgttggttatagctaaaatggtgttcaagaaaaaattcatagaattacataaaatatttagaatcatagagttatattaatagatatgaagggatgaaagtgagttaagcacccaattcaagaaattagaaaaaagaaagaaactgaaagaaagcaaaaggaaagaagattcaaatggaaataattttaaaaacagaaaaatggaagaactcataaattcttaagagttggttgcttggatgaaaaatagctgttgattaaagaagctcattagctaacctatgtaagtgggaaaagagcaggaacaagcatccagatgcagcggaatcaagaatcacaagggttttttgttgtttttgctcaactaagtgcaaaagaaatggaaaatttggatggcatataaatgtaatttactaaaactgattcccatggagattgtctaaatagactaatgaccatggggtgaaaaataataggaaaagttctcagagatacagtccctcagaaacaccaggctcagattgatagggaatgtcctcaaacctttaaaaaacatatatttccattattgtttaaattgttacaaagcacagagagagaaaggggccaggttatttttatgaaacaagtataatattgacactgacacctgacagtaaacacacagaaagagagaactgcagactctaatgttctccacctgtgaatattgatgcaaaaaattttacatagaagatcaggaaacaaaatctagcagcatattgaaagaccaatataccatagaccaactgaagtttagtagaagtatagggatagttcaatattgggatatctattaatataattttatatatatgtgaaatctaaaatacatgaaacttgtgccatcctctgtatagatgttgaagagacatctgttaacattcaacatctattcttgattcttttaaaatgaaccctcttaagaaaaaaatggataatttcctacaccattgaaatgtatttatttcaactccaaacagcatcttgattaaagaaaaaaactctaatagcattcctgttaaagttaggaacaagacaaggacaagactatcataatttaactgtgtttggagataccagccaacagaattagaagtagaaaatagaaatatagcaaaatagaaggataaaaatggaaaggagggggtaaattattacttgctgatgatattattttataactggtaatccaagagaataaactaagcagcattaagcattaagataattctggaaggtagataggtacaaaattaatgtgcagaacttagtagtgttcctatatagaaatacatgtttattaaaagatataatgaaaaaaatacactgtgtaagagcaacaaaaagaaaaaatatagaaataaatctaacaggaagaatataaggcatataaaagggcattcctttcttttttttttttgagatggagtctcgctccgttgcccacgctggagtgcagtggcatgatctcggctcactgcaacctctgcctcccatgttcaagcgattcttctgcctcagcctcccgagtagctgggattacaggcacccaccaccacgcctggctgattttttgtatttttagtagagacggggtttcactgtattagccaggatggtctcgatctcctgacctcatgatgcgtccgccccagccttccaaagtgctgggattacaggcgtgagccactgcgcctggcctaaaggggtatttcatttcatctaaattatcagatatattggcgtgaagttgttcgtaacattcccatatccttttttttgaacagctttattgagatgaaattcacatgtcataaaatccacccattttaagtgtataattaattggcttttagtatattccgggttgtgtgaccatcaccatgatctaattttagaacattttcatcacccacaaacgaaaccttacacccatgagtcactttccatttacttctccccttgtcaaaaatcaattgaccatagatgtatggatttctggactctcagttctgttcccttcctgtctgtatctgtccttatgccagaaccacactgtcttggttactatagttttgtatatagtagtccgccttctcagtgattttgccttctttggtttcagttacccctggtcaactgaggttcaaaaaccttaagatactttgagggagagagcgaccacattcacataccttattacaatatattgttataatttttctattttattattattgttaatcttttactgtacataatttataaagtcagctttatcataggtatgtttaggaaaaaaacagtatatttaggatttggtagtatccattgtttcaggcatccgctgggggactcggtatgtatcccccatggataagatagattactgtacttttgaaataaggacgagtaagtcctctgactttgttgtttttaagatgatttttgtctcttctgggtctcttgcattcccgtatgaaatttaggatcatcatatccgtgtctgcaaaaaaagacaaaaaaaaaaaaaaccaaaaaaaccaaccagttgggattttgataggcatctacaaatctttcctttccttttttcctcctccttttctcctcctctcccctttcctccctcttcttccttctcctcccctcctcctcctcctcccctctcctctttccttttatcccctctcccctcctctcccctctcctctttcccctctcctctttctcctctcctctttcccgtctcccctttcctttccttctttcctttctgtgacaaggactcagtctgttgcctagggaagtattgccattttaacaatattgtcttatggccaatgaacatgggctggttttccttatttagatctttagtttctttccaagttttgtaatttttagtgtgcctacactttttattaaatttttcctaattatttcatttttgatgctattgtagatggaattttctttatttcatatttggattgttcattgctagtgtatagaagtatttttgtgtattgatcgtgtacctgcaatcttgctgaattcatttattagttctaatagtttcttagtggatttcttaggattttctctatataagatcatgtcatcttacaaatagaaatagtattccttctactccaatctggataccttttatttctttttctttcataattactctgactaaaacttttggtacaatgtcaaatagaagaggtgagaacagacaccctttccttgttcctgatcttaggggtaaagcgttcagtctttcaccattaagtatgatattagctgtgagtttttcatagattctctttatcagattgagaaagttttcttctattcctagttttttgagtgtttttaactcatgaaagggtgttggagtgtgtcaaatgtttttcttctgtctgtttagataatcatgtggcttttttttaaacttaagtattctattgcgacatatcacattatatgatttttcagatgttaaaccatgcttacattcctaggataaatcttatttggtcatagtatataattttatattttgctggatttggtttgctgatattttattgaggaattttgcatctgtattcataagggatattggtctatagtttttgttgtgacattttatctagttttgatgtcagagtaatgcctcatagaatgagttgagaagtgtctcctcttttttttggaagtgtttgtgaaggatttgtatgaattcctcttgaaatgtttgctggaattcaccagtgaagccattgagcctggtgttttctttgtgggatgttttaaaattacagattcaatctctttatttattataggcctattcagattttcagttttttcttgagttattgtgcatagtttgtgtctttctaggaatttttcaattttatataagttatccaatttgttggtatccagttatttatagcattcacttatagttattttttatttctaaatggttggtggtgatggcccctctttcatttctgattttagtaatttgagtattctgttttcttggtctagctaagggcttgtcactgttgttgctgatccttattatcctgttaatgttggtaggatctgtactaatgtcccttctttctttcctgatattggtaatttgtatcttccttttttaacattcgtgtgtatgatatgtatgtgtgtgtgtgcttatagatgtatacatatatgtaatatgtatgtatatatacatgtatgcatacatgcatagacacacacaatggatggtatgtaatagaaagtctttgaaggaatataccaggaatttggtaacattggtggcttctggagaggggaattgagtggcagaggaggacaagtgagagggaaacttcactgatactttttgctacattttgattttgtaccatgtgactatatgacttatttttttttaatcaaattaaagaaaaacaaaggtgaggagccacagaagacaatgtctgtgttagatgccctacatctgctttctgaggttcttgactttggtttatggtcatcttctcctcctcactgtttctccctttctccttctggatccttctgaagcaatccagtcaaggatctgagagggattttagggtgaaaggttctgatcctgcttcactgtctgtggatgagaaaatgtttttctctctggtcctctgcagagcgacctgcgggttgggctgagtctgtccttgaggaagatgcatcggagcttgagcctgccttctccaggtaaccttctccagttctcttctgttttcaatccagcccttgcctaggtgtaagagagagattcccattggttgtcctgaggttgacttgggggagcactttttgataagctctttttcccctaatatctgctaaacttatagagggttatgtaggtatgcagaagccagaggtgacccacccatgttactgcaggtgaaaaggctatgtactctttcctcagagggtaaagcctcacagaagaggcctgggccccagacaggggtacattggggatactttaccaggtaacaagcagatagtgggggattaggagtgttagggagtctcagtacaaatgtgtgtttctaggctaattttagctaagactgccagccccttcttagcatggggaggaattggctgagattgagtcatctgagatcatccttttaaaaaatcttcataaaacccatagaaaaagtgatctagggaaaatttagtaatttttgttaactaatgtttcccccttcatccctgtaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactggtaagcctgatggatcctgggttcctccacccccaggtccctgggaacagctaatggtaggtcaggcatttggtagcatgtcttcagctgctgggatttaaccagcaaaggagcagatttcatacctcccttgcactggtcatccttatcattctccccataggccacttgcctgccttgtctctttttacccttgcagcattaaagagaggagggtaggacagtcactcccaatccccattttagaggtaaaaatagagatctaggaattggttgagtttgtttaatgacagccactgaatgagggacttggttaggtaagagaccttattttctgtctcctctccccataccagtgggcacagtatagcaatctcccagccccatgcctgtattgtgtaaagaatgtttctttttggccaggcatgtgtattactgttatggccaggcacgtgtattactggttcacaccggtaatcccagcactctgggaggccgaggtgggtagatcacttgaggttaggagtgagaccagcctggccacaygatgaaaccccgtctctactaaaaatacaaaaaattagccgggtgtggtgacggtgtctgtaatcccagctgcttgggaggctgaggcaggagaatcgcttgaactcgggaggcagaggttacagtgagccgagatcgtgccactgcactccagcctgggcaacaagcgtaaaactccgtcttaaaaaaaaaaaaaaaaaaaattagccaggcatggtggcgggtacctataatcccagctactcaggaggctgaggcaggagaatcgcttgaacccgggggtcagaggttgcagtgagctgagattgcgccactgcactccagcctggacaacgaagtaagactccatctaaaaaaaaaaaaaaaaaaatcagattttatatagaaaagctggatctctagcttctcttggaaaatcaaaagatcttataatggtgggctctccagcttgccccagttccccggaactcacctgtctttattcgttgatgatattatggagtatctctgagaaaatggggcctcctcagccagatgctgcaagaggaggtgaggggcagtgggcagccaaggggatgcagcctgcagaaggcgttcccaaaggactctgccactgcctgcccatgcagtgtggctgcggctgcttttacccattggcttctgctttgtgccccagatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagcnggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacytaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcaytcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaatgttgttcattttattaggatcctgaagggattaggtccttgagagagggcctgaagaatgaggtgggcagaggaagagactaaggagcttttgatcttggggtggggtctcaagacatgaatctagattgagaaatgtgttgtaagatctccctctattagctgaggtaaattcccactgctgtgaggcctgggaggaacagggcttgagtgaagcctcctgccttgacactgctggggtacagctttcttctgtccttcccaagtgagagaatgattctttggactgcttttcattcttcctccatctgctccccccatgcctcctcctagtatcttctgcacttcaggagggtctgtgcaaagtgggataagatgtgtgttttcctgattaaagctatggcagctgcatgagacatgatgcgggtggcacatgcctcttgctgagcatctatttctgatctcttttgcattctggagcsagggctgagcagtgggccatctgtcgctggaaaaatgtctcttccttcctaggcctacctctgttggtgcttttgtcttccaacctccctatgtagtaagaccagccaagcccacatgcccactgggagccctgaaaccasatctggttttctgtcttacctgaacaggttcccagaacccacaccaggcctctgaatcagtctctgagaatctgattgatttaaagccacttggttgcttccattgcactacctgggttgcgatcccctcaattgatttagtaaaaagaaaacttagcggccgggtgcggtggctcacacctgtaatcccagcactttgggaggctgaggcgggtggatcacctgaggtcgagagttccagaccagcctgaccaacatgaakaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtaggtaagttacttaacctctctgtatttcagttcacattccttggtgaaatagaaattaaagttaataatcacttctacttgtgaagaattttcagatctgaaattgctttgtttgggctttggcaagaaaaaggtgctaagaattccagagaattattggtaggagttgggagtagatcgttaccccagccaggctggacagttgggcccattggctaggaagtatttgaaagccctaagctttgaggtatatccccaagaacctcttcctggcagggagggttcctcctagttgcctcagtcagttagcatctccacagcacttctgttaagtttgcacagtacttccacgtcagctagcaaagacagtggcactgtgtggtggcagtttaggtggtgttcagattctacctttacacctgaggaaacagaaatcccagagatagaatttgagaatctcctttggtttatttcttaccaccccaagtttctcacaagcctttccaggatcaggcaagacaggttatcttggaaggcagaggctggtggtgggggcctggggctgggggagctcagaggcagcttttaactggagaccaagaagggaaatggccagtcaggaggctgctgctttttttgttttgtttttctctccagttcctgccctgttgtagctactaactagaggaatgttctggttgttttgtttttcctttttaaaattgacatgtgatagttgtacatattttggggctgcatatggtattttgatacatgcgtacaaagtgtaatgaccagtcaggatatttaaggacatttatcacctcaagcatttatcttttccttgtgctgggaacattccaattcttctagctattttgaaatatacaataaattgttaactatagtctccctactgtactatcaaatactagaacttagtcctcaccatatttttgtaccatccacctgctcttcattctcctcccctgcttttcccagcttctggtaaccccattccgccctctattggagggttgtgttttgattggctgcgaaatgcacagtgtggcttctcttctcccaggagtgggaggggccacctctagggtccaccagggggagctgccctgcagccctgggctcccatcactctggtccatcccctctcctctccctcctgagcaaatgtgctagacaagactgttccaggtatgggccagccagatggcagcatggtggtgagggtgcagatctgctggaagcaagagaatgtggacttcatgggttgtggagggaactctgcacttctgtcccatccccagtcagctcctatgaccctaaggcctgaagcctcagctcgctgtggagagaacagagcctacacttaaaattcttggaggttttgtgcttccaacaaccaagtcctttcaggctcagggttggaaaaagtttgtatatctgtgtgcacattgtcatttggacggggctcagagaggtgacctgccagctgacctgacntggcctctcctcatcttctgccaggcctcaacagctggtcccctcaccttgctggcagacactaagggttacaggcagcctgcttctgggccattctgcttggttcttggtatgactgcttcctgtcactacctccacggtagtggtccaaatgccagctcctggtaaatggggcagcagagcttcaaccccttcatcgtcaggcctctgagaagggccacctgcacccaaaggtctaacccagttagtcaggtgcctaaattaggcaggtgcgtgctgtgagcctgaggaatgggacagcaggaaatgaggtaaccccttccacccccaagcaggtcgggttctgatcctccaggagtctgcaatgacatttccttctgctttctaagaaaatggccagtgtccacaaagagcctacctgactcattacgtagattctcaccccagcacttacttacccagcccctcatttgtacaagagcaggccaggggccccactgtgtatgaacctgtcttgttgaagcctgaggccctttacttggtatcatatcagctggacttaaatatgaaaattacaacactgcgtctatgaaagggtgtgcaatgcaaggtattcataaattctggttactttgaagtgctttttttgggtaatgctttagctggatttaaaggagcctgtaacaaaactgcctccgtttactggtgtacagtcccagatgtctatggattcctgcgggtcacctctccttttcctgctgccatgcctcctcctcccctggtcactaccacaccactgaaaatgagggggtcttggcggtgcgaagctacacttctagccacgatcttgtggggactggctgggatgaaaagtaagaaatacactgtttcctctctcacaggtctgggttttacccttaagctgaatgaaaggagagctgagacaagggcaggaagggttatgggtgaaatatgctgtgaaatccaaaagatattttctgtgcaagtctggtttcaactgtttgggcttgtctgaaagtgtgggaagaggtccagagctggagggacaacagagaggaagagtggggggtgacggatgggacccgaagtgttttccaccccatgggttctggatgtcaagtgatgagaaggttgctacggtttcctgagctacactcatctcccaggagaacatgccccatttctcctttgctcctgatggactgctgtggactgagacyggaagagcagggtcctggaatacatcctgggtgctaacttgagcctctggaggccaggcccactgtgtgaagagggggaaagcactgctcacagatcagggttaacaaggcctgaggggcttcagcaggctgaggaagtctggaaccccagaagtttcatcatgacygcaggsgctgggaggtttcctgttccctggcttcaggctcacctcaggtcaggctcttcccagagccaatggggctaatgccgctgggctgggggagggctcgggccccagctccaaaggaaaggagacaaggcttacgtgttgtggtttctgcccagcctacacagcaggagctggggagactttattcgtttcggggaaagtgacaacaggaatgagatgaagtgtgaaagtgaaaggaaggggcaatactgagatgagaacagcctgaacaaagtctagtacaacactgcagccatccagagcttgagggagcggggaggtccatcaccaccaggccctgtgggccaagcacacccatgtttcttctctcttgtcagatttgatgaaaaggaaacttgggactccggaggaccaagatggagcgagacggtcaatactgatggacttgcagctagcaccatggcagccctgcctggtctaaggaagctggcaggaggcgatggtacctggcgggggcagactgcccacctccccactccttcagaggactgtttcctgcccttcacaccatcatcatgttgggccctgcatgtatgttcctgcacttggagcgagcccagggacacagggcagacactgggctcacagatgttgctgcagctgagccagaaaacattccaggcaggaaaagcaggtgcacacattcacacaggcctctggtcactcgaccagccagaatgagacggactccttgacctgggaagtcaagtcccagtgggaagggctggaaatcacacgtggtcaacttcttggctctctctgctccccaaaccctggccctaggcttgctttatcatcacatcccaaggccagagggctgctgctgtccccatcttggccctgctagaagagggataggggtggctggcatgatgggtgaggggaacatgagaatatgcagaggccttggaggaagaggactggcagttatgacaggaaggctctctatacctggctccccagtgttctgcccctggcactgagcatgaggagccaggctttggggagactttgcaatcacccccccaacctggtccattttccacaggtagctttcttgaactcaccttgacccctcctcagccagcagcccccacctccaggggcaaaggagctgaaagacagtcctgaactggggggagctgggatcacatcagccaggccctgtccctcacaggaagtgagatgaggtgataccatggatggtgactaaggccccaaagtccctgcctctctgcctccccagaaacctcacagccaggccagcccccagagcagagcctgtgtaaacatgcccaggaggggaggaggggttgctacatatgagaaacagttaaaaataaatttaaaaagcaccactatgtcctgtgctggtctccacagccccgaagtctcagctcaggaagggtgagtgctgggggattatcagctggggctcggctccctcccttgcagacagcaagcaggtaagggcttcattttgctgttttctccatggagggctctgggaaaggatcctgcaagttggaacctcctaagactccagaaccaggagcggctccctctcatatctactcccctcaaaccctgtcattcccgggaagctcccagaggcagctgaggccacgcccctgctcctgagcggcagcatccagacccggaaaggacctagtttcagcctggcacctcccaaggtgagccatctcttcttaggcatagtaggaacatggagaccacactacccccactccctgaaagctgggatgggatggtgagtcaagggtcaccatgcccctattagtctggctggagttaggttaggcatcctcccagggctcattgaccccagggggaacttggggaggcaagggactgaccagctggcctcccagggtgcctctggccaggccatgctggatctggctctgggtcaagcgctgctggtttgaagagctgccagcctgtggcgccttccctgacaggcactctcatcagcaaaggcatccctggttctgccttcccttcctctttgcttcaaaggcaccatccgtctccctggcaggccaagagctacactgtctgtactccatgcgccacccccgctggtgacccagcaactgcaaagggcctctggtttgtcccgctctgggaggagactcagtggcttttcctcctcctcagctgcaaggatcctaccccagcccagcccagctctgagaaacaggactttgctacagcccgcctcaaagcatcttggtggacttctccccagcacgagctctctctacttcagggattgcaaactggcatcctcttttgccagtattgggtttttaagttttttttaagtgatcaccagcatttaaaaatcctatttcacataaaaagtcagaattctggcctctgacaaagcagacaatctggcaacacagggccggcactgtaagaacagctgagcagctgtggcccctttaacagggtgtgccctcttcaggtagccatagtccccacacagcccttcaggcctccttctcaccgtttgctcgtcatttgagcttacaaccctagttctgctcttccttgtgtagccccccagcccttctgcagccttactgacagctgtccctggcagacttacagcctctcagtaaaacaaaaccttaatggtcatctcatccgtttacccttccacaatctgaatcctttctacctttctaccgcctcctgacaaacagccatctcgtctctgctgtaggtaacccattactcctcaagcagcctgatcctgaactctcccccacatccctttctcacttgcatcccccagttcccagctgtccctcagtggctgcactgcaccctttacctgcacctccttgttgcttgagcctccagaacctacccctggctctgccaacctctccgcatcctctcactttcccactgggtatctcatgctgacgggcaggctggggacaaccccaggtgcctaggttcttccctgccagggccctgatgccctgccacaagtgactggcccagccatcattgcaaccccaagccaagatgggctgttaaagaatggaaggcaggcctggggcagaagcatcctagtctggtcttgatttccccagcaagggctcctggcactgctggcggagagacccaggcccaagcatcccgccccatcaccccatgtccagccacagctcctggactggcacccagggtttgctcaactcccacagccatgctggcctcagtgccattctgggtcctccgccaagcccagaccctccgcagggagcctgtgggctagagcaacaggcagagctgggactgagcaagtagacgcagttagggcctgggaactttttgcccagaggtccttccctgggctcgctctcatatcacccytcctctgcccacacagcactgcccatgggggcctcaagggcctgaaggctctcctgagccacgagctcatgctcttggggcagatgtggcctgtgccaagctcctggttaatgggctacacagacctttctcagaaggactcctaccctgcttccctttccctgggtcaagattctgccagggcaggcagaactggagaaacatctccaccccacccccaccccccatcacaggcctggtaaggctgggagatttcccactgataagatgcacccaactcccagagagaagccaggggcagaggcaccagcagaaccagcagtttccctcacctggccccatgacacatggatttgttaagcactggccttcccaccatcagcagatccatttggactaagttttccccaaataccttaaacttcagttgtagagttaaaaactccaaataaaatactaacggcctctaggcccaaagttagggggcttggctcagtgggagcgagagcagcttggggggctgagctggaacacactcttcctgcagcctcttgccctgccttgtcaccagccccgccttccccatgcataaggctggttccagcaggtggatcctggcccccaagagtgggtggggcctggggtgctggcatccgcctcagacccggatctggtacccgttaaggtctggcatggctttgggctcggaagtcttcttgtcacccgagggcctrtgggaggaagagagcagagcgggaggagagtgagtggtctgttagggagatggagttggggagccagcagcggctgcctggtggcttccccgccacattctccaagtggccctccaacgcacagcacagtgcgtatggaagtgtgtttttggacaccctggcccgcctgtgctgtctgaatgtggccccggctcgctctcacaggctttctcgctgctggaggctggctaatctggctgcagttggtaggtaacagcttaaagtataaatctgtctgaggggaatctgtcatctacaaaagcctcttagataaaagtcacagatgatggatattttggtgccagaggcctgcttagtaccccacccctgaattcataccagagaggtggctcctgaatgacaattatatttaaagcaagagtcagagtgatgtgtaggagctgaaatcagaggaggagagctggtatttcaatggcttgttcttgctacctggatacagacaaaaaccagactcttgggtggggggcaaagttatgttcaaagccatctaatattcacgccctcccccatgacattcctgggtggctyactgccttgcaggggccccatcctttctaccttttctctcacataacccatgctcagactagtgggctagcagagtttggtttctctggggaagtagaactgccttgctgtgggaaatgtcaatacacaaacctctaaacccaccatcccaagtcacctcccttgggtgggagcgaaaaagagagaagggtgggagagagataaaaaaaaaaagggacccacacgatgagaggaaaggaaaaaaaccctctttggacccacccaggcgtggtccctctctcaccgtctttcactgcggctgttcctgcggtgggggctggactgggcccgctgcggggaagaaacatccttcttccggtccttggtgggagagggagggcccgtccctttgccaatctaggtgcagaggaggaagcaacagcatcactccaggactgccctggagcccaacctctccttccaggagccacaggtccctggaggctgccctggggaaggcccggggaacctcaagcatggctcttccctgtctggatctttcccaacctatttcccaggcactaaagctgccagagcaggagttcctccatggggctgtccaatccctgtgggctcctgaaggcagagtggaagtgggggaagtcactgagataccataatattgcaaaaagtccccaacaaaggccaggtaaacgtgccagttgtgggagcagcccacactgaacttggggctgagatcccactcaccccaagggtgatgctgggtatctccagccattgagaagtcagactggtagctttagctctgcttaagaaaaaaatgagaaaaacaaaagagtcatcctttatatggcaccgtcagcttgacttgagttttcaaaacgcaggagtgctggagaggggcaagtaacacaggtgagtgtttagcactgaataggctgggaatccatcacagctctaaacactagggaactgttggctctcaccctagatccaatctgatgccttaaagacacaatagcaaactgagcagcaagagccagggtgctgggggacccagagctaggtggggagcggcagctcaggggcagaagagagcagcccctctctaacgcagggttggctgcagcctgcctctgccctaggggaaggcactgtcaccccaggagatcttggcctagggctggcaatggctagggcagccgtagctcttacaaacccctgccaggacacctgcaggcacctgcaacacacctgggttccccatcaccccatcaggaggctgagctccagtctgatctgcctctcactgccagtgagcaagactctgggcttccaaccctgaaaatggagctaccacctaccgcccgctggcctcccagggctgtcaagagaagcagtgcacttgggagtgcagaggtcggtggttgaggcggaggctccaggctgcctggaggggcagtcacagtgcagcagtgactgagctatggagatacccagcagggggccctggcagccccaggagaacccaggcagatgtcagaattctgcctgctgaaaggctctagggctcaacagctcagcccagctgtttttggtacaacagcccccagcccaactccctatcacctcctgctcaagtgtgggtgggaagaggaagaaggaacactgccctcattgtcttccacatggtctgacttccctttcttctgaccacctcctagtcctttaatggttgctagggttggggggcagagtcaggatatgttacaggaggagtggggaggctgcccatcacagcacccgatcacaccctccagacaggccgtgattctccaccagtgaccttgccatgtgcccaacacctaccaccatccaaacccagcccacccacctcctccctccgcagccgtcctggtctgcccaccccaggggaccacctgaacaatatcgaccactaagcaaggtcccagcaccccagtcccctgagaagctccccagtcctctcaatcctcacatcgcctctgctggggcgggggagggggcgagggagggggcgagggcgtggaaggcgggcagaccttgagccgcatgtcgcgggcgtggcgctccagctccttgcggaagtcatcgcggcccaggcgctccacgtccagcaccgagtgcttccactcgatctgctccacgctgtgcgggtcgtgtgacacgctctggcccagcttcaccttcttgagcacgtgccagcagcggccgtaggcggcctcgaagtccagcacgagctcgctgagcgtgcggaaggcgggcggcttgtacatcaggtcctcgcgccgactcatgcccagcgcaccgtagcggcccgcgaagttcacccccagcacgatgtggcggaagtagttccctgagaagtaggtcttgaagctgatggggaagcgctccagggtgggcatgctgttggtgaggtaactggccagtgccccgctaaggaaagagccaggagaagcacggggccagcacaccgggagggactgggaccgggagccacggggtccacgcaccgccagccttggggtgcagacaccagtcctgctcatctccatacgcctggcgtctcctcctggtattcctgccatctagcattgagcctggtatccagctggagctcaataaagggaacctcgaataggcacggggcttccagggatttgtggccaccgctctaaagtccagcagggctggtgccacactgcagggctttccagagcccagtggcccaaggacggaagagaagccttccctcccctgcctcactccctcgtcctccatcccgcaccttggcacacacacaggccacagacgcggcttcactcttctcttaccctcaccctgtcctctccccatatccacatgcaaccctgcctgtggcccttcaaatacaatcacgtgtactactgaggcctgggaggtgcccccagccagccccaggcccactcccacttcctacacctctgccccacctgctcacctctccagcccccggggcctcccacctgagtttctcacaccggccttttcccctgcctgccaaagttggctgctgctcaggactgaagctgagcctgcgccaccgtccacctcctccacggcactctcaccatgaccagtgtttactgcttctttttccttacttgcttattttgtctcctccactagaatgcaaacctcccaagcacagggcccttgtctgtcatgttcttcagggcccagcatcaagccgggcacacaacagttactcagtgaaagttctcgaacaaatgggtagaaggacatgaatggatag

SEQ ID NO: 10681 - DNA, 209320 bp, Homo sapiens
  misc_feature (1)...(209320): n = A,T,C or G, or insertion/deletion polymorphism (see Tables 1-2)
tcctcccatcttggcctcctgaagtgctgggattacaggtgtgagccactgtgcccagcctctctgctctttcccttccttctcctcttagttaaaattgtagccgtggtcagaggtggctctgtctcctcgtagaaagcagggagcaagactacaaaagaaatggtaaaattttaacgaattttaaatgaataaatccctaatttcctatggaatgacaaactaaatgatggtttgtagttggaaaattaagcaataaaatacttttttattttttgagagagagtctcgctctgtcacccaggctggagtgcaatggcacactcttggctcactgcaacctccgcctcccgggttcaagcgattctcctggctcagcctcccaagtagttgggattacaggcacgtgccaccatgcctggctaatttttgtattttagtagagacggggtttcaccatgttggccaggctgttctcgaactcatgacctcaagtgatccgcctgccttggcctccaaaagtgctgggattacagacatgagccactgcgcctcgcctatttttttttttttaataagtctataataggtatacacagggcctgactattccagatagtgtcagctgtgtagttttcttattagcagacttgggatctatatttatagacaattgaagttttaaagatgtaaagaatttatttattcattcatttattcttttgagagggagtcttgctctgtcgcccaggctggagtgctgtggcacaatcttggctcattgcaacctctacttcccaggttcagtgattctcctgcctcagcctcccaagtagctgggtttacaggtgcctgcaaccacgccctgctgatttttgtatttgtagtagagacggggtttcaccgtgttggccaggctggtcttgaactcctgacctcaggtgatccagccacctcagcctcccaaagttctgggattataggtatgagccactgcggctcatacataaagcattatatacaattgtcattatatactgtaatgtaccttcattccttctgtctgaacaatgtggattttagaaataattaccaaatataaacactactaaaatgtgtagatttggtggtgcagcacatcaaggagcacaaattttacaaatttctttttaaccatctctgcgttgtattttcagaatacggatgattcattttaatcctggtgtctttaaatgattaaggattttcatacatgaggtatttcccacagggaaattctaaggtaatttgggtatgattcgtttagagtttttcattatttacaacaatttagtaaccattagactttcttccttgcatgtgaatacatacatatatttttacatcaagtatttccatcgaattttagctgcttatattttctttttaaccattacttggaatggtattttcctataagcggggaataaagaaactacttctgtctctcgggtatattaacagggacagtggggcctaatttcttatgtcccctcagttagcctttgtcacagacactcctgtgttttggggtcaggagggaagagatcattgcagactacagtcatggaatttgattcatttaactgaaaactttttattttactttacccatcttaagtcctcctgatagccctataaagtaataaattgtccaaaccccttcaggaaactattcttaattccatcatcatttatagttgcctatctgcccaataaaccagaatttagccttaaagccatcgctctcttaatctrtattatgatcttgtctttatatatgagttttgtttttcaaattagtggatggccttaggtaccattttgttattctgcttstttgtgtcttctgaagacagtcacagcatcatagaatactacagattggaggggtctatgggatcatcagaaccagtgcttttcaaaaaaattttaactgcaaactccccatttgaagtgaatttttgtttgtttgttttgtgacaaagtttcactcttgttgcccaggctggagtgcagtggcacaatctcagcccactgcaacctccacctcctgggttcaagcaattctcctgcctcagcctcccaagtagctgggattacaaccatgtaattacactcggctaaatttttttgtatttattagagattggctttcaccatgttgaccaggctggtcttgaactcctgagctcaggtgatccacccacrtcggcctcccaaggtgctgggattacaggcgtgagccacggtgcccagcctgaagtgaaatcttataagaccctcagtattggtccagggagggtagacttcctcatacctcccaggaggcccgagggctccattgcctctaatttcctctagatgagagaactgacacctctagagataaaattagctgcccaacattttggtgagggaggaagagtccatttttgttgcttagaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctggtgaacatgagagacagtggagaggagagtcccgggaggcagccttcccagccaggccaccccaaacttctggttagggattcccagcttcacagcactacgtaagctgcttgccaacagatgttttgacaacatctgttgtcaaaggttgacaacaacctttggtccttgcgatggctttctcctgtgtttcaagatggattcctattggcatctttcatttccacctctgtttcaccaagtttagtgaccattttcatacattggggcttaatgtggtgcagtggaaagtgtagcagattgaatgtggaagatcgggttccagatctcgttcaggaagttagtagctgtgtgaccaagagcaagtcgttcagcttttctgagccatgattcctcaggtgtacacaccaagtgatgaaacactttaaaaactaagaaaacagtgtttgaaatgcccctcaagtgctggtgtttccccaaggatgttctagacccttcaccattccattcattcattcattcattcatctattcgatgattagtgtgatccctaacttttttattgttgttgttgagacggagtctcgctctgtcgcccaggctggagtgcagtggcgcgatctcggctcactgcaagctccgcctcctgggttcacaccattctcctgcctcagcctcccaagtagctgtgactactggcgcctgccaccacgcccggctaattttttgtatttctagtagagatggggtttcaccgtgttagccaggatggtctcgatctccttacctcgtgatcctcccgcctcaacctccccaagtgctgtgtgatccttaacttttaatctacagttcctcttttttttttaagccaagtagatgggtgattttgttttctgctaattattttggtatctttcattccacctctgtttcaccaaatttagtgaccgttttcatacattggggctaaatgtggtggtcgttctccagaagagtgagtgtaagttcgctcttactttgagcagcttatctctgtttaggcgatttctttgtcaccattaatggaagtgtgacacctttctgagtcccaaatgtatcggtttatcaaaaaccacatctgcaatgctgcaccttgtactgagttcacctcagtctggtactttctttgccttttgtcttgtttgcctccttgttagattagctccttaaaactttttcttttcattttccactaagtcataactctctagactaaatcctattaaagaaacatttaaagtgtttctttactgtgaagtgtatcatgcatgaaaatagtgtgtgaaatggaggtagatgttcagtttaaagaccaatagtagagcaaacgtctatataccaactcctcaggttaagaaatcctcttgtgatatatttatgcacgtggagtagctactttttccagaatttggggacatgtaatgatgactgagagatcatatagtctacataaaacagctcatcatcctagaatgagaaagagagaaaccagccaataaagaagggcagtgtgtataggtacttacaatgagaaatacaaacaagatgggattggagccgttctctatgtctgggagagttagaaaagtttccaagaggatgagacttttgaaaagtttccaagaggatgagactttttaagggatggtttgcctgaggaagatgagcgttccaggtaaagggaacagcatagcacgtgtagtgattcttctccctcctcattcccctctcaccattctgaccattcaccttcagtttcgtttccactctcctatcctccataaatgttggtgttcccataggtgttgcattaggatctcttctcacgtcattcaattttcatccattcacttgctcaatgtcaatgaagcaatgggtctccagaaactcctgcctgcagaactatctgtggagcttggtaaaatgcagatggtcccaccagctcaatcagaatctttggggtagggtccaggtatctttagtgcagatgactgggactccacatggagaaacacaggtgaacagggagggttggagagaccactcaggaatcagtcacaggtgaccttgtgcttcctgctaccatggctgcccctcccagcctgcctcacctgtgcctttctcccttctcccttcctgccttcagctcctctgttgcttcttcttccttaaacatcttcaccggttcctgtgctattacagagccccgtctgtgggtctcatgtctctgctccatgccacgccctcccttgggcatcatctgggctttggctgggtctgtggagggtcctgggctgcagtgccatgaacagtggagtggggcatgcgaagttgacagtcacactgaaagctcctgcctcgcctctctaccttcttctcttttgggggtttctttcctgaggcagggaaaaagaaacaggaacccagaccaaactgaggaaaacacgatcagagatgagatggggtcagaggcaaagggctgtttgttgggtttgcactttcattactgagagcattggaatagttttaaggcgtgcaaactgtgagactagacaatttcacttagaaaatgaaacgtgcatgcagatgttattctcatggggatatatatctgcatctgtttgtctacaagtgttcccttgcagagtcacagacatatacaaaacctgggttccatcagctttgtctgcacatacgtggctaaatgtgtacagggatgtacaattaaagattttaaacacttgattttgacagtatattttgcagctgctgtgccaagaaccctaagctactgtgggttaattggagttgtagcaagtatttctttctcggctgtctcttttagcagagcttctctctctctctctctctctctctctctctctctctcttcccctctctccctgtttcacccctccctgcctgcctgcctctgcccctccctccctccctccctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtgtaagtaacgcagttatatatgttgctggagttaggtggtctgttttcttgctattttttttttactttaactttttcagtttccttttgagaaaagtaaaaataaaatgcataaaccatttcaaagaagttaggagggtccaggttgtgcaagctttcttcttgttcaatggacttgcagaatacctagttctatcagaagagacacacaaactaccgacatagaagctacaaacatcctccggaggatgggaatgaaatgggtaataaatgaagaaggtttctgaactgacagtcattgctataatcaggcttattcagagttgctaaaatatttgacattggctcatattagaatcaaagaactaaaatgtattctctttacaggatcataaaaatgaagttagcctgtggctttcagagcaggttctttctggctgcgtaaatgtgagggtttttgtttgtttgtttgtttgtttggttttgttttttaactaatgtcaaatgttgactatgtttcctgtccatttcaacttttcttgaggtcggacatctccctattctagagtacaatgtctggtcactcttgggttgcaggccactgtctagtggaaagctagtcattgctagtttataccagtcagagacttttccatctttctgtgtgagggcttcgtttaagcacttcaattcctaagtattcagggaggaaaaacaagtcacttgaagaccaaaatcagtttatttcacaagagaaaggaacggctatttaaaagatgaaaaattgaaatttaaaaatatgatctgccttttcttcaaaatctgaagtgaggttaattttgtgtaggaagagtaacataagctttcttgattaaaaagcagtattttagaggaggcttttaagatcataaatcacttaggtaaggtcatcaaaagagatggctgatattttttatggtcatttgcaactttttaaaaaaagtccatacggtaatgttaatgcagctatttctggcttcttaaaacttgcatagatttggaagtgggatttctaacaataagagtcgtgagtttttctgagctatcattgcctttctctgtctatcacattcatacctcaggcagagctactgtccctcccacctgtccaccctgcctgtttcccagcccccatccttctctctgagtcttggaacatcatgaaagactcttctgcagatttccttttaacataccctgcccagccttggacagagggagtactgtgaagcaacatgcagggctgccaattttggaaatgaatgagcttagttgattcctgaatattaaatcagttctgtgagcagtagaatgagatcatatcttacaaacctgacccaaagtgttcctaacaactttattaattggggtttaacatcatcaagggctgtagcactgggcacccgaggggatcagcctaaacccaaatgaaatccccaaactccactcggattcctgctggccaaatgcacctagggccacgccttctaaaatatgtcctttgttatcaagggaaatctgagacagaaaacacatgttggcagcatcatgtgagcgcctctctgcacataaagtggttgtatcacaaggggaaagctttcgatcttgtgccgttttgttttggtttcttgtttatgtggactctgttagactcctgcatctggaagaggcttgaagcagagtggaaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccctcctccacaccctcctccacccccacagcttgtgcctctcaactgcccctggtggacagctccaacctgcaccccccccaaccccgccgccccctctagaatctcacgtgttttcgtggaggaccgagagtgctttttagcagtgaatgagcaaagagaccagatatgctgatacctgcacatggtctttgagagaggcagctgattgacatcgggaaaactgctgagcaattaaaaaaaaatactagagtcaaggtgaaagaaaggagagaaagagacagcgagagagacaggtgggttgtctctaaagtttcaagcaaagttctgtgaagcacctagcaggtcaaaactgataagggcagatggtgaagaaaagtcttaaactgatcagtgccttacacatggaacgaagctttcatttcggcccgatgttctgccagaaagctttgcttgagatccaccgccagtgttcttgctttgctcaacgatcccactatgctggtatgttctctctctggacagccgtctttctaacaacgggtgctgttctgaaaagctgggagcccaagaaatgttgtaaaaaccaagygtggccttcagctgttggaccctgaggaacagcacctgcattagggccttgctcacgtttcttactagacaggttgccagctctcatttttrccctttgtctgagctaattggccttagtgttacatcggcccacatttttctccctgtaaactccattcctccctcatttcatctacactgcagagaactctcaagctcctggtgagttttgctgcaaagcctgtggcacgctgaaagaatgcaccccttccraacctcatcttcccacttcttccactggagacactgygggggagaaacatgtaaatatcgttaataacaatgcatcgcgtccttgaaaattgctgctaagagagtagattktaagtgttctcaccataaaaaagtatgtaagataatacatatgttaattagctcagtctagctattccacaatgtgtacatattttaaaacaatgtgttgtacatgataaatatatacaacttccacttgtcagttaaaaaataaaaaataagtccaggcgcagtggctcacacctgtaatcccagcactttgggagtccgaggcgggcggatcacttgaggtcaggagttcaagactggcctagccaacgtggcaaaaccccgtctctactaaaaatacaaaaatgttagccaggcatggtggcgggcgtctgtagtcccagctactcrggaggctgaggcaggagaatcgcttgaacccagaaggaagaagttgcagtgagccaagatcctccactgcattccagcctgggcgacagagtaagtgagactccatctcaaaaataataataataataataaaataaaaaatagacatttatataatgaaggtttttaaaaaagaaaattaaaataaatttggagaatgacctgtgaaaaatgcctctgcaagttttcctgaccagaggaaggacttggcttctctcctagacattttttctcgtatcttcctctaggagtcagtggaagagtggcgattaggtaacatctgaatgtagtagaacccagagctgttacctccatttgagctactgctggtcattgcttgacttctattctctccatcagtaaaatgcacgcgaagcttacctcattaggtttttcgagaattaaatgagataatgcatggtgcttagcttagcgtctggccatagccttgatgtcaatactgtcctcatgttctcctgtcagcggtaggtctgtctctcagacactttccaacagaggacccagatccttaatgacaggggacctgggaagacagggaggcaatgtcacagaatggaaagcgtgctcgagtagaagtcaagacctgggtgtttgagtcccagctctgtgcataaccatttgagtgatcttaagaaaatgatcaccccctcttccatgctacagccctagatggkttactccttactccaccactctcctcaccttgactcgtgccggtccctcagcacgacgggtcctcctcctggctggctcctttcttctctccttctatgagactcccctgatcccctgagcccgagggtcagggcttctcctctgccatcctatggcacctacatctctccacgcttaccgtgcagccatcactgtctgcctttcccactcgactgtcatctctgtcttaaagctctgccttcggtgtcaagaccgggcagcactcaatgaatgtttcccgaacggatacgtaaatgacagaaggaatggatgaagagtccctgccctgcctcaggtcttgagtgaagatgaaatgaaataatgtgtgtggaaggcttggatgagtagagtgctgtgcagttgccttcagttttaagttagtatgaggacaaagcattttttataccaatattttagttggtttctcagatactgagattcacacattttagtgaaacaaaacaatattctcttttataccatccttgcagtgtgggcccattatttgttgtagaagcaggccaggctttatgtgggctagaacctctgatggttgaaactgtgagcaacaaaacttttcattgcagaatgacaggtaagattctgaaagccagtggcatgggagggctcgctctgtaactcggcttgtcccagggtatgaatgagggagttcagatccctgcctgtgagggtggagaagggaaaatggtttctaaaagcagaggaggaaagagaaagaatcatcatggaggcagcatggtcagggaaggggcagagggtgttgcatctgacaaagctgggtttggacgatagcctcatacttgggtttctgttgtatctcatgagtcctctccctggaggagtatttggattctattctgcttctcccctgagtttgttttcacggtgggactatccaggactaaagagaatggcaccgtattgctctctctttctgaacccggacttgcaggccatatctggatttatcctttttatcagcagaatggtacatttcccatagcaatgcttgaactctggtccgtgatgaagcaagctcttccatggtgttagagtctgtttttccttcagaaaatgctatttgcagaacggcaacaacaaaacgtgtaacaggaattgtccgttcccatggccagtcctcatgtagagccacaagatggcgcagaggatgacatgaaatcatgtacgcgagcgtgatttgctactaggcagctctgtagggctgtatgtattgatatcacatgcgtctatatgaacgccccgytgcagctgcctttgctatacagtgaatacactgtgggtctattattcgcctcttcagatccagcccaggagttggtgcagactcatttttcactttcctttgaccctgggtgtctccacaaatgaaccacctgctgtgtcttggtgggggtggagatgtggggtgaagtaatgagcccgcaaggcctgtctgtgcctattggctgctctaaagggaagttgaggaatactgcaaagccacaaatctgagatgtcagctcataaatctgtaagctccttgcttaagtaatacgctccttgacggccaaaactgtcatttgcacattctcttcagctgaacacaaaagttccggttaccagactgtccctggatactggggactaaaagctggtgattggcggggtttgggggtggggagggggcgctgggctgattgccctggctgctccccacagctccacggctgctgctttcacccccacctgaccatggtcgcagtggggggctttctcttggtatttaattagtaagtgtaggcaaacatttgcattgtggcactgggataggaaaagagttgaacatgaatataaaaatggggatggggccgggtgtggtggctcacacctttaatcccagccgccaaggcgggcagatcacttgaggtcaggagttcgagaccagcctggtcaacatggcgaaaaccctacctctactaaaatacaaaaacattagccgggcgtggtgacacgtgccccagctagaggcagggaggctgaggcaggagaatcacttgaacccagaaggcggaggttgcagtgagccaagattacagcactgcactctagcctgggtgagagagtgagactctgtctcaaaaaaaaaaaaaaggaaatgggagaaatagtttccagcatttagcttttggcgacaatgactaaatcaatacaaatgttaatctctgttgcattatgcttttgaaactgtattggcagtttaggaaaaatccagtcaacagtttaatatgaaaatagagacctgtagaccaaatggagggcaggaagcagatatttgccacacaaacatttattgagcgcttratgtattataggtgctgtgtaaagttttggagattcagaaatgaatcaaagagaggagtgaacatacaaattatcccaactataataccggtgataagccacaaggtagctctgctagcacrgaacatatggaagagatgaataattctgcttcggagggaaggagtcatattagagttgggtctagaagaatgagcaggaggtggctgggaagggagggcgtttgggcagaggaattggcatgattctctgtgtatgcacaggaccatgaaagtgaatggtgtcatgtaatttttttttttttttttttttgagaatgagtctcactctatcgcgcaggccggagtgcagtggcacgatctcggctcactgcaacctccacctcctgggttcaagcaatcctctgcctcagtctcccaagtagctgggattacagacgcctgccacaacaatcggctaatttttgtatttttagtagagacgagggttcaccatcttggccaggctggtcttgaactcctgaccttgtgatccacctgcctcagcctcccaaaatgctgagattacaggcgtgagccaccgcacccagcaggtgtcatgtaattttattcatatttcctgatgactaagacaacgtatttttcagattctcaaaacaggcaatgattagtaatagatcaccttaaataggatgttataatggtgatgaagaccaatcacagctgcctggaaacagtagatcatgggtcaataatgggcccacacctggrttttgttactgagtcaacctacgctacttgttcatgttgtacctatttatcttgagctggtattagtatatccatttctaaaaatccttgcttgagaaggaaaaactattcaggagaaagaagaggagataaagtctaaacaacttgatttcacttgaaaagtcctaagtcgtccctgggaaactatctatagtaaaaagcatgggattttataccgtgttttaggcaactgaaaggcttttttacaattgtagtaaacactgactgccagcattctggtaccagttactttattaaggtaaattcccaaaactcacaatagtgggaaaaaatactgataagccttctaaaacaccaaagaagtgtagaacaacatcytggatgcttttagtcacgagtcagaacgccgcggtggttacagagcaatagcatttcagagctgggagagaccttagagatcatgtattttgtggattttcaaatctttgaagaatgatgttctgggtaaggaagctgctaagagtccatgagctagttagtgaggactgctacactcttacacactcactcccggatccctttgtgcatgatttctgtcattcaaccagtgttcataaagcccttgtaacatggaggataaatatttgaataagatactggctttaccccrcagaagcttagagctttgaaaggaggtaagacatataggtaaataatacacataggaagttattttaaaaatataatgagagttattagagttcagaagatggaaacttatttcctagtgaaatggatgactgtgtcctgtaatagaatatttactatatttagtaacagatttatacagtctcatttgttttagttaagaagtttgagtatccaacagagaaaaaaggttaggtaaaaattaagtacagtgaggccaggcacagtggctcacacctgtaatctcagcactttgggaggctgaggcaggcggatcacttgaggttagaagttcaagaccagcctggccaacatggtgaaaccccatctctactaaaaatacaaaaattagccaggtgtgatggtgggtgcctgtaattccagctattctggaggctgaggcaagagaattgctttaactcaggaggcagaggctgcagtgagtcgaggtggtaccactgcactccagcctgggtgacagagtagaaccccatctcaaaaaaaaaaagaaaagaaaaaattaagtatagtcatgtgtcactgaatgatggggatgtgttctgagaaatgaatcattaggtgattttgttgttgtttgaacatcatggagtgtacttccacaaatctagatggtrtagcctcctacacacctaggctagagggtaggactgttgctgtactgaatagtgtagccatttgtaacacaatggtaagtatttgtgtccctaaacatatctaaacacagaaaaggtacagtaaaaataagattatcttatgggaccaccagtatatatgtggttcgtccttgactgaaacrttatacggtgcatgactgtatttggtttagcccatgtttttattttgaagaaatgcagaacaagtttaaaattgaattgttgaattgttgtcattagttgatagcctaataagaacatattgttcaagtacaagaatatcattgatttaattaccctgaaaatataattttgaaaaatatctacattttttaaaaattaaattttcgtagtgtaaactaaaattaaatactcaactaactgagagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcytgaagaaacccataccaagaaatattttacgtgttgtcatcattaagaagtcagcaaaccttaaagacaaacacaatctattcatccatccatccatccatccacccattcatccatccatccacccattcatccatccatccatccatccatccatccacccacccacccatccatccatccatccatccatccatccatccatccatccatccatccattctgtaagtgtttattgagtatccactgcatagcatgcaccattcctggcagttaagaaaataaaaggcctcactctcatggaacttacatcagaaagggcaatattaatgatcagccctgaccacatgcctttccctattaatgatcagcccggaccacatgcctttcccttagggaacattgtaggatgaatgttccctgtggtctgaatgtttgtgtctccctctaaattcataagctgaaatcctaacccataagatgatgtcattgtaacattgtagggtgtattttagttggtgtggatatggaggcagaaaagcaaggatactggtgaacctggggaatgcttaagaggttggactgtgctgtacccgttaaaaagcaataaacaggctgggcgtggtggctcacgcctgtaatcccagcattttgggaggccgaggcgggcggatcacgaggtcaggagatcgagaccatcctggctaacacggtgaaaccccgtctttactaaaaatacaaaaaattagccaggtgtggtggcgagcacctgtagtcccagctactccgaaggctgaggcaggagaatggcgtgaacccgggaggcggagcttgcagtgagccgagatcryrccactgcactccatccagcctgagtgacagagcgagactccgtcttaaaaaaaaaaaaaaagcaataaacagaatctcatgcttctatacaataaaaataaccatcttccctatagatgatgaagagtctgttaatataatctgacaggcttgttttggaaaatatttagatacttatacatccagatatattccaaaccatagccttgtaaaacctctgagctagcgcaatccttgagtataagtctacctccacctagaccaatgtttccaaaccattctgtggctgggaagactggaaggacccccaggctgaccctgttgggaagacatgcaacaaggcttacttcttcagtggtgtcagtgattttgagccagttctgaccatccactcatccgtctgtatttgtgtagtgctcactatagacaaggcaattttggggaatgcagttgtaggaaagatagacatggctcctgaccttatgaaatgttcagtcttgtgaggaagacacaaataattacagcccattgtaagaagcggtaaggtgcttttgtacccttttggtccatttttctttttttttgttttgagatggagtcttgctctgtcacccaggctggatggagtgcagtggtgcgatctcggctcactgcaagctctgcctcccgtgttcacgccattctcctgcctcagcctcccaagtagctgggactacaggcacccgccaccatgcccggctaattttttgtatttttagtagagacggggtttcaccgtgttagccaggatggtctcgatctcctgacctcatgatctgcccgccttggcctcccaaagtgctgggattacaggtgtgagccaccgcgcccggcctggtccatttttcatcttgaccatggaccacgctggtagatgcctgggggcatgagggacatagcaatcaggctctgtcagcctttgtgaccagcacaacttatttccagtgcattaaagaaaatgatactgcctatgcccaatttagatgtgggccagctgtgttagttagcttaacacagcattttgttttgcatatgtattgattttgcgcacatgctctctaagtgcctcagaacactgcctacagcatcctggtgaggttgacaatcagttgtcctgtccctgttcatctggcatggggacacactgtcagaggaggaactaccaagtaagtaattgcctccagcacacaaaaactgcagacacatggttgacataagaatctagtttcagctggtggttttcagggcaaagcaactgcactaacaggagatttccctgacagctgatttaaggctgtggaagaccccagtttatcagctcaaattgagaatgtccttttttgactagaaacgagaccctcccagccaactgcacaaccaaaacttatattcaggatgtccaggacctgaaactgacatgggagtcaatattctacagccagttgtggtgtcgacagggtctgggggaaatcttcagagctgacttgtgatgtagcagggcttacagcaaaggcatccctttcaccttgctctttaggattcatattctaagaagctgctaagaaaaaatgtctaaacggagacacttaggatatagttttcatattaatgttttattttaacaataatgggagcaaacacctaccaggtgtttactctgcgtcaggaactgttctgataatcttatttgaactttgcaacaattccatgaggctagctactcttaccatcctgttttacagctggggaaactgtggcacaggaaagttaaggaacttgaccatggccacagagctctgagtgtcagaaagaagatttgaaaccacacagttggcttcgcatcctgtacgcttgactatttctcttttctgcctctcttgggagaactctgaaatactaaagtactatattactaaataaatgcttgctaaagcatttatttggtcccatattctcaatttacacaattcttttctccaatcacatttcattttagactttatgagccctgttgaagtcatcagcttaaaagtgcccttgagcaattctctactctagattgagttaaacagagtatctgtagataatctagaatcacagacaatacctgtcttagttcctttgggtcgttataacaaaaataccatagtctaaatttataaacaacggaagtttattttgtacagttctagaggccgagaagttaaagatcaagagaccatcaggttcagtgtctggtaagggcccactctggttcacagatggtgccttctcgctgtgtcttcacatggcagaaggggcaaacaagctccctgggctccttttttaagggcactaatcccattcaccagggctccaccctcatgacctaatcaccttctaaatgccccatctccaaataccatcatcttgtgggttaggatttcaacttatgaatttaaagagggacataaacattcagaccacagcaacatctaattttgagccacctaactttgaaagaacaaggattgattaatccaatgtcagcatacagtataccattagatgtgagcccctcttggcaaacttgataaaagtgtgagaaaaaaattacctagaagactaataaatacagaatagtcacatataatttctgtttaaagatttataccttaccaatttccccaaaatgatttaacacaactcattaaatatttgtaaaataatttaaatcttaaaatatatattgggaaccagttaggaggagagagaaaaagacaccggttcctagaccagcttggttattgtacttggacatttcttaggctctgaattttatggacgctaaggcaaatggatcacaaaggagtaaaagataggggaagggaacaaaagcatttagtgtgctcccactgtgtgcagatcattctgttggccactttcccataccttacgccctttattctcacaacagacccttgaggtagttaccgttattttcatccacatcaaagtatgtggcagaggcaggatttgaaccaagcctatttgactccaaagcctgtatgtatttttttactaggtttaggttttattattcttacccaataaagtgacatatgatttgtctggagatacctagtcttcctttgaggattttttaaaaaatggatccctatgtagagaacattgggtaaaatcatagtaacctatgaaaagtaggtattcaatcaatgtttatggaataacatgagtaaataaatgcatggataataagatgaaggatatcttctttaattttataagctaaataactgttttttgtaaatgcttctatgttaactattaacctctataaaaaacaaagccatatcttagcttcataattcagtctaaggcagttaggtaaatacttaacaatttaatattttatgtttttttctttcatagtttaatttctcaaaagaatagccgaggccccccttatctttacttcttccacccctatttacttctcaacccactgaaatgtgctccgtgtttcctctgattctgttcaaggtcaataatgaactcattaattctaatccaagggacactttgcattctctgtcttttttggtctctcaggggcatttaacattcttagccacttgttccgtcttcctctttacctctctggctgctcctttgtaatcttctcttttatattcactcatgaagtattgaggattttcatggatctgtcacgggttgtgttctgcttgccttctactctgcacctccctgggtcatctcatccactctcataactccagctgccagcttcatgcagaagactctcaaatctgaaaactgggatcaactattttttatatccaaatactctaaatgaagatctaagccaagactgtctatcttgaaagtaagttatttctgtctatggaggcaaaggctcacgtaggaagtgaagaatcttatatatttctaagccatttcttggcagtcagtcacgtattaggagtcagttctgtgtgtttttaaatacagcattgaacgactcagtgtttgttgttattagtgatttgttggacaggatagagagaaagcacagttatttaaagataaagtgtttgtagcccttctcaattgaatagcatacatacagataagatgtctgtgaaattttaatagaaatcaatgtgaaataagattcaatttataaaatctcaaattacaggcaacttgtcaaagcctagctgttgtgtaaacgtgggaattcacacaaggaaaagatgattgattggttgattgattatataacatgagttacattctatccaattgcacctgaatatattcacagacgcagctggatggctctgatttagagaacaagtattttcttcttttcacacaatctgttcctagaagcgccatcaaaacataaatattattttctcataataatataaggcatagtgattttattcttagccaaggatttagtgttgtagaattagttataattaacaatgtgttagtaaagttgagatagtattttaaacctatctgagtacttaaaataatgtaattttgctccagattctgccaaaaaaaatggaaattatttaacctaggattctaataactaacagtatccatagcattaaaaattacctttacatattgtaaatgtcacctgcctacaaataacatgtccattaaagtaaacattacttaaatatgcagctcaacagggcctggtttctttacaattaactagaaaatttgaactaaatcttcctgaagatttcttctctattaaaaacaaaagctgcctcctttccttgcttcacagctttttggacctgcctgtgatgagtgtcctttattgcccagtgtaattttgccatggtttttagcaatctgcaaacactccagcccaggtaacctgacggtagcatagacaggaaaggaggggatgtgaatttctgcctctctgcctctagtggggctgctaaggtaccagccatctaaacatctgcccaggtcttggtgcagtccagcttttcagcagagtcaagggcagaaattctgcccgacttctgtgtctggtacctatttgtacaatgcagaggtcccatgcaaattgttttcctttgaaatraccttaatgatttcttcaggtttcaactacagtaaataatttgttaaataaaaatattagaatgaaaggggggaaaagaaattacttcctctagcaaatgagactcttaaattcaaatttaattaaccaagacgcccccaaaccacagagcatgtcacccagcgttgacaattaattagctttgctctgaaagagctacaggtacccagcaaagagttacggattaaaggctttactcgctctgcgaaggctgcccatttctagctatcacaccttgatagtggtttgttgcttcaggcaacaaattacatctgaagtgtgtgatttcatgtccgtttttaatttcacacaattgaaatatgggaaaagtgaaaataaagctctacttcttttcaaaataaagctctatttctttcaaaataaagacattaaaagtgaacaacactacttcttttcggtttctcatgctgttcaagataattttctatcaaacggtgaaggaagataaatactaaggaaaactctaaaggaatgagtggtcactcttggcttttaggcgggctctctgtttatggtagaccattcagcttcttccttttagcattaaattagcatatgtataaatgatttaactagaaacttggagctagcatctaaaaggcagcatggtgtaatgaaaagaacattagattccttcgattcttgaaatcagattatctgggatatgcttatcccttgaaggaatcttaattttagttggatagtccttaaactagaaaagatatacgtacatattttatagacaattgcttctcagccgaaaaatcaggcactgacattccatgaggaatggactttaattagccggtgattgtctttctctgtctatatttataggcaaccgaaatagctgggttgtaggtacatggtttcatcaattccatttaataagaccagccagttcactatcattcatgttcatgaaagataggaataacgtcagttaactaaaatcatttatatctggctttgggatggctttttttttttttttttttttttttttgagatggagtctggctatgtcgcccaggctggagcgcagtggcgtgatctcggctcactgcaagctccacctcccgggttcatgccattctcctgcctcagcctcccgagtagctgggactacaggcgcctgcaaccacgcccggctaattttttgtatttttagtagagacggggtttcaccgcattagccaggatggtctcgatctcctgacctcgtgatccacctgcctcggcctccgaaagtgatgggattacagacgtgagccaccgcgcccggcccgggatggctttttaatgcatgtttaaatggatctggtgtcttaggtgtttacagttcttttaatttatgtattaagcccagtttccataattgcatactaggtggaacttaggaaaaggcaagaagctattaagtttccctggtactaagcaggcctgggggtgggcagatcaggccaggaacataaagacctgcagtcagggagcatccgataagaacggattgatggtcaaaaggtcagctggcacagggaaaagtacgtgtgcacctaagtgcagatgaaaaagaaagatccacccacactggcgccgaggcttgcaagtggatgtctggcaagcaagcagaagccgagatgcagatcaggaagctaaaataaagaagctggggcatctgggaagaccgagacccagggctccgcacaggctaaacagcaggaagaagagcgagtagaattggggtataggcgtggccaggtcatcagttacccaggtgcacggcggctgtcaggaggtcaggcagcaggcaaaactctgttcacaggtaggatagtgtgagggatcctgcccgctgtgctttctcaagtagggactttttacctctcattgtccaacgtacttctgcttttctcctccctgatgaagatcttgtgactgtgtactggcaggttggagcccacccctccaggacagcagggagcaaaggaagggtagctttgtaggtgtgggtggagataaatattcatgcatgggcaatgaagcagctctaagctatggaatcacatgtcaacccatatgtcacgtggcatcaaaggcagtttatacattggtaaaatgttcctttgaacttttctattccacaggaattgggaataagttttgggttatttcatcttccagtgtccttaaaaatgtggagcatgctctctcttaaaaatatgaatggttgctgtggcttagagcaagtcgccaccttcccgaggtcatccaactctcagaaacagaacttctctgttttaatgagtgtttttctctagatcttgacctagaacttgttgtctaggcagtatctgggtctgacttactaggtttgctggacagacagaaatagaaaagtgcaatgagacaatcgatatgttcttaggtgcccacagagtgtggcaccaacttgtcaagttctggacaaaattagattcattagtgcagaagtcctcaaccttctcttgggtcctgaagcccagcttttgcagatggcgtcttagtcattagtaaggccgctccatcggagtcccygtcatacaaaatattaaaggaagctgtgaagatcggttgcagtgtctgctatcctgctgtcgtctggccagaggtgagccgagactgtggggcagcggggtactgagcagctgctgtataatgagccgagaggggttaacccctggcaaggcaagcagaagagtcattcttaacatgcttagaatcccaatattcattgcagcagcttcaccaaccctgaaaaaccacagcatcagatggtttcttagtaaatacacttatcagaaacagaggcagagggtgcttccctttgaacttctgagacaaaagcccccagcaaggcatggattctgccaccgacggagtatttatttggtctttctaaaatccagatctctgcagccaggaaataacaaactcttgctttgtacttctgtttagccttccatgccaatgactatttttttaattaaatattttctgctttatttttgtgtacaaaagtgtctattttcacacagggaacttggctcagcaaacattcgtagttacttggctttaaacaaaggagaaggttttacattgaatagcttttatttaaaaattggtttatactatcgaaaggaaacattgaggaaaccccccagggcatttggactgggcacagatttcttgaggaacaccccacaagcacaggtaaccaaagcaaaaacggacaaatgggatcacatcaggttaaaaagctgccgcacagcacaggaaacaatcaacaaggtgaagagacaacccacagaatgggagaaaatatttgcaaactatccatctgacaagggattaatacccagaatatataaggagctcaaacaactctatggaaaaaaaaatctaataatccaatttaaaaatgggcaaaagatctgaatagacatttctcgaaagaagacatacaagtggcagacaggtacatgaaaaggtgctcaacatcattcattgatcatcatagaaatgcaaatcaaaactacaatgagattatcatctcaccacagttaaaatggcttttatccaaaaatcaggcaataacaaatgctggtgaggatgtggagaaaagggaaccctcatacactgtggatgggaatgtaaattagtacaaccactgtagagaacagtttggagcttcctcaaaaaactaacaattgaactaccacgcaatctagcaatggtagtactgggtatttatccaaaggataggaggtcagtatatcaaagagatagccaagctcccatgtttattgcagcactattcacaatagtcaagagttggaagcaatctaagcatccatcaatagacaaatgaataaagaaaaggtggtacatatacagaatggagtactcttcagccataaagaagaatgagatcctgccatttgcaacaacatggatggaactggaggtcattatgttaagtgaaattagcgaggcccagaaaaacagacttcacatgtttttatgtgtgctgcccagatgacacaattcaggaaaatctttcagctcctaccagagagtaaagctcttcagctgtagtgggtttacctgctgtgtgtcttcaggcttctcccagttctttatctctgctgtggagccaatataaagttatcaataacatttggtggtgtagatgcttctcatctgtgcaatttaggagtagactctaatacagagcagctgctgggtgaaccaaagatggctttagtgatatttatagcttattgattgcatagttctttgtctgtgattatcattcaataaatactgatggactgagtttcccggaacactgagattcgttttaagcagcttccagcattctttctgtgtatgtggggggaggttcaggaggcagtagaaggtggccataataatgttgtcttgtggtggtagtagttgttataatttcccttttatatcctaattctggccacgacctaactcactgtactgagacattttccccctataatatggagatatgttgctaagcaaccagatcagtaattggtaagtgcttatgtataatatgatttgatttgagttacatacaaaaatatgtaaatggttttttatcttcattattagataaatgattatcatttggttttattttgcccaaataaaataactgctttcatttaccaaaattaacatgatgtagtagaaaggccttggatttagaggatggaaacacgaatgcaagtcccaggtctgagagtcagcagccctgtggccatggctaaagtcagggaacttgccaggcctcgttcttttttttcarcccgtaatgtgtggtacaaataccttctctgctggcctcccagggccaggttaaggatggatgtgatgatgtatagaaaatgttttaagaaaaaaaaaatccaaggtctaagcattgtctagaattccaggctacttaatcttggaactctgagtctgttagtataattccaaaggctggattgactaagaagtactgtcctccagcagggcacagagccatagggcaggtctgcgcctatagaagaaagtaaacacatggcatggaccctgaataagtgaacagtgcagtgatggtggcgaggcagaagcaaaaggccacatggtcaagcaccctgtcattaagcattaaaacataagatagatcatctcaagaccaactgctggccaggtgcagtggctcacacctgttattcctgcactttgggaggctgagatgagaggatcactcgaggcgaggagttcaagaccatcctgggcaacaaagtgagtccctgtctctacacaaaaaacctttttcaattagccaggcatgatggggcacacctgtagtcctcgctactctctaggatcacttcagcccagaagtttgaggctgcagtgggctatgatcatgccacagcactccagcatggtgacagagccagaccctgtccttaagaaaaaaacaaagcaaacaacaaaaagacaactgctataagacttcaaggggaaggacaatgatccacgggggctgaagtcactgatgagggcaacttctacaagtccttgaagcataggaaaattcttttttcttttcttttcttttcttttcttttctttttttttttttttgagacagagtcttgctctgtcgcccaggctggagtgcagtggcgcgatctcggctcactgcaagctctgcctcccgggttcacgccattctcctgcctcagcctcccgagtagctgggactacaggcgcccgccaccatgcccagctaattttttgtatttttggtagagacggggtttcatcgtgttagccaggatggtctcgatctcccgacctcgtgatccgcctgcctcggcctcccaaagtgctgggattacaggcgtgaggggaaatttttaagggtaaattcacagcgatgatttccattggttaactctgtgcattaacatgcaaatgtcaatccatttccaaatgataacagtgcctggctgtagtattttaacatgatattgtttgaggctaatggccaccatgtttgcctcctagcagtaaacatgttatttgaagtcatgtcatgaattaccttcctgcactaatgaaatagataatttacataaaaatcaggaaaaaaaaaaccccagccccatatgcttttcaatctctagagccatggaaatgacctccctgacagccaattagaaaatacaaaggtgaaggtggatgctcttattcccgatacggagaagttccagaatgactagcgtgcttcttggctatgcccaaatacttttaagtaggtgttatttcayaataaagcattaatggtgtttgttacatgtggatgaatatcttcactgtgtctggragctctgcctcagaacgtaggatcttgttccctatccctgctgtttataatctgttttattaccttctcccactgtgtcatggaccggatggtttttctaggggctgctgtgatctgtcttgtcattgcttattatcagatagccttaatcctcagaacattgaaatagttctataatggcacgtgagccatggcagcccacagcagcactggccattttcacatgaaatggcagcctggattgtcctttacatgctgacaggggagactgtccatctgccacccctgtcctgggtcgggaccctttctgttcagcaggtgcagtggctctgagagtctcacagtttttcagttgatatctcacccatcaattacctgggttggatttgtagagctcgaatgacctcttaaattttataaacactttacccacctatttgagcatcccacacttgagcacccctcagacaagatgaaatattcttaggatagggttaggaacacacagtattcctgaaacttttaaagatatagaggtccttaaaaattaccatattgcctgattttcctgtctgtgccccaaggaaagttctattcttcatgaagctaataatttttaaaagattgctaggtcaatattttagtaatctttagacactaaggataggagatttcaatttaattctcatgagatgcacttagaatgacgggttttccatttgaacaccctgcagttctcacaatccagggtaatagtctgacaaatagtctattatacaattacaaaaaaaaaaaagtcaaaatcaagttccccctctaatctacataattgagacctaagactttccctgcacttaaagccattgaatccaccagatgagtgtggacctcatttttttaggtttgggtagatctggccaatgagagcaagtaaccatcctatgtgaagytcatttcagttctaaactgatccttgaattcagatattgtcatattgatgcattaggagaattgtcttgggtgtgagatgagtgaggctatggagagaaaggactggcactcagagggaagactgagcttactgggacattctagccaaggacaggctactgctcttctcctcactgcctgataatgctcagtgtggcaccactttttttttttttatttctgagacagagtctcgtgctgtcccccaggctggtgtgcagtggcgtgatcttggctcactgcaacctctgcctcccaggttcaagcaattctcctgcctcaacctcctaaatagctaggattacaggtgtgcgccaccatgcccagctaatttttgtattttcaatagagatggggtttcaccatrttagccaggctggtcttgaactcctgacctcgtgatctgcctgcctcggcctcccagagtgctgggattacaggtgtgagccatcgcacctggcccactttttgtttttttataggtgttcaggaaatattaatttcatcctgctagagagactttttccttgaaataaggcacagataattatatgaagytaatggatgtttaaagatgtatgctgggataaatagctttaggaaatatattgtactatccttggtaagaataagacaagtagtttttaagttatggtagtttttaagttaatttttctgctactggaaatcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgattctcccacctcagccacccgagtagctggcattacaggcatgtgccaccatgctcgactagtttttggattttagctgagatgggggtctcaccatgttggtcaggctggtctcgatctcctgaccttaagtgatccacccacctcggcctcccaaagtgctgggattacaggcgtgagccactgcacctggccgtctttaccttttcaattctctcatgactgcctctcctttatgtccctaaataatacaattatacgtgaatgatttctcaaccttaaccttctcttctctgtgtcattgaagtgctatatgaaaagaactgaagctgctgacctctaagacattggaatatataaaaaaagatcaaacagctgcttataatgatgtcaaagataaaatgctattatagaatctatggctgtaaaaatgtgatttatattaatttttagtattctgaaaatttcctgatatatttattttatacacacattttaagaaaataattttatatgcattctcaagatgacttcctctatcactgtttttctgcattgaagccaacggaggctttcctaaatggagtagagtccaggagtcattgcagaatctctatactggaaatcattctggttccccactgcacgcatccctctccctcgtattcctggtaagcagttttctacccaccatttggatattttcagtgacaaaacacactcactattttatgaagccaacacatcactagtgggttattccaattttgagagaaatgtcgcttatacttatcaagctaaagatgcttttatgtttcacctgctgctttggtacctgtattacataggtttaacccctattcagatacaatacggtacaatacaggacacatagrcctagattcagccttggctctactacttattatttattatattctttcaaaggatcattgattagtgtactaaatgctttacatgtactgtcattaaattctcataaaaagtctaaaaaagtaggtattatttttgcttcatcttcctrtgtggaaactgaggcttgataataatatttataatagtgatgatgatgatgatagcattgtcatgtgccaactgtgttccaggcactgtgcttgggcctttataaacattatcagaatttaggtaacttccctaagattatctacctagcatctaggaagctggatgttcaaactaagtcagaaaggcctcaggatttaactgccttgagcttcacttgtttgtctgttaaatgggggtaatattgttctcctcacgagggcttctgagattcaaaaaaatggcttatgaaagtatctggcatccttgcttgaaagatacttccacatgtcatttattcatttctttaaagagagctttcttgaaagactctttccttcctctttctccaggtttcttttctccaggctaaatatccccagctcctgtagtcttcgttcattcattcaaaacataccgtgagctctcttccctggtaaaatttacattctagaggggaaacagacagtaaagcaataaacatggtaaccaagtaaagcatctgctatgttacaagataataggtgtcatggttgtgaacaaccaagataatggaaattaggagtctgggagtgagtggtgttttattgactgtggctgtgtgacaaattacccccaaaacttagtggctaaaagcagcaatgatcatttatcatctctcgaggtttctgggggtctaaaattcagataagacttagtgggtgtgatttatctctgttccatgatgtctgggacctcaggcagaagacttgaaggatggcatctggaatcctctaaaggctcattccttcatatgtctggcagttgatactggctgtcttctggggtcctcagttcttttccacttgaccctctccatgtgacctgggcttcctcacagcatggaagctgcgttcccacggtgagtgtctcaagaaaggaagccagggagaggccattattgccttttgtatccaaagctcagaagctctacagcatcacttccattacattctgttggccagggcaatttcagagttttgcttgggttcaagaaggaacatagacgcccacctctcaaggggagagtatcagtgtcaggttgtaagaagtgcctgtgggagacacatggatgcagccatctttggaaaggactgtctgccatgatgggcaaggtaggttcacggataaggtaacatttgagcgaagatttaaaggagatgagggagtgagccatatgcccatctccatctcggcagagcattccaggctgactcaagagcctgtgcaaaggccctgagatggggattggaccaagaatatttggaggctaggatgactggagcagaatcatcaaagaagagagtagtaggaaaagtggtctgagggatatggggggaagggacagaccacgtaggctttataggccactgcaagtactttggcttttactctgagtgatatggagagccaaagggagggccttgagcagacttaaatcttaaaagagttactctggctcctttgtgaataggcaggtggagagcgagtacagaagatggcagacaagttaggagactgtggcagcaattcagcaagagaagtctgtggctctgaccaagatggtagtaaaggtggtgagaggtgatgggatcacagatctactttgaagttttagccaacaaaacttcctgatggattatgtgtgagaagaagacaggtcagcatcgaagaagtcattggaaggatggaattgccattttctgatacaggaaatgctgaatgtgtaacagctttgcaggaaaaacatcaggacttcagttttagggttggcaagcttgagatgtttattagatatccaagtggaattgttgaagaggtaattagatacataaataaggatttccagagagggatctaagctggaaataaaaattgattaatcataggcattaaggatgttatttaaatcatgatcctggaagaaaacaccaagggattgagtgaagcagtaaagaggacaaggactgagccctgaggcctccatcgttaagaagctgggcagaagagaaggaaccagcaaaggaaactggaaaggaatggccagggtgtcctagaaaccgagcagaaagggtatcaaggaggaaggacctactcactgctctgagaggtcaagatggggctgagaaccattaacttgagcaatcatggtggtcattgggaacccagacaagagcagtttcagatgagtcatgggacacatgcctgaatggaatgagcttatagataatggaaggagagggcctgcagaaggccagcacagacaacactttccctgagttttgcggccaagatgggcaaggaagtagaacagtagctggctggggaagaatcaggagaaggatttgtgttttatgttttaagatgagagaaataacaacatgtctatgtgctgttgggaatgatctagtagcgtgaaagtttgtaggagggagagggaggagggaaaccttggagggatatcctggggtgtgctttactttcagggatcctcgcttttctcctcagcaggggatgtgtggggtgggcctgggtggcagagataagaaaaaggaaaaagccatgaggctactgcccgttctaagctgcctttcagtatcactcccttcccctgtctgtctctccatgtggactgggaaccccagcaggtaggggagtgggaaccatagccattgcctggtcctttttacactgtgaaaaggaaccttgaatgtagatggataaacaccatcttttagttcctggcagatcactgtcttccttcttgttctagtcctctgagacataggcaggctggcttgagagcagggagggatcgctgagcagaggtgtgtgcgggtgttagaaggtgccgtgatgccttgtgccaatgactgacctgggatgagtcactgttcatttagggagagaatttcaaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcrgtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagwgcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggayacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctctgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttktttaagagaaaacgaagtaagcctagcagatctgatcgtacaatcattttccccttattgttcctttttccactccagagctgcccagaagttaaatctgtcttctaaaaagaagaaacatcggccttccacttcttccsctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcrtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttawcgtgactccggccctgggcttcatttggccgscgttgctagtcttgctgaagctccggagcaactactaaactgtggggatttagattttacttgttcagttcgcagactgccagtcccctgggtacccaaacacggtcatgsctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcytcctctgaggggragcatccagtcctggagctttccttggtggtgggcagggcagacagttttcagctgagggctttcccaggcccagcagcaaagtaagacccaaggaggcagggmrgtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcayctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaamattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagygagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttgaggtagacaagtttgatggaattcccaaaagcargttgattgattatttaaacctgacctggagtctcctagagtggaggaggggagcaggaatctccaacgcttgagatggccctgaaggtgagagtgttgtcacccagccggaccactgcccctcagcctcagccacccaccacctccctctggaaacctgggaggccttcctccataggaacagatttcatgggtttatgtagagcaacttcttatttagtagacaagaaaactgaggcccagtgaaggtaacaggttttccagtgactccagaagcagggcaagaagtcaggacctttcggccattttatttcctactgtatcactggctgtcactagataaacatgacccttgacaatttggggtggagacaagagtgtcatggaactgcagtggtagcaaaataacgttgggaaccaattgcctttgtccagtggggaaagacatacttttcagagtcaggattgggagaggaaggggaataacagccaagaatagatacacagaatgagggagaagggaggcgtgctatcccatcccttccctccttcccactccctgctgtttccagcaacaatcccactccccagccaccaccagggagtcatttctggccactgagcacctcttgaggcaaaagcttttctggaggccatggtgatggaagaaatggaggtaatttccatgtacttggagttgaggcatgcacacgcacatgcgcgcacacacacaaaccatctcaggatcctctgcccctagagcatttcctgatacacagcaattttttttttttttttgagacagagtctcactctgtcccccaggctggagtacagtggtacaatcttggctcactgcaacctccacctccggggttcaagtgattctcttgcctcagcctcccaagtagctgggattacaggcatgcgccaccacacccagttaatttttgtatttttagtagagacggggtttctccatcttggcgaggctggtctcaaactcctgacctccagtgatctgcccacctcggcctcccaaagtgctaggattacaggcatgagccaccatgcccagcccacagcaaatatttattaagcacctactaggtgttaggtactgtgctgagcggtaggcttaggtttgaaataatggacaaggcagagcacctgtccttaaggtacttataacttagtgctttattscagtcagtcttagaaagctcaccaatttgggccaatatgaaggacaatctgatttaaggaaaaatcaggattgtaggcttaaaatgattctgtctcactttgaagttacataaacaaattatgctactaagtagtcttatagagatattcttaataagcagataaagatgattagtggatcaaagcagcttagtccccattcatatttcactgatttggcttatatgtaaatgatgattctaatctgtttgaaaacggttgcttctcctaagtcagtcaacgttcttcatgaaatttgtttgcacaattaattaacatccatgtttaaggttcatttgttagtatgtcacagcttaatgtcagagctttctgtcttggattagaagcttccagagcaaagcatgttatctgtttgacttgctaagtatatggctctgcagccacaccatggtgcatcaacatttttaaaagtgagaatggtaatggtgacagtcatattggattgatgacaatcaaccttttacccttttagggtagaagtcattcagttactaactccttgtgacactgtatggaagagaaagacaagatttctgttcagtttacattcttcttagaggaagaggagaacaagatttttaaaattagattaaaatactgtggttttttgtttgtttggttttggttttgttttttttgttttttgttttttgagtcagagtttcactcttgttgcccaggctggagtgcaatggcacgatcttggctcactgcaacctccacctcctgggctcaagtgattctcctgcctcagcctccctaaaatactgtttttaaaaaaggtactcggtagctgttattcactcastcaacaagtagaaacagtggggatagctctctgttgttcaggaggtgatgccggggaaaatctcatgcctttcagcccaccaaggtgcagtttatttacacacagattgtccaattcctcattattattgctgtccttcctcatcctgaagcatgaccaaagagaaaagctctgagccagaattaacatctttacttcaagtattcataaagaattcaaatgtgatggacaattctggatcccactggatcccagtagattctggatcccgctagatcccactacactcacaacttcattcttaaacactaaagttgggaaaagcaaattgtgagttctcttttattttggttcactgttggagggggcgggaacggcataaataatacctattcatcactatagctagcctgatagctttgtaaattaaattgttagctcttctgggaaattaactcatgtgacgttaaactccatagttaagcttacgtagagttggggktggtggttgttttccctttcttcctttatttcttattttgagccttccttcaaccgatacctccagagaaaggcgacttggggaaaatgttctgactcttaatcttcgcggtttcttttttcccacggatgtagatttcgccagcctctggacagcacatgcgcagtatgctgctagcgccgccccaggcgcccggagctcaggaagcgcaggtggcgctgccagaagggccatgctatttctggggcaaacctgaaagacctcagacacaggggctttcttctatgccatgccactgttgaacttagcactccccgttcttgcaaagagtgggaactgttaggagaatattctccgttagaggttactgggcaggaaagtcatcccaaggacgtgtataaagaaagtgtgagccaggcatggtggctcacgtctgtaatcccagcactttgggagattgaggcgggtggatcacttgaggtcagaagttcgagaccagcctggccaagatggtgaaaaccctgcctctactaaaaatacaaaaattagccaggcatggtggcaggcacctgtaatcccagctactcrggaggctgaggcarraggatcacttgaacccgggaggcggagttgcagtaagccaagatcgccaccactgcactccaggctgggcgacagagcgagactccatctcaaaaaaaaaaaaaaaagtgtgaagccattttcattcattattaatatgatyacctttaattctgctgatgagggtgtgtggatatcattttctgttgtcttcattatcaaatggagaactagaaggggtaagcagcacattttggtttaattagatcagatttrtgataggatggcatatcgctacatataaaatactcattttctggcgttcctggccagagatgtctacacagagcaaaatggatgaaaggacccacrgtgagcagggaggactggtttggtccygtagcccagagtctcctatcttatataccaggtctgttcttgagctttcagagtgcaagtagagaaacagaatttagcatccactttctccgtggagatcctgcatttcctacttctctgaacttcccctgcctgcttcatatgagtagacaggctcttctgaacacatttttgtttaagtttcagggacctgacgccttccaggcactgatatgtgtacatatactccacaagacgtatctatgggcaagctagaattcagccccttatgtttctagtggaatgttcatttcagtttccgtcactaggttgttagcttcttgggaggaggaaacatgttcttttcatctttgtaccctttcagtgccagctcagtgctagaaaggatacacaatgtggttgaacttaaaaaaaaaaattctatacagtccgtgtgaagtcttgatggggcgctgagcactgtgtagggtccgtcctgaaagaggcagctgcaaaaatgaggcagaaacagtgaaaacatggacgtgaccagaacccagtggtccttggctccacctgctcttcccagggtgcgagttgtcccggggttttacatcaggaagaaggtgacgcttcatgccacacgctggcaaagaggaaacagtgtccacattcctcactgaggaattttctcgaagaccttcttgtcctgtcctctcattttgcatgtaaggaaactgagggccagcaagaggcactaacttgtcatcccactttgtgggagaagacaaaagtttaaacttctgaatgtaaaagatgatttgttgtggaaaactgttaatcagaatttgaataagagattcgtaatcttttcctcccattttgcaacttttttttttttttttttaaaaacaaggtttcactcttgttgcccaggctagagtgcaatggcacaatctcagctcactgcaacctccgcctcccgggttcaagcaattctcctgcctcagcctcctgagtagctgagatcacaggcgcccgccaccatgcctggctaactttttgtatttttagtagaggcggggtttcaccatgttggccaggctggtcaactcctgacgtcaggtgatccacccgccttggcttcccaaagtgcttggattacaggtgtgagccacagcgccctgccccattttgcaacttttgatctcaattctgctggctctattttaaggtattaaatggagatggtaggcttgtgtatgtgtgtgcacgtgtgtgtgtgtaagtgtgtaggaggaggagaagaaagataatttttataaggggactttttaaaagctagcaacctttatcataattggtggacagccttggggcctcctggaatacctgtaattcctaattagcatcctgatttatggaataaaaacatgagataaaatgagggaattctctctggaataaatgccactgtctcaattaaccaaagggcaataagatggattataatgccagaatagggcttttgatcagtctttgtccaaaaaccacattttagttaagctcagcacaattagaccattactgatatcaggagaatggaaacagtaggtatattttaagctaacattcccagcatcttatctttctatagtctttctcttgttaatggatgaaaggaaagttaagcatgatttgttataattatcccattaaaatgggatcgatagaaatattttatgttaaaaaaatggtgagtccaaactgctgagttaattagaaagttttcctttgtgcctcaaacagaataggaaatgctgttcttgcctactgaattgttcgtatcaaatagaaaatatttgaatccctttctaatgcytcattgaaccaaaatgtattattatggagggggagaataattccgatacattctttttttttttgagacagaatcttgctctgtcgcccaggctggaatgcaatggcacgatcttggctcactgcaaactctgcttcccagattcaagcgattctcctgcctcagcctcccaagtagctgggattacaggcatatgccaccacgctcagctaattttgttttttagtagagagggggtttcaccatgttggccaggctggtcttgaactcctgacctcaggtgatccgcccgcctcggcttctcaaagtgctgggattacaggaaaaacaaccaaaaatagaacaattacagtagcaccgagtgctagagacaaatttcctgccaaatctcttttccagttccctcagtctgcstctgtgttctgtgccacaaccaaagattcagatatcaattttgtccacttgtagctcatttgagatctgttaagcaacaacagtgaatgctgggtggattcrttagtggagctctgttccagctgtagctaataaagttattttctcgctgaaatcggtgatggtaaaattggtctgttttccaatgctagcttcttyagtttccgctgagttcttttctcctggagtgtgagatcacaatggcatgccttacaaaagagtgctcttgcctgctccrtcctggctgctcccaggccgaccctggctcctcaccagcaccctgcygtaaacgctcagctgccccttcccctagcagcagcgtcggcactacatttaggaccctttctgtatgtaccctgaaaacccaccggcgcagtggttaggctggagcagctcaggccagcctggggcaaaaggcagaggactgagaccatgcagtgagattggtgcagtcagtattggtggaggagctgctgggggccaggcacatgctggaaaagtggcgtgttatgtcccggggtctgaagcaagaatgggatcaggcagtgtggaaccaatttgtaaactcctcactcactgactgtcattagtaactaagttgctacaagctctttttttgtgagcctcaaaacaggaagcccagaagagtttacaacaatggaaactctcaggtttctacaggaaaaaggagaatgttgttttccccaaaggttatttccttctgcagcctggccatgtgcccctttccctcaagtttgggaagcaggacaaagggccctggggaatgccttagcccatgatgagctgagggacagtcatttttgtcccgtcatcatgcatttgatttgctccttgttttatgtaaatatataattttagacagcgtcttccttcgtcasccaggctggagtgcagtggccctgacacggttcactgcagcctcaacttcctgagctcaggggatcctcccacctcagcctctcaggtagctgggaccacattagccaccatgccctgctaattttttgtattttttgtagagacaggatttctccatgttggccaggctggtctcaaacacttgggctcaagcgatccacccgccttgacctcccaaagtgttgggattacaaacatgagccactgcgcatggcctgttttaaacattttaagaaaatattttatcatatttgcacaagaagattttcagtgaaggacaatgttttgaaaatccaatcagtaagatrctcgctgggaggtatttttatagaaatccatggaaagctaatcataggaaatcggaaaaacagagagcagggtttgtagcttggcctttcccctaccttgttccgcattctataaaaagtgaaaaagtagcaaagtagcaccctacagggggctcagaggtgctggaggactaataacgcaccatttgcatgtccacgccacgcgaccctgcagtcacgctctgttacaagtacagatggtgaaagtgtggccaggaatggatgccggaagcccagaaggaagttggctcttgtctggaggctcccagggtggatctgcacagccttcccttggctgattcctgtccatcctgtggatatcagtgaaatgccaattccttggggaggctttccctgccaacctccccaaccccaggttatccaggctgggtgccccctcgtgtgcttccgtaaccccccaaagtttctcctcattgcattcatcactctttagatgactgatctgcgtaattccatgttcagtgggtctccttaatgaatgtaagctccatgagggcagggccatgtccttcttgttcccctttgaatccagagcactacacggtgcccaactgtcataggtgctcagtaaatactaggtgtattagccagagttctccagagaaacagaaccagcaggrtgtgtgtgtgtgtgtgtgtgtgtgtgtgtgtgtggagtgggggtgggggattgactgattttcaggactggactcctgtgactgtggaggttggcgggcaggctggagacgcagggaagaggtgcagctggagtccaaaggcgggcagccgacaagcagaattccttcttgctcagggaaagtcagctttggttctattcaggccttcaactggttggatggagcccaccacattatggaaggtcgtctgatttactcaaactcagctgatttaaatgttaatctcatctaaaaaaatacctccacagaaatatgaccaaatatctgaataccggggcccagccaaaytgacacattaccatygcactaggggaatgaatggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcgattctcctgcgtagctgggattacaggcacatgccaccactcccggctaatttttgtattttttatggagatggggttttaccacgttggccaggctagtctcaaactcctggcctcaagtgatccaccygccttggcctcccaaagtgttgggattccgggtgtgagccaccrcacacagcctccctggattcttaatacagccctgagaggtaggcagtggggcagtgcgrggaggcagggkcttgttagatgctgcccatagatgagaacactgagattcagagagggcaaaataattcctagaggtgacaccgcttttcagagtggatggggtgacaccatatgtttgtttctactgttcttttccaaatcatacaacatatgagccattcatcttgtgccaagcactgttcagaaggctccatcctcatgacacccctgtgggaagcttccaccatcaccactcctcttttacactggaggaagctggaccggatctaaggaatctgcccagcatcacatgcctggtctgtggtggagctggcctatgaacgccaactctggaacctgtcctctggatggctgcatgagactgtctctctataggcaccttatgtggtcattttggtttcagaagaggtacagtaagcaaatgttcctggctggcgtgctgcagctgccttggcggggtggcaggcagggggctgtggcggaggctgaggctggtcgtcctcctctgccgctgacagtcccaagctctcttccctcatcatctcagatagctttgtggttgtcactgtgttgttttatatatgaatattttttatggatttttatatatggatygcygtgtgacttatgtttccctgccctaagcacaccgatgaaagtacattaatactcaaaatgactttgaaaagaccaaaagaaacaaaaaaagtcctaaaytccgtgggaggaaaaaccatgatcctttagccctactccrgaatagtaagaactgagagccaaagccaaggcggggacagcaccctgggagctgatgggctggttagtcccatcccagattatatggaggcacccgggtgattccatttcattgagaattctgtgtctagagcaccagacagtgaccacagaaatgtttaaacttcagcttttgtttaaagagatgtgctgtgagtatttatcgagccatggtctgtggggacactgctgggagagggagcatttctggaacccatcgtggctttcttccttgtctggcctcggcttttactttccttttttcatggacccctctatctcttgtgtccaaacccacctacttttccaggtctggctaagtgccttcttcctccagtgtcccacccctgtcccctactgagcccccttttctccgtgttttgtatcatgtaccatcccttgcccagatttctctgattaaccattcaccactctgttgctgtcaccgctttatgggtctaggttttctcctccactgagtctttaggctacttgaaggtgggaatctttgttcctattgcgttcatatccctgaaaatgcttagccatatgtcagacagacagaactccctgaactgaaaaacacaaagatgtggagaatagcacagtctttatatgactttttccctgcttgtccctatcatttacccgtcacctcttagtccatctggtcatccattgattcattcagaagacaggtattacgtatcttctatgtgctagttactttggggatacccagatgagttaaacatggtctctatccttaaggattccagaagttgctatcagaaagagttaaaaatcattcttcaggtagatagctcaaactaaaaatacctgttattatggccatcactccggcttaccatggcagataaggctgaaatttgtcccagataattggcttcctggtgagctttctccctccttctttttcactgagtatacgctaatattcctccagtattcatactgcatggtgaggacagctgacggtatagcagccagggaaggctgcacctgtgtttccattttagcgctttgatgtgctgcatgcggttgccctgcaattagttcatatgcrtgaatcacaatggcatatgtaaaacgtgtgctcatacagacccctctccaaagacctcacgcatcctttgcttctggagagaattcccctgaatgtatgtgatgaggaagttgggcttttcctctctgtgccaggctgaagcgaggggctttgctcaaggtcgtatagaaagtcgtctgcccttccaggccgtgctcttccattggaggcaacacctgggcgttctttgttttgcctttgccgcagagggagaaatgtcatatctttcaaaattccagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgsgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaatctcttcttcttcctcctcctcctcttcttcttcttcttcctccttcttcctccttcctccctcctcctcctcttcttcttcttcctcctccttcctccctcctcctcctccttcttcttcttcctccttcttcctccttcctccctcctcctcctccctccctcctcctcctcctccttcttcttcttcctcctcttcttcttcttctttcttcttctttaagaaagggtctgcttttgtcacccaggctggagtggagtggcgtgaacgaacacagctcactgcaggctcaacctccaaattcaagcgatcctctcaccttaggcccccaagtagctgggactaccagcatgcaccaccacgcctgggtaatttttgtatttttttggtagagatggggttttgccatgttgcccaggctggtctcaaactcctgagttcggatgatttgccggccttggcctcccaaagtgctgggattacaggcatgagccactgcatctggtgtttttgttgttgttgttgttttgagatggaggtctctgtatcatcaagaatggtctcaaactcctgggcttaagtgatcctcccacctcagcctctcaagtagctgagtttacaggtgcaagccaccatccccagccaagcacattaatctttatgaaaatgttttgtttctgcctttccccactcttgcaatggctcaccacagtcatcccattttcccagcagcgtggaactcacagtcagaagggcccattctccmaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtygtcgcagccggcaggtcccagctctcctctttcaattgctgtgtgaccctacggaagatattcagtttttctgggcctgaacttctttatctgcaaaacaggaaaacgaatcatacttcctcagagggtaattgtgaggctccaataactgtgctggagaaagtggggtatgaggcccggtttggggctgtgggagcacctcttccttctgttggtcctaggagctcagcgcttggtgggatgttccagaccaggagaggctgggactaaaattccagrgtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctggctccctggcctctagttcctgcttctctcgcctgcccccttgactccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaagttccctcctgcccctgaggcctcttgccatrctgggctctaagtgggcatttatttctctgtgcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaaygcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggcatttaaattaaaatttggccaggcacagtagctcatgtctgtaatcccagcactttaggaggccaaggcagaaggatcgcttgagcccaaagttgagaccagcctgggcaacgtagggagaccccatctctacagaaatttaaaaagtagccagccatggtggcacacacctgtaatcctagctaaggctgagacaggagaatcacttgagcccgggaagtctaagctccggtgagcctgtgattgtaccactgcactccagcttcggccacagagtgagaccctgtctcaaaaatagaatattaattaattaaaatttaaggaattctgtttttactacggtgagtaacaaggttttttttttggtttttgggtttttgtcgagacggagtcttgctctgtcgcccacgttggtgtgcagtggtgcgatctcagctcactgcaacccccacctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccaccgtgcccagcctatttttgtttttgtagagatggggggtcttactatgttgcccaggctggttttgaactcctggactcaagtgatcctcccacctcagcctcccaaaatgctgggattacaggcgtgagccaccacacccagcctaacaaggttttttgttttgttcctgtaggtctattttttttttttttccaatcagtattttcaatgttttggctccagacagatttcagtggtgcatcacatgttaccgacgtgcctcccgtgcctccctgtctgttcatctgctgtcgtctctgccagggatgctcgtctctcattcgtttttttggcgtggaaacacgctgctcagtcctcaggcccagctcccgtgtcacctgccacctgcaggccttcctcttgtcccttctccaggcactgtgcctgtgtcccctactccagaccgtgagttgtggatgaaaggggctgtatcttacttgcccctttttgcatttattcatgtggatacatagatgctcattcgcttcaattcattgaacatctgctactggccagggactttttcccttttggaaggagacccagataccctccagacataggtccggcctctcaggagttttcattctcctgagagaggagagagacttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatttgcatacctcatttcatttgtacataactcatttgcatataccaactcattaaagttgtctcttttactagtgaggaaactgaggcctagagagtcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctyactactgacgtaaatgtcagaggtggtcctgcctcttctcagtctccatcccaargctctttacagctttctrtggcctgattttcttgctgtggatgctgaagggcactcttcagtggtttctcccagggccgttgcggattgcagctgtttcatacccagatgacctgrggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccctttttttattagagtcaggatctcattgctctgtcacccaggctggagggcagtggtgcagtcatagcttactgcagcctcaaactccggcaggtctcaagtgatcctcctgcctcagcctcccgagtagctgggactataggcatgcgtcaccatgcctgactaattgtgttattctttgtaagagatgggctctcactgtgttgctgaggctggtctcgaactcctggctttaagggaatcctcctgcctcagcctcccaaagtgatagaattacaagtgtaagccaccacacttgtccatcattgccttttaatctttgcatcctgccayctccccagcacagccagcataggagccggcacttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtgggaacgatgttttcgttaagaatggactgcctgtataatggtggtcccataagattataatactgtgtttttactacaccttttctatgtttaggtatgttgtttagatttagaatatgtaacgcaattaccgctgcgttaccagcaatcccaagaggaccccagaccctctgaaggaagcgggctcctgcaggacccgggagacagtgttgaacttgaccttgctctcctcctcgggtcaggcctgccgaccctgcactacaggttcctttttctctccctgtccgtgcatccatctgtttctgcactctcttcggtgcgtcctctgaaccaccagaattaggttcctccacaccaaatgtgatcatttcatttcgcagctagattgctcgtaaacagctaagcaggtcacgctgagctcgacacagtccaatcccaaataccagtcaggctcccaccgtcccttcctatcccaaaatgtcacctcccctgtgttgcagccacactgaagcctcaatgtcccctaaacattccagaccctcttgtgactctgagtctctgcccctgggttcacgccacttagaacgagcttccccccattttctgcgatacacactgtcactttccctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatctttagacgaagcatcaacaaaggctttttcactgaaatccaaactcaaggtgtatacatgtcacctcccagcacagcaaatggcacagactcgagggaatgttttccttcyggaacaacattataaagcagcagcccccagcctgtaggcaccagggactggtttcacggaagacagttttcccacggaccaagggtggtggtgggggaygatgatttyaggaagattccagtgcattccatttatcattagattctctcaaggagcgtgcaacctagacccccacatgcacagctcacaatagggtttgtgcttccatgagaatctaatgctgctgctgatctgacgggaggcagagttcaagtggtaacgcttaccttctgctgtgtggcctgcttcttaacaggacaccgactagcactggtccgtggcctgggggttagggagccccgctctgttacagagaacaaaatttgttacgtagggatcacttgagcccaggagttcaaggctgcaatgagctatgattgtgccactgcttttcagcctggctgagcgagaccctctctataaaaaatttttttaaagagtaaaatttgtatagtttttgggaatttactatggtgatattttatagcgctgtcaggaatgctctagctattggtgggccctcagagcacagtgaattcgagggctctgatgtattctgttgttttttttgggtttttttgttttttttwttttgagacagagtctcactctgttgcccaggctggagtgcagtggcaccatctcagctcactgcaacctccacctcccgggttcaagcaattctcctgcctcagcctcctgagtagctgggactacaggcgtgcaccaccacgcccagctaatttttcctatttttagtagagacggggtctcactacgttggccaggctgctctcaaacttctggcctcaagcaagttgccctcccgggcctcccaaagtgctgggattacaggcatgagccactgcgccgagcctctgatgcrttcttgccggtcatttgtacagtgttgcttgcatgtgagttcttcttcaggtcgagattaagggtatgacattagtactaaccattattcaacctctgaaatatacgcacatgggacaaaggagataatttcatttacttatgtggccttactttgaagatattcatatgttagtccattttgcattactataaaaaatacctaaggctgggtaatttataaagaggtttaattggctcatggttctgcagctgtacaggaagcatggtgctagcatctccttggcttctagtgaggcctcaggaagcttccgatcatggcagaaggtgcaaagggagcaggcatgtcacatggcaagagtgggagcaatagagagaagggggaggccccagactctttaaaacaaccatttctcacatgaactaactgagcgagagctcactgatcaccaaaggatggtgctaagccattcataagggatctgcggccatgatccagtcacctcccagcaggccccacctccagcactggggattacatttcaacatgagatttggaggggcaaacctctgagccatatcaccatagttagtgcatgccagatgatttttgcgtttcccacaggatgtcagtgagcctttttctcagtcatggccagccccaacagagaggcaagatgagttcctcttggttgtgatgcctcttttcttttcagttcacactttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagagaaaaacaaagaaattaaggacagcattgcgatcacttttcttcctccaaacaaaagctttcaagcgcaacatgttgatttttaaaattcctttctgggctgggcgtggtggctcacacttgtaatcccagcactttgggaggccaaggcaggcggatcagaagatcaggagttcragaccagcctggccaacatggtgaaaccccatctctactaaaatacaaaaattatccaggcatggtggtgtgtgcctctaatcccagctactcaggaggctgagagagaagaatcacttgaatccgggagatggaggttgcagaaagccgagattgcaccactgcactccagcctgggtgacagagtgagactccaactaaaataaattaataaatacatgaataaataaaaaataaaattcctttctgtagccactgtgagccaaaagcacgggcttaaaytgcagagtgctgtgtgtgcactcacaaatcccaggttcccagagtggagagccytgcaccccagccgcggccaagggtcagaagtagcaactggtgattaatcaagtggctcctgtcttaggacagtcagcgtttattgtctctgcaggccagactatagaaataagcagacccacaaaagccagcaattaatatttccccggagagattccagatgctgccgggtggactgtgacatgctagcattcttcctgctcctgatttattccattgtgtggaagagcttccacagaaatgactctttggatttttcaggaaatgtttcaagccttcttattcagacaccctttcagcgtccagtgatggacgaagctgtgccctagagtcccaccttcccaaacagtgggcaacttgctttctccagcctcctgtccccttccgagcacccttcacccctcccatccccaggagtcgctgaataggtcccatgggagagaaatgacagcttgaagtgatgacccatcccaccccatcaaatgttggcattttactctggcctccaaaggcatggggggatgacccatggcaggaatacaggccttacagagaggttcactccaaccaaaccatgctgctcccccagtggcccaccatgaaaacctctggaaaaccaacttatttgccaaatgactcccatgagcaggcctttgcaaaatttcagagtgttgtacagctgcatcccaggacaaaactctttcttttcagtactaacagtgcaagtagaatagggtcgtggtggagcatcccattgtcttcattcctggtccactaattttcatctgagttaagagttttgggtttgaattcaagggaaatgaaaagttcttaaaggggccrggcacggtggctcacacctgtaatcccagcactttggaaggtggaggcaggcagatcacctgcggtctggagttcaggaccagcctggccagcatggcaaaaccccgtctctactaaaaattaaaaaaaatagccggggttaatcccagctactcaggaggctgaggcaggagaattgcttgaacttgggaggttcagtggaggttgcagtgaggttgcagtgagccgagatcatgtccctgcactccagcctgggcaacagagtgaaactccatctcaaaaaaaaaaaaaaaaaaaaaaaaaaaaaagaagctctcaaagggcctgagccaggcaccgtggctcatacatgtaatcccaacactttgggaagccaaggcagcaggatcacttgagctcaggagttcagcctgggcaacagagtgagactctatctccacaaaaaatgttttttaaaaattagccaggtgtggtggtgcaygcctgtagtcctggtgggtggccaagtcaggaggatcgcttgagcgtaggaggttgaggctgcagtgagctatgatcatatccctgcccttcagcctgggcaacagagtgagaccttgtctcaaaaaggaaaaagaaaatggcttgaaaggcatgtgagacattacatagtttgaggtatttcctttgctatatgcaaaggcataaaaatgaacagggagctagcggtttattgctggtccgaaccagcaacatcacagctggccctgggcgtcacagggtctcatgggggtaccttaagaggattcttaaatgaaactcagaacacagagaagtagttgattttgtgtcttgcatgttctgactcttcatttagtgtcacagcaagggtcaaggatatgggaaatcataaacaatcccaagagtttcatgatctttgagaatcttaaagcttcatctaagctatgcttttgaattgggcagaaccagaatggatacaagatgaatacagttcaaatgattctaaaactagagattaaatcctgtgaatttcctactctcagcaggaggagattacaactatttccaggtttaagatgatgaacatgattggttttgccccgtgctcactgggctcagatgagaaatagctttaaggtgcatccagggtttggttggttgtgaagaagaatattccttgtcgtcaatgaataaatgttgtgataggtcattagaggaggatctagagccctttgctggaaattgtttgaatttgaagccagagaagtaagcaagtaaccactttgttctccttctttctctttgtttactccattgtacattgactgtctcccaaagtatcccaccgagccttaagaaaaagttccccttaaagataacagaactggaggattcagctaggggctttttgattagtcaagaagcctttgattggatggacatgtaatcccagcactttgggaggctgagacgggaggattatttgagtttaggagttcaagacaagcctgggcaacatggcagaaacttgtctctacaaaaagtacaaaaaaattagccgggcatcgtggcaggcacctgtaatcccagctactcgggaggctgaggcagaattgcttgaacctgggaggcagaggttgcagtgagccaagatcctgtcactgcactccagcctgggcgacacagcgagactccatctcaaagaaacaaataaacaaacaaacaaaaaacaaaaattagctggatgtggtggtgcatgcctgtagttccagctactcgggaggctgaggtgggaagatcacttgagtccaggaggtggaggtttcagtgagccatgattgcaccactgcactacagcctgggtgacagagtgagaccctgtctcaaacaaaacaaacaaacaaacaccttgattgatgatccaatatagttcttttgttgttctttgggccttctttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctgggttcacgccattctcctgcctcagcctccggagtagctgggactacaggcgcccgccaccacacccggctaatttttttgtatttttagtagagacggggtttcatcgtgttagccaggatggtcttgatctcctgacctcgtgatccacccgtcttggcctcccaaagtgctgggattacaggcgtgagccaccatgcctggcctgagaaaaatatttttgatttccactttatagatgagagaattgaaattcaggttaatgatgccactcaggcttgaaacttcagcatcatttttgtgtttcttctgcacatcccacattcggtccatcaccaaattctgttaattttttcctcgtgatgttactggcatctgtctttttctcatcacatccactgataccaactggggctttctggatgattatactggatttttccattaccttccacatgctggtcttacctccttgatgcctcccgtaagtattttggatcttgggaatatgaattcatgtctgttcccttcgtttggcacccccatgggttgtgggcacagaggcagggaggctctgagaggcatgggccaggaaaggcttttcagagatttctgagcatacctgtgtcccttacaccttattctaattcacaccagctcttggtgtttgctcttcgactgtggacctctgtggatggtagacaatttgtgtgagtccacgagcccttcagtgttaaacatcattaaacataaggtcgcaaaagtcagctgatgctcaaactgaaattgttgtattttgttttgttttatgttattttgtttcccagaatgaggatatattggtcttattgtgctatgtgttagagccacatattctttcttctgattctgtgttcacattgccttccagatatcatcaaatctaacatgttaaaatctaacataatgagtgaaaatatatcagcgagaatgataatagcatctgctttctaatccatgtgttcatcatgggaaataacaaagctgcatcatatcctgtcttgtttctatcatgtcctcttctccagttagatcctaagtccctccatgacaaagacctggattcgttcacacatttagtgattcagcaaaacacctagtaagtaccccttgtgtggaaagccctgtacttgcctttggtcctatgggagttgcgttgcttgatgttagtgatgtacctaagggtggtgttaggactgaccggggctcccctcccaagccccacctatgtttttaatcacaataccatgcaacttccaaatcaacgctgttgatagaaagacacctacccagctctgaagagttatttggtccctagatcaaggggcagataagtcagatttccagaaagatagagcctgcctctttgtcattccatctccactattccttcactgatgagaaagtgatcagatcagaactgatgttgtataaactgctctgtaattcctgcctgattggcttttcttgagaggtgcctgtccatwagcttttgccttccttttgtcaggctctctaaacactttaagtaacagaatcaattaagccttcctcacgattttagaaaactaagtggtagctcaggaggggagtcatcctaacaagctgtctgtgtagacagtggattctgtattgtcgcttttgtttctcaaaggtttgggtttggtcagaggttaccaaggaaccttcgctatatttccacagattcttttgtgagcctctagttcacgccctgtaaggacattcatccttctctgtccttgggagacgtaggaaaattatttcctggagaaatcaggcgcttgtaagagccagcctttcaaagaggtatctaccatcaaaggggctaatcgtccgagtgacagacacgcatggctggcttccctctttactctgccttgattgagacaagatgagcgtgctgctggccttagcaatgggggattctgttagaacaatatcctcagggaatagcttttatctgctaagtatgacaagtgtggcaactgtgcacagagtccagatctcacgacctcgctttgcaaaggctacaagaccaagggcttgtgtacctgccccaacagagacaggctgactcttactacgtggccgtaggaatggtttgcccttgctcaggacttatttacctaatgtcgtttggcctggaatgtttcagagcaccctttcatgcctggtcagggttgtgatcccttttggagacagaaggaggtagacgtgcttttgtgtttccgacactgaggacattgaggttctgggggattcatcacttagctcccaactcttattgggagcagaagtgccactggagtagggtggctggtttgagggtgtggccccgggaaaggtggcaggacacacttctcttgttctccagcccattttcaggcacggtatcctgcgctgctagcaccgtagccatcactgacctcaggaccctcccggtgaacactcagttaaaattcctactcgctgcagtgggaaattttatgttatgtgaattttatctcatgattaaaattaaaaatgaaattttaaaaatgaaatattcagttgcctttcctagaaggaatcatcccgatgatactattccttacttctcacattcatcccattctaatgcccacatttacttcataatgtattacctacgtatagtgtatgttgttcgcttcatttagcatgaccctatgaaatgcctgtgtgaccaaaagcagatcaactgataaggccttttgtggctcagatgtgtctttgcggggaaatggtcaggcgtcctctgttggcaagggcacctgtcccaagcagaaatggagaaacacgtcctcacctcctcctgccacctgctctgaacagattctgtagcgtaaaattctttataaatacacatatcaatggagttcttgacattttgcccagaacctgaggaagaataaaacctttcttgtccaactaaaacacacacggaataacaagcaaaagcaaaagagaaatcccaagaaaacagaccagaaacaaagggttatgctccgtcattgtccccaagagggttacacatgagactcacagggcaaattttatctaaattaaaatgctgatttttcacattacaggcccaaagtttaccgaggtcacagtgcttttaaaattaatgaggccgggagcagcggctcacgcctgtaatcccagcacttttggaggccaacgcgggtggatcacgaggtcaggagtttgagaccagcttgcccaacatgacgaaaccccgtctctactaaaaatacaaaaaattagccgggcgtggtggtgggtgcctatagtcccagctactcaggaggctgaggcagaagaatcgcttgaacccaggaggtggaggttgcagtgacccaagatcgagccactgcaatccagcctgggtgacagagctagactttgtctcacaaaaaaattaaaaaagaataataataatgagtgaagattagcttcctctgaagtcagttccttgtggatcatcttattgcttattttttaacttatttgatatctcactgacccctcccgaggcagaaatttgcttttgctcattgcaaactggccaaggaaaaaaaaagaacaatttcctctatagagtagttcccccttatcctcagatagccttccaagactcccagtgaatgcctgagacctcagaaagtaccgagccctgtatgtgctgtttttctgatctggtaaccagggcggctactgagtggttaacaggcaggcagtgtagacagcaggaggtgctgggcaaaaggaagactcacatcccaggcaggacgaaatgagatggggtgaaatttcatcacactactcagaatggtgtgcagtttacaacttatgaattatttatttctggaattttccacttaatattttcagactaaggttgactgtgggtaactcaaaccttggaaaacaaaaccgtgggtaagggaagactgctttaagatctgagaatgaggactgacatgttttggtttggctggtggtttcagatccaacctcagtagttcctagagaccatttaatttgtttttgagatggagtctcgctctgttgtccaggctggagtgagtggcgtgatctcggctcactgcaaactccacctcccgggttcaagcgattcttgagcctcagcctcccgagtagctgggattacaggcatgtgccaccatgccaggctaatttttgtatttttggtagagatggggtttcaccttgttggccagactggtctcgaactcctgacctcaggtggtctgcccgcctcgacctcccaaagtgctgggattacaggtgtgagccaccatgcctgaccgagaccatttaatttgaataagtgcccaagaagcaaaggactgagccaggcaagatgatctgagagcaggaaggtgtggccaggctggctgagccatgaacaggctggttgctccagggccggtgtctcccctggaaggttctggagttcaggctgtgttggagtccaccttctgcccctcaagtccatggcagggccgttgactgctgctcttgcctgagtctcctggttgcaaaggccaggcaaggcactgcctaacgttgtgactaacatcgtgggtgtgacggggagtcagggtggcttctctgttgccccaagtatgccctgcacatcaccatcttccttttcaaagaatggtgaaaataggaattgtgctctttagggaagattgtcttttttatatctttttcttttttttttctttttttttttttttttgagacagagtcttgctctgttggccccaggctggagcgccagtggcgcgatctcggctcactgcaagctccacctcccgggttcacgccattctcctgcctcagcctcccgagtagctgggactacaggcgcccgccaccacacccggctaatttttttgtatttttagtagagacggggtttcaccatgttagccaagatggtctccatctcctgaccttgtgatccacccgcctcggcctcccaaagtactgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaattgtttgaacccgggaggcagaggttgcagtaagctgagatcgtgccactatactccagcctgggcaacagtgtgggactccatctcaaaaaaaaaatgtagaaaaataaaaacaatcatctattcatggctaggtagaggtcagatttcactcactgacctgtttttagattttccttcgatattccaactcttagatatgtcaggttgctggagttgctgactgcactaacttctgcattctccaactttcccctcagagagtggcttgtctaaatcacccaaattaccatgtgggtgagaatgttggggaaatgaagatttaaaatccacaatattattagtgctgtcaatatcataatatcataaatgtccatacgaggaaaggagaccttggcagaggctaccttttctatctgttttgtgtgtgtgtgtgacattcttcatgaatgacttcttgaactatgaaaatgaggcaactgtggcctgaactctctcatttgcctcctccccttcctggcatttacttaagacatttcctgatgcttcccgggggtgtttcatgctggtgtctaagccagagatcacacctcccacccaccatgcctgcacctccactcctgcaaaggtttttagagtcagggtccctatcagtgtctaagcatcaggctcttcagaccctgacctttgaaaagtccaaatggctcttgagtgccccattttctcccaatctgaaaactgtaagaatgaaatataacaattaagcctcagaggatcacaagcgcaggtgatcctcatgagcccagactgatatttctaaattatctagatcttccttgaacatagactccagagttaccgggacgcagcgttcccattccactgggcagccatctatacgtgaagtgtcattgttggtggtttgggagttttattttccctttcataacacgtctcctgtctcctcagctcccccagaactccctgtaatcatatttgctatcagttgtgtttgtggaggtgtagtgaatttttcagggatgaataccaatgctgagaccctccaagaagacctgtgaggtcagcctctgtcagcgtgacagcccagtgggagggggccccaagctacacagcaggagatgattgtcacacgtcctggtgagagagcctgctcaccagctctggacctgcactccgtgtgcctggccagtagataggtttccctggtgttccccaggccttttctgcttcatgacattgattatatagctagcatttcatttcagtagggcttgggaaagggggttctttattgcagctcctgtaaaaacccatttccacacgaatcacctctggcctttttctgtctggcacattgtttagacaggaggggtttgtgtgtatcacttccctccagcctctcctaagtggaagcctgggatttggaaattgggatttttttccttctctctaaatgaatgccttgttggataccttgttgataaaatgccatttctcacatctttatagcttaaggggctaccttagccacaaggcacagtcccttattactgataagagctactgtcatttcacttatatactttgggagattcatttttgcttctcagcatcatttatgttatgattcatatctaaatttaaggtaaaattttatgcttcaccatcgacttttcaaagtttgtctttgaaaatgatttttaaaatgatctaatccaaacctctcagtttacaggtgagaaaacaaatctagggcagagtttttccacaggggcacgagtgatgtcatggaccagatgtttgtgtcgtagggggatgcctggtgcactgtagggcatttcctgggatctcaagcttctatcctctggatgccagtagcaccctccaagttgtgaccaacaaaaatgtcccctgtcacacagctaagtcataacagagtcaggcataagacacgggtgtcccgactcccccatctgccctttccaggttgggcaacagaattaagctctcaacccacacagagctcagagaattagtcaagagcacttccacaatctccagggagagaagagggtttaggagacaaaagagccaacagcatggaagagctttgtggaactctgggcratgcatcccctacatggaagagctttgttgaactccaggcgatgcttcccctatacggaagagctttgtggaactcggcagtgcatcccctacacggaagagctttgtggaactccaggcgatgcatctcctcaccggaagagctttgtggaactccgggcgatgcatctcctcaccggaagagctttgtggaactccgggcgatgcatctcctcaccggaagagctttgtggagctccgggcgatgcatcccctcaccggaagagctttgtggaactccgggcgatgcatctcctcaccggaagagctttgtggaactccgggcgatgcatcccctcaccggaagagctttgtggaactccgggcgatgcttcccctacaaggaagagctttctggaactcggcaatgcatcccctcaccggaagagccttgtggcactcctggcagtgcatcccctacacggaagagctttgtggaactctgggcaatgcatcccctaaccggaagagctttgtggaactgcggcaatgagtccactctccccagtctccctgtctacgaatagaacttggcccagtgagtcactgactcaacttctgtgatcttctactagacgatatggtttagaaattcataagatgtgtgtcaggagttaacaggtttaggggaaagaacagaagaggcggaggaatgtctccccatgaatgctgaccctccacatacccagaacctgggactagccccttggcaaagactccatgagcctcatacagtgaatgggactcgttctcagccaggtagacatcagcttgggtctgacccccatccttgtgtgcaagtcctgattcacagagtttctttggcacttttgcttaagctgtaacaaacagccagtctgcacagggctcccttctgtctttccctttaagtcggctcacatttctctcctggtcacagctgtagaggacacacacagcacgaaacatgaggagtgtggcaagtaatgaatgcccccagggtattgccactttctgacagatgaggacaaatgtaatttccagggatttcatagctgagagattagaagctttcctgctgggcctaattctggagccaggtatgaacctgtgtttcccttgtataaaggtaaaagaattctgttactggggctgtggatggagccgattttaacatttgttttttgagctccatctatagctcgtaaggtccaccaggctggtccaaggtgcctttcctctagacacaggatttcatttagtggctgtgcctacatgcaaagcagcaacttcattcaactctctgggtctttgtcttagtgatgccagaaataacaaaatagaaactgaactattacatgaaatgacttttgggttggaaaaacaggctctaagaacagagttaatgaactgagagaaaatagtttctggttatgctactagaaactgtggtttttatcctcataaatcattgctttaggraaaaaaagtcctttctaaacttttcctgtcctgtttccttttcattttttgaatgaatgaacagtagggtattctctgtctttgagttattttcttcctagccacctggtcataatccagagggaaaaacaaattagatggattctgtgagctatatttcattgctattggtgtgtggatcacaatgctttattttccaccagttaaacgaagaacattctggaaactttgcacaaagaaaaattagtgtttatccctacagttgaaattttctaggaaaaaaaaatagcaacaaattaagttttgaaaaaggagagccaggtgcagtagggtgcatctgtagtcccagctactcaggaggctgaggcgggaggaccactgcagcccaggagttcaaggctgcagtgagctatgattgtaccactgcactccagcctgagcgacagagctagactctgtctctaaaaaaagaaaatttaaaaaggaggcttggctgggtgcagtggctcaacgcctgtaatcccagcactttgggaggctgaggcgggtggatcacctgaggtcgggagttccagaccagcctaaccaacatggagaaaccccatctctactaaaaatacaaaaaacaaacaaacaaacaaacaaacaaacaaacaaaccaaattagcccggtgtggtggcacatgcctgtaatcccagctgcttgggaggctgaggcaggagaatcacttgaacctggaaggtggaggttgcggtgagccgagattgcgccattgcactccagcctgggcaacaagagtgaaacttcatctcaaagaaaaaaaaaaaaaaagagctttgattttcatgaataccagtctatttctgaaggtttcccccttggaggaacagtggtggcgggctggccctctcagtcaaggagacgtgagcattccatgagacacgggtttcctctagggtctgcccctgaggtacctgaggtttggatacctctgcccactcccctctgccatgtttttccagctgtaccgtgccgataatcactgtgtcagctgtcattaccataatgctctgagcataactgctgtaacagctgggaaagaactctgcctttgcaaaacaatgctgcgtcataacacgctaaaacccccaatgtgcccacccaatatttcctatccatttgccccttctgcactccacaggcatgatcttccctttgccagtgggacatcagaatgagactctcttctgtcctccctctccttccccaagaacagtccttgcttgcaaatgcaaacagagaaaaagatactacccgagtgagcaggtgtttccgttggggtctgacaggagaaagacaccacacttagatcrggactatttagaaaagtatggatggagtgtagaaaatgaaaagggctaattagatagaccagggctagtcatagcagagtgccaggatggcctaggtccgaagggtcaaaaggagggaaccatgttggggggacagaggaaaggaaggtgtggcggagcctccggactcgcctcctccctccagagggcaagggggttctgctgatgcagtccaggcaggcccactccctggacaccaggagagtggaaaagggtrgagactgagtctggagggcacggaggaaaattggctcagcatggattagaacagtctttcgcttcctggagcttaaaagccctccttacttacccttagctcctgccacctctctttgtccttggatggatacagcgcatgcctcctgcctgccacctcatctgtggtttctcatcctgtttgctgtcctccttcctcgttctgcccatgctgtcataatggatggaaaagctaaaggtgatttccagtcatctcttttgctgctgacagcatgaagtttgttctgctattagaatgacgcagacccgagacaagggttttgtcctgagttcattccattaatttctctctgcatagagcatctttccagcagctcctgcatgattaaattctggctgtgtgggacacaatggcacaggaagagcgttggccactcatcagccaggtcactaaaaggcaagttccacacatgaggagaaatcaaatgctcaccctttggacatccatccttttggtcctttgagtaacatttaaacaattgtttcttcagatacatggtccacactcaagagacctacaacagttggtatcacctggataagtattcaccaggctctctatgcccagttttttcccaagttccaaccaagagctattgatggctttgctcttgatcagaatagcattgggttttgctgcaaatatattcttgagcattatagtgatgaagaaagaaagaaagatagatagatagataatagagaaatagaagataggtagatagatagagaaagaagcttgcgtgtgtttgtttcaaagaatggggtcagttttcttacagccacctattctctcgcctggacatatattcagtgaatgcttctgtttgtaagatggctaactgggatatgggtcttacaggtcttcagttcctataagagtctacaaccacagcctcattaacacatgctctctggtgaaaagacattaaatggggagggaggaggtgtggatgctacgctggcttcaccacatgtaattattgaactttgtatatcactttacctttctgggtctcagggaccttgtctagaaacccaacaaggcaggctgtggtagctcatgcctgtaatcccagcactttgggaggctgaggtgggaggatttcttgagcccagaaggccgaggccacagtgagctgagattgggccactgcactccagcttctgcaacagagagagaccctgtcaaagagagaaagaggaaaggaaggaaggaaggaaggaaggaaggaaggaaggaaggaaataaataagcaataagcatgaagtggcagttattctccaagtgaacagtgtggagtaactgccattttactrgtactcaagtacttggtgtaactgctacatccaggcaactgctgagacttgagcaaggacctttacagcctttggaagtcccatccgtcagacacaccagggagcccgatgctgaacttcatgtctgtgtttgctgaatgatgagcaggtcctcttcagcgagagctacacgagctgtgaatttaccacgtgcccgtcaagggggtcattgtgttcctcactctgtcaataaaccacacagtaaagatytggataataggagcagaacagtttcaaaggacttgttacaatgtatcaagtcaataacttataattttagaaaatccctgaatacaaatttgcacrattttgagttgttttacaacttaccaggccgttaatctaagttttaaaagtctcttaatatacttaatcatagcctgtgcttttttttttaagtgctgaaatatgtttcagcattactgaaccacagcagcacaaggaaaaaacgactttaactcgttccataaaacttgcaaagcaaccataaatatatacagtgtggggtctgttttgtgcacaatttatatgcaataggctgggcttgatcgagaggatttatgcttatcgtctgtctccccaggcagacaattgtggtagaaaagaaaatgcacaggacctagagtcagggctgggtttcaatcccatttctgccacctgctttttgtgagaccctagggaagccttttgctcctttgaacctgtctcctacttaacaataatatgcccaccttagagggcagctgtcaggattgccacagagcaaggcagaggtgaaccatctgcagatgcgtgctgaatttaaaccaatgcatgagtgacacggagcatgagagtggccagcatccttcctctctccctgcaccccgcaaaacaactccatcccccactctctctcagaggtggcagcggccataattcagacacatrcaacccagccagcgtaaccaccccctacycaccccctgaaaatagaagaagaaaggatttagagtctgggcagattgcttttaaaacatttccaaccttcgatctaatttgtcattattatttgtagagctttctttctcttccttcgtatctcctttcatatccggagcattcccagggaagatcccgttgctgaatactcgtgtctccagttttctacccggacttaaagatctactggtcctgcagagctgagctccagtggtgtgaaaggcacgtgagcgatgctgggcttgtggagatgagtaacacacaggcttgctttcaaggcactcacagccttacacatttgaaaatgagtttttcactggagcctgaaacttccagatttgaaaccatctccggggccaagcctggctgagactctctctctctgcatgagctgcctgccaccatcagttccccacccagatacccaagcctgaccttgacctgctgggggaaattcattatattctcgtttactccattttatagacgaatgtttcttatcatgaatgagagttcgttaaatcagctggttctaggtggagttcactagagccctctccaatgctgccggaggacctgttgccgtctgggctgtattgtaggtgggtggtatcataataagatccgtggtacacgaatgggcttcagggcaggcctgggttacatcaccacctcactttcggtgtgtcaaagctggaaaaaacagctggaaggtggccagtgttcgcttacccaacgaagcatgactttgcatctcctctaccctgcccagtgagggctccctgttttgaaggactggcatattctggaatgcttccaccaaatccaaacatcattctggatgaactgtggagcagttcaccgttcacagttcacaaaaggaccctctgtagaagcagaggatctttccctggggaaatyatcctaagtcttctgattttaataactgatatagttcaagtatttgtccccgcccaaatctcatgttcactgttaatccccagtgctggaggtggggcctggcgggaggtgactgcatcatggatccctcgtgactcggtgccatcctcatgatagtgagttctcccaagatccggtcatttaaaagtgtgtgtttcctgccccgtctcatgctcccattctcatcacgtgatgtgcctgctcccacttcaccttccaacttgagtcagagctccctgaggcttccctagaggctgagcagatgccagtgtcatgcatacacagcctgcagaaccatgagccaattaaacctcttttctttataaatacccagacttgggtatttctttatagcaatgcaagaacggcctaatacaataattgttttccacatgaaataaacattgaccgtcttatccaactatacatgcttcttgactctagaaattgttgaatggaagtgctaaagattatcctcaaacacactcatgtgcacacagtttcagtgccagaacagtgtcctctaggaggaaagatggtcccagagcaattactggtttcctttaattttggcttcctaatgagtatcattttggtacgattccaatgaattgtttatttgaggaaagagaaaaagaaaagaacctataggaagagttggtttggattctatcgcgggcagtttatgcttctacgatagtaataaaagcaatgagagaaaaaagctacagaaccaaataaatatagatccaggagttgyacaacttttaaaagaaaaattctttagcctattgatccttcctaaggtaaacatttattttatttcagtttagaactcaagaatttttttcaagtacaactgaggaatagagtcagaagccacttcgattttgacaccatagaaacattctttctttagttactagaatcttttaaattgataagattggcattttcccaggatataacattcacctccactgtgtttttaatttgcaatagattttgagggaaagattccacaaggatttggccaacatgcctcctgagcagtgggtctcaagtgtggtccccagaccagcatgatccccatcagctggaaactgttagaaatgcaaattgtcaggccctaccccagacccactgaatcagaaactctgggaggggaaaccaacaatctgtgtttcaacatgaagtctgagaacttaaactatgcaccgttcttggtaagaaaataagagttttcctttgtgtgcgtatgtgaaaccaattccctgcaacccacagttgtttaaacaaaaacgtgtctagggagttcaaattaggtggccaattgccttataaaagtttacaaagtaaagagtctgtgctgtttccgttaggagacagaaacccaatcactaacttggagtatgagtcagaggcaggacagagaaatgtctgtctagtcggtgagctaattaatacrtgatcctgaggatggaggagccagggctgccgttccttctccactagggaaaaaaaaaaaagatgtttctctgtcaggcagctccctagctacctccagtatgttctattccatggctagaggagtgcagcctacatcctgtggatttatgtatattactgtaaaacaagctttctcttctcgagagttccgaagcagatctgtctctgattctttccatgaattcaaatacattgtcatccttaggtttcctaggtaaaggagactgcattactcatcagcatttaataaatattcatttgttggttgactgattcattatccttcatgccaatcacatggctgctactagcatgcatacagccgactcttaactacagttgtgtcatctacacaatccctgcagaaaactcattgaacacgtagtcgacacatttaaaaatgctgtgctgtggaagtgcaagttgcacaaacattttcatctttagcttcacttagaatacatttttttagttttttaatgtttttagagacagggtctgcctctgtgacccaggctggaatgcagtgctgtgtgatcatagctcactataacctcaaacttctaggttcaagtgctcctcctgcctcagcctcccaagtagctggcactataggcacacaccaccatgaccagtgtgtgtgtgtgtgtgtgtgtgtgtttgttttaatagagacggggtcttgctatgttgctgatttcaaactcctggcctaaagcaattatcctaccctggcctcccaaagtgctgggattgcaggcatgagccacctggcccatctataactaacttcataacactccaaattggaagaaagttggtggtgttattagcattattttacagatggagaaattaacacctggagttttgtgattacagagcagtggtaatcacccagttattttccttctctgtccctccagtggccctctgttgtctgggttaagtacagactttttagtttgaggaaaggagtccctccacaatttgtcatnnnnnnnnnnnnnnnnnnnnatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttrcagtgagccgagattgcgccactgcagtccgcagtccggcctgggygacagagcgagactccgtctcaaaaaaaaaaaaaaaacatcaaacaatactcactgagcccttcccacgtgccgggctatttgccgagaacttctcatgcattatctcatttaatcctcatcacaacttctctcaggtggaggcatgattgccatcccatcatacgggtgaggaaactgaggctcatagaagtaccttgccccaagccccatggctacttgcaggttccaagacaccggtcagcctgcccccctgcaccttggccatgctgcccactcacctagagcgcacagctgacactgagtcctcttctgaacctcatccatgaacatatttatgaaatctttcctggccccaagtggaaatgccccctcatttgggtcctcactgaaccccagtacacaactcttttgtactactctattatgctggggtgtttttttattgtctcacctgataaaccgtaagccccttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccggccattgytccgtcccgtctgtatcccttgggctagtttcttctagactgaggtttctaagtccaaacaagatgaactgtgcacagtgcctcaattagggaacagcagctkgagtgctttggaaatacaaaagtgtagtttgtaggttcaccttgaaggcaagatcagacagctctacgtaagccagagctctgaaacaaagcttcaggctgggaccactttgcagtctcagtgcctggtagtggggactgttctacagagccgtgatcaaacctccaactgcattctggtcttggaggaaagctgattccgtatgaagagaaaaggcctggtgagagtatttgcagggctgaagaaaagttaacatctatagtttggcaagcagcagctgcaaagcatccgtcccagcacatgataaatgcttctgacgtttccttcagacacagtgtgctaggaaggcttttaagttctcaaatgcaggagtctgccttattgatcaggtgcctttcattaaaggtttccaagcccctcggctacagaggaaacgctcccctcagcctcctccacagccccagcctttcatgcagaggggattatcattgttggaatacggcatatactttaatttggtgaggctttttgtttaatgcttatgatatgcacactggaacagactgggattaggtaattttcacattgagttggtacttccctccctaacccccatctgatcttccatatacacattttaagaagaaaataaagagaagacacgtcctcctaatgatcctccgtattagaacttaccattctgctttgaactcctgctgctttgagtctcccactgccagcaagcacttctctgccaggcggaggggcggtgaagggaattaaaggggcagtcagtggcttgcctctggcgggaggtggcggagcgtctcattagcgtttgctcctttcctccagctgggcttcactgggcccctcttcttatcaacccgtccttcacttcacccaggctgtcccctgcactcagaccccctccagtccttccaacaagatggcagcaggatgactgggactcattggagctaagcagagaattaaagttgcttttgttccaaacctaaaacttgaaaatgaaggaactcttacgtggaaatgccaccatctcccttttgttttatgcgtaaacccaactggttccccatcctctgggtctccttcctgcccctcgctggctcagggcattgtacatactgtgtgttcaacacatgctgagtggaattgaacagatgcagtcctgggaaagggggccttttggaagaactgatggggaaagaattggggtaactgtgggcagttactggacgttcttgctcttacttattggttgaatgagaatgaaagtatctaagatgtaccaagtcccagggatagtggcataatttctctgttcctccttctgactccctcttctcccctcttttagtgtggggaagttacgagaacgtagcgtttggtgcagtgatccattcagtatacgtcgggctcttaagaaagttaaatttacctaacatcctacattttagataagaccgttccagatttccacctcttgacccaaaagatcccttcggtggttttccttactagggcaattcccttagtttcttggattcttccttcctctccttcctggaactaagctgcagagtcccaggctggagaaatagcccactgcccaggggtattttagaaagggcttcccaccttccgcagtgggcctggagaaggacgccttcttttcaccaccaggctgtgatctcgcaggctggcaaggcctttatgatgaactgaatgcggtctgtatttacgtgcctgccatctgtccccaggcggcactgagaagggggctgatgctgtcacccctagctccttctgcaggtctcctccgtacgtgccactgccaggaacaaaattatcatctcatgggagctgcacacatttaatggaacttgggagccagcacagaccgttttcctcaaagacagttttataaagaaaatggactttggggaacaacgccagaaagacatccagtatacctaattattaggcgagtgtggtcattgcctctttgtcttagataactaggttgttgattacggtgctttgccaaactccacggtggatctggtagctggtatttctgggcagacaccagactgagttacttcttttcagagttctggacgttactgatctaggtgaaaggccagaagcagtgggatattgaaattctcagaagtggagagactgtggcaaggaggtacagaagacactaaatcrggtgccatgttagcaagctcaagttttcatattgatcatgcagtgagctgcagagaagaaaagcagctttgcctgggtcctgttgttctccaagccaaatagcatctctgtgctgacagacgagtctgcgtctgcagacgcagcatctcttgactgtttgctatttaacgacagtcgtaacacatgagtgagctttactcatgtgggccctttattaacaataagccgcctctgtggcggctgggccccgcggggtcggggggtgggggtgcccaacgtggcagggaggcctgcaaggggaggccgaggcgccggtggaagcacaaaccacccggcgagtcagagcaggggtcggggcccctggccgcaccgtgccgcgcatgcgcagggtcccggggtccctggggtcccgggtttgtgcccccggggcggctgggccccgcgggaggggacggccaacgcggaaatgggccctttattcacaataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacsgtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttgggaggctgaagtgggaggatcacttgagcctgggaggcagcggttgcagtgagcagagctcacaccagtgcactccagcctgggtgacagtgagatcctgtctcaaaaaaaagaaaaaaaaaaaaaaaaattggatgacgttgggcaagtgtggtgtctgtctcagctctgtgagtgtaggatgattcagaatctaatgattaggtctcctgaactcctaggtcaaacgtggttaaagggagatccagggaagcagtgaggaatgggctcttacaacactgtcatggacatgggttcaatatgttggcaattattatttattgaggacgtactttgttttaagtgcttaggataattatttgcttaatagtcacgtaagtccttcaagataggcattattatcgccattttactaatgaggaaactatgttaaaataatatattcctggtcacacagcgaccaagagtcaggatctgtctgccttcagagttcatagtctttccagtagcctcagtaaaaagtaataatagctaatatttactgagcacttactatgtcactgacattgtggaaagggatgttatgggcatttgctcttttaatgatcacagtaactctgctaggccagtactgttattatggccgatttatagatgtggacagaggaggttaaacactcgtgcatggacacatactgatcaacgtacagccagcactcaaacccaggccgcctgtctccagagcctgtgcccccaagctctaggccatgtgccctgtaagtcgcagatgggacgctctgacagcgagtgtcactgaggtcggagtgggtcatcaggcatgcctcagaatcccattccccacttcattcacacctgagaacgcctgtctctggatgcatctttacaccagctcatccatttaaaatcagttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctccccgaagcgcttcttagagcacatctcattaccgggctccattctcccgtcctgcacatgctccctcacacttagctttattgtgccaccacttgtcacctttcccggcccggtttttaataatgcaaatcttccctctctgatggcatcgctgctcattatttgctgtctggcaccacgggagctcacccagcggcacctcggagaagccagccgcccagggtgcaggcgcaggccccactgcccgccccagtctcctgagagatggctccgctctggctatgacccaagatgctcatggagggaagagcagtccagggccagggcccttccaccttcgccaggcaggtgcctttgagcaagtcaatctctgcagcctcaaaataggaaagatggtaataattattataataatatccccttaacaaagcagttatggggcaaccaaatggaagtaagatacgagaaaagtctgtataaactgtaagatttgtaaaacttgtaaagaagttgtggtggtgttgctgatggatgattgattgatttggtcaacacggagcagtcgctgccccaaagtaggcctggagggcaccccagccccctcatctgccctcccacccccaaactcagcatggaatcatatggctttggactttctccaggtggataaagccccctgatctttgaacatgtcatgcaggattattattgtgtgttttgtttgggcaaagaaatttaagccaatttacttttgttctgtaactcataactgaactgtgctcagagtctctggggtcctttcaggcatggstctgtggttctgtaatggtaactatgggttgatggagcaatggctttgtaaaatatgtttaaaagctccctctgaattgagggatcacagcctccttagttgtcccctggatttcctggcattggagttatgtaagacctccatgatcattgccatctggaatatgactctttggtaccccaaaaaacttctggagtctttcagtcatatggaatcaaaaagatcttcctttggaagaagcaattttagatcactgatggaaattttaccagaaaagtattcaaatcttttccttttataaaacctgggtttgttttttgttttttaattatactttcagttctgggatacatgtatagaatgtgcaggtttgttacataggtatacacatgccatggtggtttgctgcacccatcaacccgtcatctacattaggtatttctcctaatgctatccctcccctagctccccagcccccaacaggccccggtgtatgatgttcccctccctgtgtccatgtattctcattgttcaactcccacttatgagtgagaacatgcagtgtttggttttctattcctgtattagtttgctgagaatgatggtttcctgcttcatccatgtccctgcaaaggacatgaactcatccttttttatggctgcatagtattccatggtgtatatgtgccacattttctttattctgtctatcattgatgggcatttgggttggttccaagtctttgctattgtgaacagtgccacaataaacatacgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaaaagtgtaaaagcattgctatttctccacatcctctccagcatctgttgtttcctcactttttaatgatcgccattctaactggtgtgagatggtatctcattgtggtgttgctttgcatttccctaatgaccagtgatgatgagctttttttcatatgtttgttggccacataaatgttttcttttgagaagtgtctgttcatatccttctcccgctttttgatgggtttgtttttttcttgtaaatttgtttaagttctttgtagattctggatattagccctatgtcagatgaatagattgcaaaaattttcttccattctgtaggttgcctgttcactctgatgatagtttcttttgctgtgcagaagctcttagtttaattagatcccatttgtcaattttggcttttgttgccattgcttttggtgttttagacatgaagtctttgcccatgcctatgtcctgaatggtattgcctagatttttgtctagggtgttttatggttttaggtcttacatttaagtctttaatccaacttgagttactttttgtataaggtataaggaaggggtccggtttcagttttctgcatatggctagccagttttcccaacaccatttattaaatagggaatcctttccccattgcttgttttgtcaggtttgtcaaagaccagattattgtagatgtgtggtgttatttctgaggcctctgttctgttacatttgtctatatctctgttttggtaccagtaccatgctgttttggttagtgtagccttgtagtataatttgaggtcaggtagcgtgatgcctccagctttgttctttttgcttaggattgtcttggctatatgggctcttttttggttccaaatgaaatttaaagtagttttttctaattctatgaagaaagtcaatggtagcttggtgggaatagcattgaatctataaattattttgggcagtgtggccatattcacgatattgtttcttcctatccataagcatagaatgtttttccatttgtttgtgtcctctcttattttcttgagcagtggtttgtatttccccttgaagaggtccttcacatcccttgtaagttgtattcctaggtattttattctctttgtagcaattgtgaatgggagttcactcatgatttggctctctgtctattactggtgtataggaaggcttgtgatttttgcacaatgattttgtatcctgtgactttcctgaatttgcttatcagcttaaggagattttgggctgagacgacggggttttctaaatatagaatcatgttatctgcaaacaggcaatttgacttactctcttcctatttggataccctttatttctttctcttgcctgatcgccctggccagaacttccaataccatattgaataggagtggtgagagagggcattcttgtattgtgctggttttcaaagggaatgcttccagcttttgcctattcagtatgatattggctgtgggtttgtcataaatagctcttattattttgagaaacgtttcatcgatacctaatttactgagagtttttagcatgaaggggtgttgaattttgttgaaggccttttctgcatctattgagataatcgtggtttttgtcattcgttctgtttatgtgatggcttacatttattgatttgcgtatgttgaaccagccttgcatcccaaagatgaagccgacctgatcgtggtggataagctttttgatgtgctgctggattcagtttgccagtattttattgaggattttcacatcgatgttcatcagggatattggcctgaaattttctttttttgttgtgtctctgccaggttttggtatcaggatgattctggcctcataaaatgggttagggaggagtccctctttttctatagtttggaatagtttcagaaggaatggtatcagctcttctttgtacctctggtagaattcagctgtgaatctgtctggtcctgggctttttttggttggtaggctgcgaaattactgcctcaatttcagaactagatattgatctattcagggattcgacttcttcttggtttaggcttgggagggtgtatgtgtccaggaatttatccatttcttctagattttgtagtttatttgcatagaggtgttcatagtattctctgacggtagtttgtatttctgtgggatcagtggtgatatcccctttatcattttttattgtgtctatttgattcttctctcttttcttctttgttagtctggctagcggtctattttgataatcttttcaaaaaaccagctcctggattcattgattttttgaaggattttttgtgtctctatttccttcagttctgctctgatcttagttatttcttgccttctgctagcttttgaatctgtttgctcttgcttctctagttcttttaattgtgatgttagggtgtcgattttagatctttcctgctttctcctgtggacattgagtgctataaatttccctctaaacattgctttaaatgtgtcccagagattctggtatgttgtgtctttgtgctcattggtttcaaagaaattatttatttctgccttcatttcattatttacccaatagtcattcagaagcaggttgttcagtttccatgtagttgtgcagttttgagtgagtttcttaaccctgagttctaatttgattgcagtgtggtctgagagactgtttgttatgattttcatttttttgcatttacttccaattatgtggtcgatttcagaatatgtggtgctgagaagaatgtatattctgttgatttgggttggagagttctgtagatgtcttttaggttcactcagtcctgagctgagttcaagccctgaatatccttattaattttctgtctcgttgctctaatattgacagtgggatgttaaagtctcccactattattgtgtgggagtctaaatctctttgtaggtctctgagaatttgctttgcgaatctgggtgctcctgtattgggtgcatatatatttaggatcattagctctgcttgttgcattgacccctttaccattatgtaacgccttaattgtctttttttaatctttgttggtttaaagtctgttttatcagacactacgaccgcaacccttgctttttttgtttgttttccatttgcttggtaaatcttcctccatccctttattttgaggctatgtgtgactcagatgggtctcctgaatacagcaccctgatgggtcttgactctttatccaatttgccagtctatatcttttaattggggcatttagcccatttacatttaaggttaatattgttatgtgtgaatttgatcctgtcattatgatgctagctggttatttttcccattagtcgatgcagttttttcatagcatgaatgrtctttacaatttggtatctttgtgcagtgggctggtaccagttgatcctttccatgtttagtgcttccttcaggagctcttgtaaggcaggcctggtggtgacaaaatctctcagcatttgcctgtctgtaagggattttatttctcctttgcttatgaagcttagtttggctggatatgaaattctgggttgaaaattctttaagagtgttgactattggcccccaccctcttctggcttgtagggtttctgcagagagatctgctgttagtctagggaagatgggcttccctttgtgggtaacctgacctttctctctagtgcccataacatttttccatcatttcaaccttggtgaatctgacgattttgtgtcttggggttgctcttctcgaggagtatctttttggtgttctctatatattctgaatttaaatgttggcctgtcctgctagtttgaggaaattctcctggataatatcctgaagagtggtttccaacttggttccattctccctatcactttcaggtacaccaatcaaacataggtttggtcttttcacatagttccatatttcttggaggctttgttcattccttttcattcttttttctctaatcttgtcttcacgctttatttcactaagttgatcttcaatctctgctatcctttcttccgcttgatcgattcagctattgatactgtgtgtgcttcatgaagttctcatgctgtgtttttcaactccatcaggtcatttgtgttcttctctaaactggctattctagttagcaattcctctaaccttttttcaaggttcttagcttccttgtattgggttagagcatgctcctttagttcagatagagagatgataagggatcagaagaggccagtggtgaattaactctgtagcctagaaccttgtaggggtaaaaactatttatcatcacctacacactcttactgggcatttattgtggccaagactcgggttcctgtgtgtctgtagagggccttcattgtgggtatccacaaagtgagttgaaacaaagctcatgcatgagaagcgctgatggagttctcccttgctcctgccaccttcttatcatctgtagtctttttcttactgctgagggatccttccagtggtcacatttgcccatagccctcctgaacgcttgagtctgcagaaaacctctagctggacagcttctgggtagagaaacaggccatgaagagcctcctacatgtgcaccatgtggctacgctccgtgacgagggaaaaacaggaatatctgtctgctgtgatcacgtgtagtggtcacggtgagagatgacggggctgctcctcctcagcctccagtcaggctgtgtggcagcgatcacctccatgtcgatggagtgtctgtgcagtttgggagcgaggctctgcctctctcggtgagtgtctcacagttcctttctccctcagccccatgatgccgtccagaacaaggtgctgaactgattaatgagcaggacataaagacaactgctgyccagagcaacagctgtcccaatccatccgtggaataaacaaacagggcagagcgaggtcccgaccagtggggacttgggtgcaggaaatgccagtctcttcttgcttgaatcagggtgycagggggccttcctggccaccactcaggctgttcctttagctttctggatcccattccctgcaggtctacccttgggagtgaaatagtgaccgtccctttgagcccgagagctggggagaaggccgtgcctgttaacagctgcctggaccctctctggagagcagcagggagaggcggggctggaggagatgttgccaagaacctaagggtgttagtgacaaaagcaagaactcctggcaacaagtccgagggactttcttgatcacaagtggtatctcctaagcactttaattatagcagattaagcaggaagtggagtgcyggactaaaggartaatgatacaaaggaggtgaagcagaaaarcttaatttccttcctttaagggaaaaaaaagtccatttatttagacgcattgcaaagaaaagaatggagtgtggcctttcccccagctcggagctcagtgggtttttaaagaactgtgtgtatctctttggccagaccagcractgggatcttcagcctctctgcagaaaatgagccgcaggctcgggatttcgttaagatgcaggagcattccttctggaccaatgactcactcattcagccccttctttcccgcttctccttgtcagccctcgcctggctgagctcatattttacattcagcacctctggttacccagaaattgcatgcaaaattgkgaaatagaaaagcagtgggctgtgggctccatcagctctgcctggcgttgcatcatccttgacttgcaatgctcagagcctgggctaggagatttgcttacagaaagcctgaaggtcccagggaccttcccaaagttgcgacttgaatgcatgctcttagcacacatgctgtgtaactggggcagatctgtaggaatgagtggaactgaaatcagaccttagaaagtcacagtgaataagaaaattgccagaatggaatgcagatatacctactggttactgtcctgtatgtagcggctgtgtgggatttgactgtgttttactaataggagccttgttgggcccagtgcttcataactagctctgtctgtcgggaatcccccacagtatcctgcttgtgattcacgctatccagagtccagggcaaggagttctaaaaccttatcatgttttgttttgttttgatacagagtttcactcttgttgcccaggctggagtgtaatggcgtgatcttggctcaccacaacctccgcttcccgggttcaaccgattctcctgcctcagcctcccgagtagctgggattacaggcatgcgccaccatgcctggctaattttgtatttttagtatagagggggtttctccatgttgatcaggctggtctcgacctcccgacctcagatgatctcccgcctcggcctcccaaagtgctaggattataggctattttttttttttttttttttttgagacggagtctcactctgtcgcccaggctggagcgcagtggtgcgatctcagctcactgcaagctccgcctcccgggttcacgccattcttctgcctcagcctcccgagtagctgggactacaggcgcccgccaccatgcccggctaattttttgtatttttagtagagacggggtttcaccgtgttagccaggatagtctctatctcctgaccttgtgatctgcccgccttggcctcccaaagtgctgggattacaggcgtgagccaccacgcctggccgttttgtttttgagagacaaggtctcgctctgtcacccaggctggagtgcagtggcatgatcatagctcactgtaaccttgaactcctgagctcaagtgaccctgctacctcaacctcccaagtagctggcacctgtaggtgtgcaccatcacacctggctatttttttttaattaactttttgtagagatgggctctcaccatgttgcccaggcttgtcttgaactcccacctctgcccacatgctgggcattcaattcctagatctcttcctccctcctctcttgacttgcctcctcctggatcatgatatcttatcattttccaatcacagcgttaatggtaaggcttgaggctgggcgtggcacccatgcctgtaaacccagtgctttgggaggcagaggtgggagttcaagacaagcctgggccatgttcagcactttacatgcccattcactgagtttgcacagccgcccatatgacgggcattgttattcctactgtacaggtgaggaaatgggggctctgagaagtgtgactgtttgtgggaggcagcagctggcatgatggaaaaagtgtaggcattggaggtgggatccaagtccagtcttccacccacaggttcagtgatgtggggcaagttatataacacagttttctcatctgtaaaatctggacaggcatacctacaccctggagcattgggaggattaaatgagatcgtgtagataacagcatagtcctggcatatgagagaaaatggcagggatctttctatgacctcagtgtgagaagcaagatctaaaccctcagaggtagagtgcgtcccacactcgggctccttctactgggacactggcttccggatctccacggagaactgttcttaagttagaaggcaagcacagcggggacacggtgcaggacacctgcggacccagtgcccttgggattctttaccttcagctttgctcactgcagattagtcctcatcgctcagcagagagagtcgagattggcaggaggatctccgtcttgaacaacattatgattctctgagcatttctatatgttgaaaatattttatttaaaaattacaaccacccctcctcctcaaaattgcatgacagagatttcaccaaacctgacaactgatgagacaaagagaacaagacacagagaggaatttagaaataatccttgtgcataccttccgaagttgccacatattactaaaattacctgtatctgtgtctatcctgctactctatgcattacatatctttgcatcccccatgcctagcacagtgcccagcacatagtaggtgctcaaaaaaagtgcccatcatttgttggactgaactcacaacacagtaacaaagagccagttagagcaaatgctgtcccttttcccaggactgtagcttccagacccgtgtgaggcctcagcctgatttctgttcaccttagaaccccaaggctgactgtgcatttccataagcacctcgctcgcctgcaggacggggctgggttggtggtgggtaccagaggtgctcagtgttcaatcacgcagaaagtgggctaaagggcagcgcctcctgctccctccagagatgcacttccattctctgaaacgacaacttctctgcactcgcttaatgggatcccaaataacacgtcgcagaccagtcttttatcactgttgccccttggaacacatttcgaatgctggccattaaaagcaggccatttcacggttctttaatgatgacactaataactgtggatttttgtctcccagagtcctgatgagctgagccaaggagtaaattacggagctaacttttatgtgcatggtttattgatctgtgagcttcaaggaaactgcaccagcccctatagtttggcagtccagactaccttttcatctgtgtaattgggccacgagggcgcagttaatattcaatttatattaataggaagacaaagaacatgatgtgccagctccatattgaagtaatgggcatatcaaaatattctacctggtaattataaataaatcagtttycccgtgacccascaaggatgatgttgctaattcactgtgcatttcatcataatttatcctgagaaagttcagtgctgccatgtgcatgtatawcgcagagtatacaagggtgctccatcgtaaaacacccagctgtcttcatccatgctgtcgcccatcttttcttaacaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggtgggtatcagccccctctcaggctcaggcaacgttgatgaaagggcaaygtttactcattcacaagggcccttgagctgggagggtgtcttctggagmattctgatggaccagttccttcaggagtcaatctgagctccaccgaatggtccagtgcttttgaattactggtgtcagaccttgggcaggatcagtgtgcacagayttcaataaaatctgtccttggggagaaggaagtgtgagccagtcagtggatcacacacagaagcaggamgataacagaaagggacaaggacaatgcgtcaaggtgctggtgacagatctagtaggaccctactcctgcctgggcattgtaygaagggaaaaaaaaaagtgtttcagggagctgattagaattaggccatctcctaggccctgtataagcacactggggttgagggcaagcctgtagccctagtaaggaaccagagtgcaaggcagggaaaccgaggctgacatgcatcctgtggcctggctcagtggagtgaaggggaagaagagaggctcagggacaggtgttgtattcrctgaattgctgccttacaaatcaccctaaaattcagtgcttaatacagtaagcatttatcattgctcatcggtcagctgagcagctcttctggtcctagctcmgctcatttttatgtctgtgatcagctgtgggttgggcaggcagctctgtggatcttggctggatatcagccaggcgaaataagatcatcctatatcacaccataggcacatgtctttgggggttggctggccttacactggtgtagaatagccttgaccaggtcagctggtctctcttccacattgtcggtcgtcatccagcaggctagcttgggctagttctcaaggcagtttccaggacccatgcatgcaggtctctggaggcctaagctcagaattgacccaatatcacttctgctggattctactggcccagcttcatgagatggagaagagattgcttctaatgattggacgagctccaagtcacattgcaagggagttgcacccaggctggggtggagaattggggccatttttattaatctactatgagcataattgggaggctacttgggggcccagggtaccaagattactgagccatgggcagccaatgaactgcagacctcaccagatgctgcaactaaagctgctagtagatatctgttctcctttggattcaccctggagctttggtgaagatgggcctctaagtggcacgaaacagcacctgttccttcaggggagggagcagggacagacgtgtagaactgattgcagaaatgaataacccaggttatagaatatagcctactttgcctggagtttgcatctttctggtaagtttctagtgcttatcaagatttacattaaacagtgtataggataataactaataacctatagcagaacctgacgacaacagtgcgaatagttaccatttgcagcctctgtgaatttcctccaggctgcatctgagtagaggaggtggcgatgttctcacgggctcctatattacaccgtgggcacacagcacatgttacaggctccattcattaagaagttgarcatgcggtttccccaaagagttttacccaagaagacaaagtaytttatgaataagttctatggtttctctccttattacattttttgtgtggcatatcacccaatgggctcagtaatttaaacctgacrtttggtctaacaaatggcctacaaataatttcattaacacagttaaaacttttcagaagcaaatctccacaagttgtaagaattccaaagcaaaccctaaatcaagcatggactatgaatgcgttttagatttattccacaaaaagggtccattttaattgctagtctttgtttacatttcacactcggctgcagagctcartatgctcaatactggagtttcgctcatttcagaatgccttactttcattcacatttccaatgttataataaattacatgtctgtataaatttgcagttttcaagacatttcgtagacattaacacatttgactcttcctagaattcagtggggtaggaagagaggcactgatgttttcatgtgacacacaaggaaaccgagactcaaagatgaagtcacttgttcaaagtccctttcccgagcagacgtccttcctggattccccccgttaacctctctgtatcctgctcggtatggtggtgtatctttgacctcctgccattttatccaatatttcctagcagtgtggcctcaggcgagtcactcaacctctctggacctcagtgtccttcctcatctgtcaggtgaggacatgaccacaatgttcctcatcaggccgtgtgattcctcgagttgacacacaggaagtgctcacagcagagccaggaacacagcaagtgctcaacaaatgcggctatttttaccgttatcactgccaatattagcagcatgctgctggccagggcaaactcagccccacagggtgggcacccctggagcccccaagcctgaaaggagggagtgtgcggagtgggcctgtgctctccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgacccttcagtggcttcggcagtcgctggctgcccctgttgggacacrtctctgctgggacacacccctgctggagaacctggacttgygggcaggcrgagccttcctgcagacctggcccttcccrtgggggctgtgctcgagaaggctgcatgcctctccaggtcccaggggaagcagcaaggggcctccggggcccctgccagctcttaacacacaccagatggacagcccgctgaccacgctcttctcagtggagagccgggtgggaactgtgccaggggatgcygccccaactctgcacagcaggtctcctctcgcccccrgcctctgcacgggtgactcagtgtggtccacacacagccaacattctcccaggtggctcaagaatcaaatacagcttattttatgtatagctcaaggtgatttctcagcctcctgcctcccatcccactttatgtccaaagaaggcttagtccattgggcagccttctgcctgctctgcagacacgcctctggcaaattccrtcaagacgctactgcttctgtctcagggttagcactgggctctccttgcctaagtcctggggggtttgaaagatcctgtgtgccctacagcagccctgtcctgccaccccctctggcccaggaggagccccccgccccccgcagagttgctggggaccaccctggaacaagtgacagctgttggaagtgtggtttttcaattttagtttaggagagaaaactgatttccaaatacttgggttcactgtgctgctgaataacaacattcacggcccaggtgcccaccgggaggcacgctgccccgagggctgcaaagccccatgttagcactgcctcccggagctcccacgagccctgactccggccccgagacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaataatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctactaaaaaaatgcaaaaaattagccaggcatggtggcacatgcctgtaatcccagctactcgggaggctgaggcaagagaatcacttgagcccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaaggtctcacttgtgaaatggtgggtcacctttttccctctcataagcctggcctgtttaataaactctatgtatacgtgtgtcagcagagggtgagtggagagtttaaagaccttatccgggaccccagaatggcagatgagggaagggaatkaggttcatgagcacactgtgcccccattccagcctgctcctgcctgctctacagacgcattcgctgaaacgtaccacggattagcagaagggtggtttgcagtgcatgtgcataatgctcaggcttgcaaagggcggaaggtcgccaggggttctgagcatctccaaaacttcacgacagaggccaacccacctgggaacacagtgacactgggacccgaagccccaggaaggtgggctcactttcgttgttagtggtgtctccgctgcgaggtccattcacggctcgtgtctcctcttgtgtctgacaggctgaagtgtgtgcaggcaccgtggcagaggtgatccagtctgtggtcaacggggcagatggctgcgtgttctgtttcggccacgccaaactgggttcgtgagagtttcactttctcatgcggctcgttgagctccctgtcatcccatgcattcctctgtctccctcccagagttctctgatgacaggaagggctgcgtttctcttaggtgttgagctgaataaccaataacaagttatacgaygaaaacctatgttgttcattgtaggtggacacccattcatgtaggaaagccttcaagtccaaatagatggaaagagaagtagcagagttgttcccacttggtccaggtcagagtcaagcccagaaggcaggcaggaaaatattcatttcctgagcagccgctgtttgggaagcagatagggccccttgcaccaccgcacccatgaggatgtgggttggtggttggacccctgtaaaagccagaggagcaacctccaagcaaagcccagagcccagggcgcgtctggagaaagcagtgcacaccgtcgggaacactccagcgctgaagcgtctgggaaaggaggcagcagagccccccaacaaggggttcataaatccccccacagtcccatcttacttctgacctgtggccatctgctccccaggccttgcccttacacgcttgatatgtttagtgaattgaggagcttcaaaaactgtcccttggcagagattccaacagaggccttgctggagctcacagaggccagttctcagccaggacagaaagccattgcctctctctgcacttccgtcctccccagccctttctcttgatcttgatgtaagcagtgatctgggttttaatagaatttgctcatgccataaaaatatacacagcatttaacttgagacaggatataaagtgtgaatatgtggacttaatctggggggtaactataaaaagaaccataatgatgatgaaaaagcccagccttcccactgtgtgtaaagcagtgcaggaactggatagcatgtgatatttggggtcctcctcaaggtacatggtgatttaatcttgtcacatgtctgggctcttgctttgtttcttttttttttaagagatggctctcagttgcctgggctggagtacagtggcatgctcatagattactgtaacctccaattcctgggctcaagtgatcctctcgcctcagcttcccaagtagctggggccacaggcatgccccaccacacccagataatttttaaaaatttttcatagaggcagggtctcygtatgttgcccagactggcctggaactcctggcctcaagcaatcctcccatcttggcccccacaaagtgctgaggttacaggcatgagccactgagcccaaccagcattctttattrtagccatttagttagtaataccagaaaatgccttctgttgttgtcaaatactatttctctcatctttttgttccttctcttcccttttccccccttccctgtgcctttcttctatatccttggcatctattttggagactccgtggaatgatgcctggrcactgaacctgcttttcttccttccctggttctcccaggaaaatcctacaccatgatcggaaaggatgattccatgcagaacctgggcatcattccctgtgccatctcttggctcttcaagstcataaacgaacgcaaggaaaagaccggcgcccgtttctcmgtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggctccctccccacctcagaggctggggcagctccacccgtgaatcactgaacctgtaaactcagaggcttacgggtgtttactttaaagtggactggaactttatggcctgcagctgtggggccatcggcttgcccagtctaaatatttgtaccttgactctaattgacaatgagyagggaccacaattacagcatttgggggagaaatggaattcactttctttatgcccctttcaaaaaaaaaaagtaacaatctttcttttgtttaacaacaaaccggaatatttactgctctgcacaaatagctagagccattacggggctgttgatgactctataaactgtgcttctggcacyggtttacagccggattagcagtgctgcaggaaaaactaataaccactttctaattagaaccgtgatataattgctagaactatggaagccaagagaagctccagttcaccatttcaggatgctaagcctgttgggagggtctctcctttgctgtttgacaacagatgtaggaatgacccgggagctgcaattcattcatatccagaataatcaatccttccagtctctaacagtaggctttattttcccgtgttgtcagatgcctccttttgtagataggtgttccgtttgataagtacctgcctcttcccaactgggattgtttgcacaggtgaggatacctcccgtggcctgttatactcattactcaaacctgaccatgctcttcccctgcttaaagcacctcagatccctccatttccctgagtcctctttcgtctgcatctgtcacctcgaggacttgtttaaacactgatcgctgggcacccccccagagtttccaattcagtaggtctagagtagagctccaaaatgtgcatttccaacaagttcccatgagatgctcatgctgccggtccagggatcacagttggaaatcactgttctgaggcatcaaatgtgcagagacagtatctacacagtgtctgtgatgcaatcagtaggactcgacccactgctcctgttccaggcattttctagacattcaaatatgctttcacccccattcrtttttagaacttcattgatgaaattccactaaggggtgaaaartctggttaaatgaaggctaagaaaaagaagaaaagaccaatattccctttaattcttgttgaaaaatcttttaaattctttggtttatttttccatagcgagacaaaattktgaacacaaaagaatctctctttgaagtctgaggattttgatggcctcaggttctaaatattggctcttacagttcaaaattatttgtatagttagagtagaaaattgtcagaatttgtaccaaccttaagacatgtactgcaaattagttctttgaacaaatcagaaacatgagttgccttttctccccaaaaagaggagtgctggttcaattctgttaatgtgatcgttgtgattcaggtttaaaataattgccaagtattttcataagattcagacgcattaccctgtgtgctttctttaatcaattaatgagtatgccgggagcatggattcaggaactaaaggtaaataggtatctcctaaatttagatgagacattcaagtatcgtgagtgtttgagggtgccctttacactggtttcttatttataactatgctagtaaatatggcctaaaattggctttaattaaataactgcaaaactaggagtcaaatgaaagctaaccaagtttttttacatctttgggacaccactgctatgaggcctcaaatcacattttgcaacctacctgtctccaaacaatctaatctttggactcaagatgcagtcacatcgctcctgttttcttaggtaaatggatagccaggggtgttggtttgccgccctctgcagagataaggatgagccatctgctcccagcttttcacacccactagttccagattctacttagattgtaaagtaggtaaaaataggtttcatccaataagtatgctcaatattaattttcagaaatgaattaattaagctgagaattgcacatgagcatagcaccttgtttcagaagggttttcggccttagaggggcatgtggctttactatgcagaacacacagccagctgaatggtgctggggacacccaggcatgagtgacagcaagccctcctcagcctgcagcctcatctcttggcttctgtcttccagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagygggaaagggggaagtaagtcggccactccaccctcctgcctccttagcggctctggccccagccagaaatcccttgggcaaccatgacctttgtgtgtgtgtgtgtgtgtgtgtgtgtgtgtgtgtgtgtgtgtgtgtgtgagagagagagagagagagagagagacagggtcttgctctgtcacccaggctgcagtgcagtggcacgatcacagctcactgcagcctcaaactcctgggctcaagtgatcctcctgcctcagtctcccaagtagcttgggactacaggctcatgccaccacacctagctatttatttggttatctttgtagagatgggaccttgctatgttgcccaggctggtctagaactcccggtcttgagatcctcttgccttgatctcccaaagtgttgggatgaaaggtatgagccaccatgcctagccaaacttttcttaatagactacaatatgcagttcagtgactcgtaattcaagataattatagtatctgggctgaagttcacttttgaactgtccagggaaaggagtttgctttggtaaaggtaatttacaaatgtcattgccatgagaatgtgagaggtcaaagttacaaaaagaaaacaactgcctgacagtatctttttgttcacagacctcaaaaatgctcctcaagaaagaccaacatttatccaccaaagcactccggcagtgtgttatcatcattagctcgaggccactgtatggaccatgttttttaaaatagcatagaaatcagacttttgaataactacccagaccctggctgcctccctcaaatcgtcagtgaaggtttactgtcaaaacccaggtacggtgcctgctcttcgagtgagctgccctgccaggaacccaacactgtgcccctacagacccctcttggctgtgtttccaaagtcagcccgggctggggtgcaattctctgccttctgtgaagtagtgtttactctatgcccaaaagagttgagcaccagatcagctgaatgtctccagtggggatcttggaccaggggcaaaktggtctgttgatttcactgggttcctaaggcaggttgtgggtaacggggctgctgggctggccgggcagtggcttccgtggttcctccatgtcccgctctgccgggctttcaatacacaggcaactggctcccagcgctttctgcatgattgtctcaaagacactggatgccagaaaaacaatcagaaaactgagttaagagtctaaccctggactggaaattgtaaagctcattgagtaaagcagagatggtccgcaaagctgttgtagatgaagcctagaatgaagacatccaagtaggaccaggcgtggtggctcacacctgtaatcccagcactttggaaggccaaggtggttagatcacttgaggtcagcagtttgagaccagcctggccaacatggagaaaccccgtctctactaaaaataaaaaaattagctgggcgtggtggcacacacctcccagctagttgggggtctgaggcaggagaattgcttgaacccaggaggcggaggttgcagtgagcccagatcgtgccactgcactccagcctgggtgacagagcaaggctctgtctcagaaaataaaaataaaaagacttccagctgggatctatggacaggctccccctgatttcccctaagcctcctcgtggctcaraagacctggacaacagtactcctggggagagagctctttgcgggcttctgctgtccccaggcaaaagcgcctcccttcccccacctcggtgcctctcttcctactctttagttactgttgttaaaatccaggtttattgcagtataaggtacattcaccaaaacatcactttgatgtgtctttagatgagttttggccaatctatacagtcatgtagccaccaccattatcaaaayagagcataaggctaaagttccctcttgccgtttgtcccttcccctgacctctagcccctggmaaccacggatctgattgttgtcctggttttgcgtttatccaggatatcgtgggaatggactcgtgtggcccagatgtggccttttgtgtctggcttctttcacgtagtgtcctaatgcatttgagactcccccatgctgcagcacgcgtctcttgtttcttctggttcctgctgcctgttctgcctgctcctttagtttttttgtttgtttgagatgaagtctcactcactctgttgcccaggctggagtacagtggcgtgatctyggctcactgcaacctccgcctcccgrgttcaagcgattctcctgcctcagcctcctgagtagctgggaatacaggtgcccaccaccatgtctggctaatttttgtacgttaagtagagacggagtttcaccatattggccaggatggtcttgaactcctgacctcgtgatccacccgcctcagcctcccaaagtgttgggattacaggcgtgagccaccgcacctggcctctccttcagttttgactgggcctggaggcttggttcctaccctaccaccaggacagaatgaaaatatccacagctggggctggagttcctctaactggggctgctttttatggctctgaaaatcagccctgagctgcctccagtggctgctgtgaagaaccgagaggttctggtcctcacttacagcgggcgaggcgccccagggaagtggcccattagcttgagggcagctctctcgacagcccatgatggtgagcaaagtctcactggagaggagccgaggatagtgaacgggaatctctcgggagatgtattcttggtaacaggctcacaccatgtagagcgcttccgtttagaatcacgttcttaaagaaggaaacgcattcggatagggatgaggagatgcagacctttaaaatcggatagggatgaggagatgcagacctttaaaatcggatagggatgaggagatgcagacctttaaaatcggatagggatgaggagatgcagacctttaaaatcggatagggatgaggagatgcagacctttaaaatcgacagcacaattgcatccacatttctcctgactgtgtgggagttggccttgaaccctgccctcactgttttctcctgggtagtgtcttcaccctgtcaatgtaagagtctgacaaatgtttagtttattcttttaagcagctgtcagtaatcatcatcatcagagcctgcaggactttcttgtactttcagtaaagagtgactcgcaaaacatctaacccttgagccaaatgactcccaaatggcactgatcagaaaaacttgggagatgggattatctctcctccttccaggtttcaaaccaaactgaggacaactctgttttcggttttgtactttttttcttttttgcagttctgctttcgatttggaatctgaaagtagggagaaatcttgaaaacaaggaaacagttcattaaatgacttcaaatataagaacttgaaattcagattccacaaaagtttaggccaagacattccctaaacccagtgatccaccccaaatcagtacctaaggaatcctgcacccttattaaatatttaatagccagctcatcttcttcctatttttaagttgtgaaagagaattgcttttaaataatgcattcaggttaaaagaaagggcaaataccacgaatggtttccaaaacctcggttaggtccttcctaatgtttcagtggatgagaacaaagaaggggaaggagtccaggggtsgtgcgatcggcagacctgggggacatctcttccctcccgaggggaaaggatcccggccagaatgcacacggcctccccgcctgggactcacttgacttcagtgaatttataactgtttaaaatataatgaggagatttggagggttgtttaaaatggaaattttgtttacttacatataagtaataatccctgcggacctggcagccagaactcaattaggggaaagtttattaattagtcaccctgcagggaagccattagaagagatctctgcygcaagaactaaatagactctgtgtgcgcctctgaatctcatatgcacacatgcattttatacattttacacacaaatgcatcttacatttataattttacacacaaatgcattttacacatataagtagacagacaaaaaaaagttttaaacatttccagtcaaaatagaaaagtctttgttgatgtatccctgttttgcagatagcactaggttaagcttaaaatatctccctgtttaaaagctcattggaattagtgggactgatccttcagcctcatggaggccttcctctgctttgcgaagctaaatctgtaatagcttgagagcctcctcgggaatcccagcactgggaaacagaccctgaagccctactgatcagagagctgcttctcgtaacgacgcgtgtactgggcacctaaaacaaggtggtacttgggaccagaagtgtttcagatttcagattgttttcagattttggaatatttgcatatgtaatgatcccttgggaatgggacccaaatctaaatacagatttcatgtatgtttcatatatgccttatagacatagcctgaaggtaactttatacaatatcttcaataattttgtgcatgaaacaaagtttttactgcattttgactgcaacccctcacraggtcaggtgtggaattttccccttgtggcatcatattggccttcaaaaagtttgagattcttggagtattttggatttcagattttttgggttagggatgctcagcgtggactagtgatacttcagggtaatgcgctaatgatacggagatcgcacctgtcctgttgacaaagataatttcaaaagccccacttttatgagtaatctaagcatgcaagcaactgttgctcaaggtccacaatgacaccgggtctctgatttgttcattctctttattgcctctgtggggaggattagagggctttgtaggctgggctgctgtgtgcgcacacaaatgtatgtgcacatgggcacacatctgtgctacactcatctgtctacacatctcatcagactctttaatctgtttttttgtttgtttgtttgtttgtttgtttttaacactgagtctcacactgtcacccaggctggagtgcagtggcgcaatctcaactcacttcaacttccacctcctgggttccccgcgattctcctgcctcagcctcctgagtagctgagatgacaggcgtccaccacaacacctggctaatttttgtgttttttagtagagacggggtttcaccatgttggccacgctggtctcgaactcctgacctcaagtgatccacccacctcggcctccccaaagtgctgggattaccatacctagcctaatctgctttcttttgacaatgcaaatgttttctttacatgtcatggaatggcttaaatcaactaatgctgyatttagggctgtgtggtggatatgactctggagatccattctttgggtggcagatgtgggaaaagaggcttaggaaagaaccttgcttctaatggagccacagccagtcccctgctgtccccagcagcgaagccctgtgcagcaaggatgtccacacactacagggctctcatctcccgcttggtcaataatgaagtggcagtttcatctttttaggtttttgtaatctatatgtttttaaatgttggccaggagacactattctgaagagtgcagcctggaattcccatcaccgcatccgtttctaatcttctcaagcctcctggccactctcagcaggtaactagcatcttagtcaatgagaagacagagctgacctggtgcattcctcaacttctcttcttttggtttcatagtctcctggtccctttacctcagtttcccscctgctccttcccacaggcctgctgctcccgtctcctggcrttcttcctcctgccccttctgcctcttctgggacctcaccaattgggaccccctcagtggtcttttcatgcttatgttttcagcctttcctcccaccaaagtcagggttacagaaggaagagaaggaggcagggagggagggaaaaggaaaggaaaggaaccacaatrgcaccttgcctctgccaygctcctctccgatcgcctcctcaacaaagacgtcagattcccctctttgtaatgtcttctttgaatttyagcagtgtgggggatgttatgcttttgccttactccgccttatattttggctgtttgtgagctagtccaagccctattggactataggtkccttgagaaagagtgccacagtgccagggctgtgtctgctgcatgctgtttgtgagcttgtccaagccctattagactataggttccttgagacagagtgccaccgtcctggggctatgtccgcagcgtcagtatccaaggcctattagactataggttccttgagacagagtgccacagtgctggggctgtgtccgctgcgtcagtgtccaagccctattagactatagggtccttgagacagagtgccacagtgctggggctgtgtctgctgtgtgctgtttgtgagcttgtccaagccctattagactataggttccttgagacagagtgccacactcctggggctgtgtccactgcatcagtgtccaagccctattagactataggttccttgagacagagtgccacagtgctggggctgtgtctgctgcgtgctgttggtgagcttgtccaagccctattaaactatgggttccttgagacagactgccacagtgctggtgctgtgtccgctgcatgctgttggtgagcttgtccaagccctattagactataggttccttgagacagagtgccacagtgctggggctgtgtctgctgcgtgctgttggtgagcttgtccaagccctattagactataggttccttgagacagagtgccacagtgctggggctgtgtctgctgcgtgctgttggtgagcttgtccaagccctattaaactatgggttccttgagacagactgccacagtgctggggctgtgtctgctgcgtgctgttggtgagcttgtccaagccctattagactatgggttccttgagacagagtgccacagtgctggggctgtgtccgctgcgtcagtgctcaggtctcctttgtccaaatgaaatgtgtgctgtggttttaaaaatgattctctgctctcgaactcctgacctcaggtgatccacccacctcggccagcctggccaacatggtgaaaccccctctttactaaaattacaaaaattagtcaggtgtggtggcaggtgcctrtaatcccagctacttgggaggctgaggcaggagaattgcttgaactcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtggccaacgtagtgaaacctcgtctctactaaaaatacaaaaatyagccaggcatggtggcgggcgcctgtagtcccagctactcgggaggctgaggcaggagaatcacttgaacctgggaggcggagcttgcagtgagctgagatcacgccactgcactccagcctgggtgacagggcaagactccatctcaaaaacaaaaaatgaaaaataaaataaaaattaatctctgtgttatctagtagagctgtgattcgggaagagtaagaccacccaattacctttcacgtaagcagatggtattaggtcagagaagcctcacaacgcaacagagtcaggaggcagtcagctgactgggcaagtatgttagagggggaattatagaaaatgatgtattcataaaggtgttatctgaaattaaataatacaaatgtatttttattcattgatcttacgaaccacaaagggccaaggctctctctttgagttttcaattcaattaatttgacttccacgaaccacattcgtattaacagttcagtttttgctttgaatttcttcaaagagatttaagagcttaaaaaaacactttacaaccaactgggtatagactttttctagattcttacagtattttccactctataattcctcattcacacaaaattcaacatcgttaaaaaaaawttttttttttgagacagggtctcactctgtcacccaggctgaagtgcagtggcgctatcttggctcactgcaacctctgcctcccaggctcaagtgatcctcccacttcagcctcccacgtagctggggcaacaggtgcgcaccaccatgcctggctaatagtttatatttttttgtagagatggggtttcaccattttgcccaggctgctctcaaactcctgagctcaggcratccacctgccttggcctcccaaagtgctgggattacaggtgtgagccatggtacccgtccaaaaaatcctcattttttatcacatcttttcaaagcattgagttgagtttttataaaaacattaactctctttacaaaatcatttcattggcttatacagtattttatgtttttatttaaaataacaaggggcagaaaccaatttaggaggaaacacagctgacctattaagaactatgcagctgattctttttggagcaaaagtgcacaaactagaccacagcctccactaaccacgagccctcagcgtgctgtgggcgtcaggcagaacttcttatgcaggtgacccagagcattgctgaacctggccaggtggtaaggcagtggctcccaaacttagctacacattagactcacctggagggcttttaaamgcatcccagagtgcgtgctgccctccagcccaattaaattagaaaggctgggagtgggaaccagacgtcaatatttcttgaaagattccagggtgattccarcgggcagcaaagtttgggaggaactacgacggtgcgggaaggcgagttaaaagagcttctgcatgctttctggttagcttcggattttcatcttagatttagcattaattttctatgagatcttgggtgatttatttaacttctatgagcctcagtttccttatatgtaaaatggggctaatttctgcattgtgggatattataggaattaagtgatattaggagaatttaggatttcctgctaccttccaggtgcttaataaagtgtggctcaggcgtaggagacgttattatattgtttcctgtgggtagaataaggcatgtgggtaatttggtttggtcaaagtctagacttaaaatattgcatattagaatataactaaaggattactcaaggcagactgagttgtgttcctttaaccctgcagtcttgacctcaaaatctggaaagtcagtgaggaacctgcttcttacctgctattaattatcacctattgtgttcatttgctgtgtaactacactttctccccagccgccggaagtgatggaaattcttgataatagcaagtggcctgtgctgactcaccttgtactatttcaagttaagcaccatgtgtgaaattcacaattctgtgcctacggcaactccaataggcacggagcagagagtagattttccattgtctaaatgtgactcttactttgagtcacgcaggtataattataggtattttatattatcatcctcagcacagtctaaactgtgccttttgttcttgtgttctgttttactacatgtacattatccattttaktccattacatcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgacacattayatcttccccttaaaggggttttactgggaatagttgaagagaaacaaaatataacatccttaatgtaaaaagttctttgccatagacgtgccagtagctggagagctggaattgcaatgctttctttaagtatttctcacctttttttctcagtactagatatggaatttgaggataggaaggggtggaggcagattagccttaggacagtggttgccgaatattttcatcctacagcatgagcagtgctgcatcagccttgtccttcgggctcttctgcagacgcgtggatgcctagatccctcccacgcaccccgagtgccacctgcaatggtccagacacacgcgggtcccacacgctctgctsgctttttgtaccaacacctttcaatcttgccccaaattacttggcctccacaacagctttgggaagtttccatctctgcctttgccattttccttctgtgcagagtagggaaaggcagagggaagagttgctgtcctggcagtaacaggaggcaggccaggtatgaggctgtaagctgggccgcctggaaagatagggatccagaggcctggaggagcagcattccgctgctgcctgggattgaggcggggggaagggagacagccaaggagtgggtgatgtacccagagacacgcctctctggaagagtggggcctggggcaaaaaggcggccttctccggctgctttgtggagctgatggaggccgcaggatgtagttgagagctcaggtcttgcagtcagtctgtggtttgaatcctagctctactactggctgcaggatcgtgagcaagtttttttttttttttttttttgttgttgttttttaacaactttaatgagatatacctgagctacaataaactgtacatattaaatcatataacttgatgttttatcatatgtatatgcctatgaaaccgtcctcaatcaagataatgaatatattcttcacccccaaaagtttcctcgggagccttgcaatccctgcctccagctcctcttccttcctgtctccagacccaggaaccactgaactactttcagtttctagacattagtgtggatttcctagaattttatgtaaaaggaaacatatcttgcagacggtactctcgtgtgtggcttctttcacttagcataatgattttgagatgtaatcatttcattgcctgtatcaatagttcatatatttatatttctgcataatrgtccactgcccagatataccacagttggccgatccattcatctcttgatggacatttctgttgtttccagtttggggatattacaaataaaagtactaaaggttgagcatccctaatctgaaaattcgaaatccgagatgctccaaatctgaaactttgtgagcgccaaatgacatcacaagtagaaaattctacatctgaccgcatgtgacaggtcacaggaaaaactttttgtgtacaaaattatcaaaaatattgtctaagattatcttcaggctgtgtatataaggtatatatgaaacataaatgaatttaatgtttacgttgggtcctatttccaagatatgtcattagatatatgcaaatactccaaaatctctggttccaagcatttcagataagggatattcagcttgtgtgagcatacatgcacaagtctttgtatggttatatggtttggctctgtcctcgcccaaatttcatgttgaattgtaattcccagtgttgggggagggacctggtgggaggtgattacatcatgaggatggatgtcccccatgctgttctcatcatagtgagttatgagatccggtggtttaagagtgtgtggtactctcccccctgctcactcgctctctctcctgctctgccatgggaagatgtgtcttccttcactgtgagtcaatgaaacctattttcctcataaattacccagtctcaggtagttatttatagcagtatgaaaacagtctaatatatatatggacatatattttctttcctttggggtaaaaacctataatagaactggaatcttatcaatgtctgggaatatttgaaaaaaaaaaaagaaaaactggaatggctgtaccatatagtagatgtttaactttttaagaaatttctcagctgtttcccaaagtgcttgtactattttatatggggagttcccgttcctccatacacccaccagcatttggtgtggtcagtcttttaagttttgcctgtttacatagtaggtttgtaatagtgtcttgtggttttagtttgcacttcgctaatgaccaatgatgccaagcatccttctacacgcccattcggcatccatacctcttctttggtgaaatgtcccttcaaatcttctgtccttttaaaaattgttttgaaagtttttaatatattctggatgcaaatcctttataagatatagtatttgcaaryattttctctcagtctgtggcttctctcttcattctcaacagcatcttttgaaaaacaaatacttgtttttttatgaagtccaatttatatgttcttttatgaatcatgtttttgctgtcacatctaagaaatctttgcctaacccaaggccaaaaaggtttcttcttatgcctcctctagaagttttgtaattttaggcttcaaatttaggtctttgatcaatttttagttaatttttgtatattttgcaatgtatggactcaagtagtttttttcaggttgagggaggttaggtgtttttttgtgtgtgtgtatgaatatagtatccaaaatttccagtatcatttgttgtaaaaagctattatttctctactaaattacctttgtcaaggattagttggccatatttatgtgcaactatttctagactctgttctgttccattgatctatttgtctatctttacaccaataccacactgttttgattatggtggatgtataataggtcttgaaattaggtaatgttaaccttccaactttgttcttattttttaaagttgttttggctattcagtgtatttggcatttccatacaaattttagagtcgctttctaaatggattacrtagaaaaaatttctatcaaagaagtctaccaggattctgattgggattgcattgaagctatagcaacttggagatgattgacctcttcacagtattgagtgttctgacccaggagcacagtatctctctctagtttaggtttttattagttcccttcagtaattttttaaagtaggaaaaagctattatttaaacatgtatttcttttatattgatatataattacacatatttatgggtgatattttgatgcacgcatacaatgtgtgatgatcaatcagggaatttaggagattcatcacctcagttatcacttatttgtgttgggaacatttcattattttcttctagctatttgaaaatatacaataaattattgttaactatagcctcctactgtgctatcaaacactacggcttcctccttttatttaactgtgtatttgtaactgttaacccacctgttttatccccctcccccggcaccccacaycccgccccttcccacacacacacattcttcccagcctctggtatctaccattctcctctctacctgcatgagatcaactttttaagctcccacatatgagtgagaacatgcaatatttgtctttctgtgcctggcttatttgacttaacataatgacatccagttccatccattttgctacaaatgacaggatttgagtttttgtataactactagtattccattgtgtatatagagcacattttgctacaaatgacaggatttgagtttttgtataactgctagtattccattgtgtatacagagcacattttcttggtcccgttccattcatccatccattgttggacacttaggttgattctgtatcttggctgttgcgaatagagctgtgataaatataggggtacaggtatccctttgatatactgatttctgttcctttggacaaacacccagtagtgggattgctagatcatatggtagttctckttttagtttttttttgagaagcatctatactgttttctatactggctgtactaatttacattcccaccaacagtgtgtaagagttccctttactatgcatcttcactagatttcatggtgggtttttttttttctgtctttctaataatagccattctgactggggtgaaattatatctcattgtggttttgatttgcacatccctgatgattagggacattgaacattttttcacatacctggttgccatgtgtatgacttcttttgagaaatgtctattcagatcctttgcccaatttttaatgggtttgtttgggttttttgctgttttgagttccctggatattaattccttgttgaatgaacagcttgcaaatattttttttccattctgcaggttgtctctttgctctgttgattgtttccttagctgtgcagagcgtttttagtttaacatactccaatctttctaattttggttttcttacttgtgctttcaaagtcttagccataaaatctttgcctggaccaatgtcccaaagcatttcccctatgttttcatctggtagagttattgtttttggtcttaatatttaagcctttaataaattttgagtggatttttatatatggtaagagatagcggtctagtttcatccttctgcttatggatatctagttttcccagcaccatttattaaaggggatgtcctttccccaatgcatgttcttggtgcctttgtcaaaaatgagttggctgtaaatagatagatttatctgtaggttctctattgtgtcccattggtctatgtgtctttttatgtcaataccagcctgttttatgttacagtagcttcctagtagtgtattttgaagtcagctagtgtgatgcctccagcttgtttctttgttttccagtattgctttgtgtgcaaggtttttctgtgtgtgtttaaattccatgaagaatgtcatggatatttcgatagagactgcattgagtctgtagattgctttgagtaggatggtcattttaacaatgttaacttgaactcaggattcagaaactcactcaaaaccacacaactacatggaaattgaacaacctgctcctgaatgagtcctgggtaaataacaaaattaagggagaaatcaatgagaacaaaaagacgatgtaccrgaagctctgggacaccgctaaagcagtgttagagggaaatttatagcactaaaygcccacatcagagagctggaaagatctcagatcgacaccttaacatcacaattaaaagaactagagaagcaagagcaaacaaatccaaaagctagcagaagacaataaataagatcagagcagaactgaaggagttggagatgcgaaaaacccttcaaaatatcaatgaatccaggagccagttttttgaaaaaaaaaattaaggaaatagaccacttsactagactaataaagaagaaaaggagaagaatcaaacagacacaatagaaaatgataaaggggatatcacccctgatcccacagaaatacaaactaccatcagagaatactataaacacctctgtgcaaataaactagaaaatctagaagaaatggataaattcctggacacatacaccctcccaagactaaaccaggaagaagtcaaatccctgaatagaccaataacgagttctgaaattgaggcagtaattaatagcctaccaaccaaaaaaagtccaggaccagatggattcacagccgcattctaccagaggtacracgaggagctrgtaccattccttctgaaactattccaaacaatagaaaaagagggaatcctccctaactcattttatgaggccagcatcatcctgataccaaaacctggcagagacacaacaagaaaaaggaaacttggccgggcacggtggctcacagtggctcatgcccataaccccagcacttagggragccaagcaggtggatcacttgaggtcaggagttcgagaccagcctgccaacatggcaaaaccctgtctctactaaaattacaaaaatagatgggcatggtggcgggtgcctgtartcccagctaatcgggaggctgaggcaggagaatcacttgaacctgggaggcagagattgcagttagccaagatgaagtcagcttcatccctggttcaacatgcaaatcaataaacataatccatcacataaacagaaccaatgacaaaaaccacatgattatctcaatagatgcagaaaaggccttcaataaaattcaacacccttcatgcctcaataaactaggtattgatggaacgtttctcaaaataataagagctatttatgacaaacccatagccaatatcataatgggcaaaagctggaagcattccctttgaaaaccagcacaagacaaggatgccctctctcagcactcctattcaacatagtgttagaagttctggccagggcaatcagacaagargaagaaataaagcatattcaaataggaagagaggaagtcaacttgtctctgtttgcagttgacctgattctatrtttagaaaactayatcattggagcccaaaaacttcttgaactgataagcaacttcagcaaattctcaggatacaaaatcaatgcaaaaatcacaagcattcctatacaccaacaacagacaaacagagagccaaatcatgaatgaactcccattcaccatcgctacaaagagaataaaatacccaggaataccttacaaggaatgcgaaggaccccttcaaggagaactacaaacaactgctcaaggaaataagagaggacacaaacaaatggaaaaacatctcatcctcatggataggaagaatcaatatcgtgaaaatggccatactgccaaaataatttatagatccagtgctattcccatcaaactacactgacagtcttcacagaattagaaaaagctactttaaatttcatatgaaaccaaaaaagagcccatatagcaaagacaatcctaatcaaaaagaacaaagctgggaggcatcacgctacctgacttcaaactatactacaaggctacagtaaccaaaacaacatggtactggtaccaaaacagacatatagaccaatggaacagaacagagacctcagaaataacactacacatctacaacaatctgatcttcgacaaacctgacaaaaacaagcaatggagaaagaactccctatttaataaatggtactgggaaaagctagccgtatgcagaaaactaaaactggaccccttccttacaccttataaaaaaattaactcaagatggattaaagacttaaatgtaaaacccaaaaccataaaaaccctagaagaaaacctaggcactaccagccaggacataggcagaggcaaagacttcatgaagaaaacaccaaaagcaattgccaacaaaagccacaattgacaaatgggatctaattaagttaaagagctcctgcacagcaaaagaaactagcatcagagtgaacagacaacctacaaaacgggagaaagtttttgcaatctatccatctgacaarggtctaatatccagaatctacaaggaacctaaatttacaagaaaaaaaacaaacatcaaaaagtgggcaaaggatatggagagacacttctcaaaagaagacatttatgtggccaacaaacatgaaagaaagctcaacatcactgatcattagagaaatgcaaatcaaaatgacaatgtgataccatctcatgccagtcagaatggtgattattaaaaagtcaagaaacaatagatggtggcaaggctgtggagaaatagaaacgctttcacattgttggtgggaatgtaaattagttcaacttytgtggaagacagtgtggtgattcttcaaggatctagaaccagaaataccatttgacccagcaatcccattactgggtatatacccaaaggaatataaatcattctactayaaagacacatgcacacatatatttattgcagcactatttacaatagcagagacatggaaccaacccaaatgtccatcaatgatagactgcatgaagaaaatgtaatacatatgcaccatggaatactatgcagccataaaaaagaatgagatcatgtcctttgcagggacatggatgaagctggaagccgtcatcctcagcaaactaacacaggaacagaaaaccaaacaccacacgttgtcactcataagcgggagttgaacaatgagaacacatggacacaaggaggggaacaacacacaccagggcctgtcagggggttgagggaaaggggagtgagagcattaggacaaatacctaatgcatgtggggcttaaaacctagatgacagtttgatgggtacagcaagccaccatagtacatggataactatataacaaaactgcaggttctgcacatgtatcccagaacttgaagtaaataaataaataaataaataatattaactcttctgatccatgagcatgggatgtcttttcatttttttctatgttcttcaatttttttatcagtattttgaagtttttgttatagaggtatttcacctccttacatttattcctaggtattttttagtagctacagtagatggggtagctttcttggtttctttttcaactatttgttgctggtgtgtagaaacactactgatttttgtatccagccacattaccaaatttatcagttctcagagtttttggtggaatctttaggttgttctaattattatatgccatctgcagagaggaacaatttgactttckcttttccagtttggatgccttttatttctttctcttgcctaattgctctagctaggacttccagtactatgttgaataacagtggtggaagtgggcatccttgtcttgttccagttcttagaaaaaaaaggcttttagcttttccccacttattatgatgttagctgtgggtttgtcatatatgacctttgctatgctgaggcatgttttttctatgcctaacttattgagagtttttatcatgaaggatgttagattttatcaaatatttttcctgtgtctattgagatgatcttgttgttttagtctctcatatgttgatgtgatgtgcacgtttattgatttgcatacatcgaaccatcattgcatccctaggataaatcccacttgattatggtgtattatgttattggtgtgttgttagatttggttcrctagtattttttagatgatttttgcatctatgttcatcagggatattggtatctcattttggtattaggataatggtggcctggttgcgtgaattaggaagacttcccgcctcttcaatttttggaatagtttgagaagaattggttttactttactccttaattctactgaacttttaaagtcctgggcttttctttgttggggaactttttattactgattaattcttgttactcattatttgttcagatttttttattcttcctgatttaatcttgtaaggctgtatgtgtccaagagtttatccatttcacctgagctttccaatttgttcgtgtgtagttcttcataagactctaatcatttgtatttctgtggtatttttttcatttctcattttttaaaatttggatcttttttcttggttagtctaacagtttaatcaattttggttcctttcaaaaatcaagcttttattttcttgatcctttgtaatttttgtgtgtgtgtgtgtttatttcgtctctgatctttattctttcttctgatttttggctcagtttgctttggcttttttagttccttgagatgcatcattcggttgtctatttgaaatctttctccttttttgaggaaaacatttattactctaaacccctcttactactgcttttgttgtatcccgtaggtttaggaatggtgtttttccattttcatttgttttaagaaaaaagattttatttcattcatttaggagcatgttttcatgtaggagcatggttttaaattttcatttatttgtacagtttctaaagttcttgttattgatttcgttttactgaattgtgatctaagatgcttgatatgatttcaacttttaaaaatgtgttgagagttattttgtggtctaacacatggtctatcatggagaatattccatgtactgataataaggttgtgtattttgcagcacttgaatgaaatgctctctaaatatctgttcgatccatttggtctgtagtgcggattaagttcaatgtttctttattgattttctgtctagttgatctgtccagtgctaaagcggagtggtggaccaggaccaggcacattggctcacacctgtaatcccagcactttggaaggccaaggcgggccaatcacttgagctcaggagtttgagaccagcctgggcaacatggtgaaactctgtctctagaaaaaatacaaaaactagctgggtgtggtggcatgcacctgtagtgccagctactccggaggccaaggtggaaggatcgtttgagcctgggagattgaggctgcagtgagccaagatcacaccactgctctccagcctgggtgacagagtgagaccccataccaaaaaataataaataataaaatggagtggtggaggcctcaactattactgcattggggtcaagctctttagctctaatgataattgttttatataatatatctgggtactccagtgttgactgcatatatatttacaattgttatagtctcctgctgaattgttccctttatcattatattaatataatgaccttatttgtcactttttatgttttttggctaacattgtattttgtcttatgtaagtatagctactctggcacacttttggtttctattttcatggaataattttttccatcccttcattttcattctatgtgcatctttacaaatgaaatgcatttgttggagacagcatacagttgggtctttttttttttttaaataaatccattcatcttgtctatattttttacttaaggaatttaaactgtttacattcaaggatgtcattgataggtaaggacttacttctgtgattttgtaaactgttttatgatggttttgtatattttttgttcctttcttcctcttgtattgcttaccttgatgatttggtagtttattgtagtgatgtttgactcctttctctttctcattcgtgtatctgctctcccagtgagtttttcagtcttgcgtattctcacggtggtagttattgtccttttgcttccagatgtagaactccctcaagcatttctcacagggcctgtctagtggtggtgaattccctccattttttcttgtttgggaaagactttacttttcattcattttttaaggatagctttcagcaatatttcatctttttttaaggatagctttcagcaatattttatagtttttatgtacacattttaatcatatctctaaatcatgtgtttgatgttgttgtaaatggtatttttaattttttttgagttggggtgacagagtgacacccaggctggattgtagaggcacagtcatagctcactgcagcctcaaatttgtagtgttcctgccacctcagcctcctgagtagctaggattataggcacatgacatcakacccagctaatttctttttgtatcatttttctgtagagatggggtctcactatgttgaccaggctggtcttgaactcctggccttaagtgatccttctgccttggcctcccaaaatgctgggattaccggtgcgaggcaccacacccagccttatgttttaatttctaattgtttgttactatgataaagaaatgcattgatttttgtccattgacctcatatcctgcaaccttcctaaactcacctattagttctagtaccttttttgtggattgcatccattakatttttctataggtgactatatcaccaatgaagatcatttgactttctttccaatctggatatcgttcatttattgtacttgccttattgtactggccaggacttccagtataatgttaaatggaaacggtgagagtggacatgcytgtcttgctcccaatcttagagggaaggcatttagtcttttaccattaagtatgatgttagctttagtttttagtagataccttttattaaattgaggatattgccttctacttatatattgctgaggattttttatcaggaatgactgaattttggtaaatgctttttctgcatctactgaaacaatcatatagttttcctttcagtttgttaatatggtaaattatattgattargttttttttgttaatcaaccttgcattcctgaaataaacctcacttgctcatggtataaaaccctttgtatttgttgctagatacaatatttttttgagttggggtctcactctgtcacccaggctggagtgtagtggcatgatcacagctcactgcaattttaaactcctgtgctccagcaatccttccttccatctcagcctcccaactagctaggattacagtgtgcaccactgtgcccagctaattttttatactttttttgtagtgatgaggtcttgctatgttgccctggctggtcttgaacttcgggcctgaagcacctcagcctcccataatactgagattgtaggagtaagccaccatgcctagccctagatacaattttctaatatggctctttaatattttatttagaatttttttggcaatgttcatgagggatattgttctgcaggtttttgtgttttttttttttttttcaaacaacatacttgtttgcttttggtatcagattagtatagtatagcttgggaagtatttcttcctattttcaggaagactttgagtagaactgttattatttcttccttaaatggtgggtagaattcaccagtgcctccatctggtcctagagttttacctgtggaaaggytgtgaactacagattctatttctttaatgaatctagggccatttttattatctattacttcttgaaagagctttggaatttttcatctttcaagacatttttccattcttacacattgtttaatttactggcataatgtttctttattatctttttgatatctgtaggaactttagatgaggccatctcattcctgatattgatcatttgtgtctttctttttcccagatcatttgtgctagggatttacaaattttgttgatcttctcaaagaaccaacttttgattcatcgacttttctccattgtttttggttttctgtttcgttgatttctgctattttttttcctttctgctatttttttttcctttctgctattattttgtctataatttgctcatctttttctaatttcttaaggtgtaagctgagatcattgatttgaagccatggttgctttctgatataggcatttaatgctatacgtttgttttaagtacatcttcagggttattcacaaatttggatgggttgcattttcatttctattcacttaaaaasactttaaaattttcattttgaatttttccttgaccataggctgtttggggccaagttgtggagtttcagaatatttggaggtttttcagatattgttctacattgacttctaatttaattccattgtatcaggcaacatgctttgagtgacatgaatccttaacatttatttagacttgttctgtggaccagaatactgtgtatcttggtaaatgctttgtgtgcacttcaaaagaatgtgtattctgctattgttgggttgaatgttctgtgtcaagtagatatttgatagtattgttcaaatttatatccttatggttttctgtctacttgtcatatcagttttgagatgggggtatttgaaattgccaactataattaaagacttgtctgtttcttcatgcagttctaccagattgttcttcatggattagaacatgagccacataaatttttttattatgacctcttgatgaattatctcatttctcattatagaacgttttttttttgactctaacaacatttttcatcttcagtcttttttggcatttttaaattgtgtgtcatagttgtacatatttttggagtacacatgatattttgatgcatgtatacaatgtgtagtgatcaaattaggaaaattgggatattcatcacctcaaacatttatctttgctttgtgttgggaatgtttattattaactatagttcttctactgtactattgaatactaaaactcattccttttatctaactgtatgtttgtacctgctaaccaatttctctttatcctaccctctgcccttcccttcccagcctctggtagccactcttctactctctatctccatgagatccactgttgtagctcccacatatgagtgacaacatgggatatttgtctttccatacctgacttatttcatttaacataatgacttccagcttcatccatgttgcttaaaatgacaggatttcattatttttatggctgaataatattccattgtgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgctggatcatacagtagttctacttttaagttttttgagaaacctccagaatgttttccatgatggctgtactaatttacattcccaccaagtgtatgagcattcaccatttcctgcatcctctccagcatttgttttttgtctttttgataatagccattgtaactgaggtgagatgatagctcgttatggttttgatttgcactttcctgatgattagtgatgttgaacatcttttcacatacctcttggccacttgtgtgtcttcttctgataaatgtctattcaggtcttttgctcattttaaattggattatctggggggttttggcccattgagttgtttgaattcctcatatattctggttattaatcccttgtcaaataatttgcaaatattttctcccattccatatgtaggttatcttttcactttgttgtttcctgttctgtgtagaagctttttagcttgatgtaatcccacttgtctatttttgcttttattgcctatgtttttgaggtcttaccccaaaaatattcgccaatgtcctgtagtatctccccagtgttttctcccagcagtttcatagtttcaggtttaaatttaagtccattttgagttgattttcataatgtgataaaaaatgaagctctagtttcattcttctgcatatgaatatycagttttcccagcaccatttattaaagagattgtcttttccccaatgtatgttattggtgcctttgtcaaaaatgagttggctgtaagtgcatagatttatttctgggttttctattgtattccattggtcttctatgtgtctgtttttatgccagtggtatactctttgcttactatagcttgtagtataatttgaaatcagatagtatgatgtttccagcctggttatttttggtcagtattgatttatctactacgggttttttgtgattctataagaattttaagatttcttttttctatttctgtgaagaatgtcatgagtattttgatagggattgcagtgaatctgtagattgctttgggtagtatagacattttaataatattaattcttctttgagcatgggatatttttccatttatgtgctcttcaatatctttcattggtgttttataatttttcttgtagagatctttcacttctttggttgaatttttactaggtatgtttttgtagctgttgtgattgctttcttgatttcctttcagattgatcacagatagcatatagaaatgttacacattttgcgtgtttattttatatcctgcaactttattaaactcatttatcagttctaaaagttttttggtggaatctttagatttttctaaatataagatcatgtcatctacaaacaagaataatttgacttcttcctttctaatttggatgccctttatttctttctcttgccctattgtgctggctaggaattctagtactatactgaataattacagtttatagttcaccactgagcatccttttcttattccagatcttagtgaaaggttttctattttaacctattcagtatgacataagctgtgagtgtgtaatatatgacacttatcttgttgaggtatgttccttctataaatttgttgaggattttcatcacgaagggatattgaattttactgactacctttccagcatctattgaagtaattcatatattttccttgattctgttgatgtgtgatgtattaaacttatttgacttacatatgttgaactatccttgcatcactgggatgaatcctacttgattatggtgaatggtctttttaatatattgctgtcttctgtttattggtattttgttgaggatttttccctctttttatcagaaatattgtcctgtagttttcttttgttatctttggctttggaaataaggtcagggtggccttgtagaatgagtttggaagtatttcctcctcttcaattgttaaaaatagtttgagtagaattggtattagttattctttaaatgtttggtagatttcagcagtaaatccatcagttccctggcttctctttgatgggagactttttattactgttccaatctattacttgttattggcctattcaggtttttatttcttcacagttgagttttggtaggttatatgtttccaggaatttttccattttttcctagattttccaatttattggcatatagttattcataatggtcgctaatgatcctttgtgtatctgtagtatcagttgtaatgtcatctttttcatctctgattttatttagttgggtcttctgttttttcttagtctaactgaaggttttaaaattttgttgcttttcaaaaaaacaaactttttattttgttggggttttttgtattgttattttagtctcaatttcatttatttctgctccawctttactcatttttttcctactaattttaggtttggtttgtttttccttttctagttcattgaggtgcaacattaggttgtttatatttggagtctatatttttaatgtaggtatttattgctatagaactttccattagtgctactttttctgtatcccgtgggttctggcatattgtatttccattttcatttgtttcaagaactttttaaacttcattcttaatttcttcattgacccattgatcatccaggagcatgttattcaatttccatatatttgaatagtttccaacatttcttgttatttatagttttattctgttgtggttagaaaagatacttgatatgattttgactttttaaaacttgttgagacatgttttgtggcctatcatatggtctgtcctggagaatgttccatgtactgatgagaagaatgtgtattttgtagcagttggataaaatgttctgtgaatatctgttaggtccctttggtctagagtatagtttaattctgaggtttctttgttgatttttctgcctgaatgatccacctattgccaaaagtgaggtgttgaagtcccttactgttattgtattgtagtctacctctcctgtttagatctactaatatttgctctctctctctctctctctctctctctctctctctctctctctctctctctctatatatatatatatatatatatatatatatatacaccctgctatttggttatatatattcataattgttatatcctctttcagaattgactccttgctgaattattatataacaatttcctttgtttctttatatagtttttcacttaaagtctattttatctgatcgaagtatagctagtcttgatcatttttggtttccatttgtatggaatgcttttggtttccatttgcatggaatgcttttcccatcccttcactgttagtctatgtgtgtctctataggtgaagttagtttattgtaggcaacatatacttgggtcttacttattaatccattcagccactccatgtcttttatttggagaatttagtccatatacattccatgttattattgataggtaaggccttcctactgccattttattacttattttctagttgttatatagtgtacctccttacttcctttcttatttttgtggttaagtgattttctttgatagcatgttttaatttgctgcttttattttttgtttatcaattatagatttttgctttaggttaccatgaagcttacaaaaacatcctgtaattataacaagttatttaaaagtgataccaatttaacttttcattgtagcagaagaaaagaaacaaaaagaaaaaaacacatgcattttaattcccttctgttcctacattttaaatttttgatgtcacaagatcaaaatttgcctacctcaaaaattttatagttgttatttttaatagttttgtcttttaatcttcttaataaaattttaaatggtttagatgccatgattacaatataacaatcacattagcattatttttcctatgcttttaagaacttctttagcatttatcataggctaggtctggtagtgatacgttttctctggaaaactcatctctccttcatttctgaggaataactgcttggtgcagtatccttggggaacattttttttttccttcagcactttgaataatatcatctcactccctcctgacctgtaaaatttctgctgagaagtctgctgccaggtgtatttgatgtccgttgtatgttatttgcttttttcttgctctctcactgtttttaggaccctctttgcctttgacctttgtgagtttaattataatatgtcttggggtcttctcacttgggttgaatctgatcggtgacttttgacctttgtgtacctggatatttatatttttctccaggtttggaaagttctgtgttatttctttgaataagcttgcaacttcttgtctttctcagttctctctttaattccactaacccaaatatttgctcttttgatgttggtccataggtcccataagctttgttcattccttcttattcttttttttctcttctgactgtctattttcaaatagtcttgtctttgagctcactgatcctttcttctttttgatcaattcctctgatacgctctattgcatttttcatttcatttattgaattttttacctccaggatttctgtttaattttattttttaaatcttttctgtgaactttctctgagagatttctgtgagctttcttgaagttcactgagcttccttaaaactgctattttgaattatttgtctgagagatcacatattttcatcactttagggccagtcttggtgccttactttgtccctttgacatcatatttccctgaatgttcttgacgcttgaagtatgatgatatctacacattgagagattaaatattttagtcttcctagtctggctttgtttgtgcctgtacttcttcagagggtcttccagagattctaagccaactgactattgtgttccctgtgatcaccacagtaatctcagcattagaggatactctattccctggcttgctgtgagtctcacaatggctttctggcccaaacggacctggggaagacccaatgacggtacttgtgttatgtgggaacactggccaccagggacctgagtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcagaaaaaaaaaaaaaaaaaaaaaaaaaaatggaggctggcatacctgccacattggctcaaatgggcatgcatcttctagtaagtccctgcatagacaggatagttccccaactatcagcaggaggagctggagcagaatctgggccctcataagatctgctgtgagacagatactgaaggggtcagtctcagctcagaggggtgtgtgtcacccagcaagttcctgtagagatagaatagttatctgactacagagagagggtctggagctgtgactgggccctcttgggatctgctgtggaatagaagctggagagcccagtcttgtatcagaaggcatgtctttcccaggaggacactgcatcaataggatagttccacgactgcagcaggaggtgctgtacatgcctctctgcgggtcttagcacaaatgggataggtctttgmctgtcttcagtctcttttgtctaatattggtagatccactccagctcttatggttactgtttgccttatccacacttacacgtttaaatgattgtttatttctatttgaagtgtatttctcaagcatatagtagagcctcacttttttatccaatctgacgatttttgccttttaataagggtattttagactatttcaatttcatatgattattgatatggtttggttcaaaatattattttctgttttctatttgtcccatctgatctttgttctctctctctcttttttgctttcttttggatttatgaaacatttaaatggttccaatttccatcttctgtgggtttattagctattacttttattgtttaattattgctttagtgtttgtaatatatatgtttaagttaccacagtctaatttaaagtgatattataccacttatataaggaataaaaaccttacaatagtatacttccatttctcccgtctgacttttgtgttattgctatcaaacattttaattttacatatgtcatcattcacacgttacattatgatttttgttttaataataatcttttaaagagatttaaagtaataaaaattacatatttacccatgtggttatcatttccaaagctcttcattcctttgtctatattccttgtrtttttgcttatggtgaattcttttaggatttttaagtcaaaaaatatctttatttcccttttgttttggaatgatacttttgctgggtgtatatttctaacttgacagtttttagtactttaaaaacattgctccactgtcttctcacctgtatttccaatgagaaatctgccgtcatccttatctttgttcctttatatgtaacgtgcttttttctctctggctcttttcaagatttttctttatatcactggttttgggcggtttggttatgatgtgccttgatatagtttcttcctttgtgcttggggctcacttagcttcttggatacatgggtttatgactttcattaaatgtggggaagttttagccattatttttctcaaatattttatttgtaccacactctgtcttctcctttagggactccaattacacatagcaggcacttgaagttgtcctacagctcttttttttctgtgttttatttgttgttttttttccctatatattttattctgaatagttttattgctagatcttcaaatttgctgatttttcattctgcaatatctaatctgccattcatctcatctactatattttttttatctcacacattgtagtttttatctctagaggttcagttttgtgtctttttaaatatatattccatgtttctacttaactttttgaacatctgaaatacagttgaaataactgttttaataaatagctgcttctgtcaattctaacatctatgctagttctaggttggtttcagttatctcttcattatgggtttcattttcccgagtctttactttgtaaatattcttaagctttgttttagaatgcagttgcattacttggaaacagtttgatcatttttttgttttgcttttaatatgtgttaggtgggatcaggtcagtgttcagtctgtggctaagtatgggaaagacttctgggtattcaacccaatgccctgtgaatcgtgaagttttccaggctggctgttaggaagtggcactattcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggatccatctcctccagtggcggtctaagatccaacactgaagatcacacttcaacacgacgcctgtgattctcagtgttggaacctgctgggaggtgtttgggtcatgggggtggacgacacatctccaacattgaggatcacatttcaacatgagatttggaggacacaaacatccaaactacatcaggtgtgctgatcagtactcagctgaacacttgagggaccttctgcaaatctctagagctctctcctctgcagtactctgtcttgtaaattgttgccaccttggtctccctgtacttcagcagcagaggtattcatgggcaagttgcttaagttttctgaacagttattttctcatcaatacagaaaggataatagtatttagcttatgattctactgtgggaactgaacgaaactgatgtttgtacagcacctggcacttggcagatactcagcaaatatttgggtcttccctgtctctgcacctggtcgttacttcttcctgatttttgtcttgggtttgcaacctgattcctggctgagctttaggttggtttctgtataacgatcaaccaaagcaggtaatcactcatgagccattcaggttttaacttgatgagtttcagaattctgctattcaaatggcatttaggtagaaacgtatcctcctgtaatttgacatttattttytccaaaatctcattcagttcaacctgcaagaattatttgaattcacttatttgtagtgtgaatgtcagtaggctttagaaggtcagtggtgcgtggtggaaagaatttaagaggaccaatgctatttgcaaccccagcgtgatttttctggggtttcctagtaggtcatgaacgtcaaccttttacttccccttctcattttgcctcagatttcccaaggagctacatgaagaacagatgagtgtttgtcagaacttaaccatttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgycacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccactcgcaaatgaaggtggtgggtcattgtcaccataataaagatgtgcctgtttcatagtgatgagagtgaggggtggaagactggcttatccttaggggtagggccaccagacttaaccaaaaaaatataggatatccaggcaaattcaaatttcagataaccaacaaataaggttgtattataagtatgcaccccaacattgcatgggacgctcctggtgacatgtattttatctggcaacccaatctcgggagttcagaaagctaggggagttagcacctgccttcccatgcaaatgtttagtcacttccaggatccttcctgtctctttactactgctccaattaaattacagccgctcctatgtctggcagagacaaagccactccaccaccatcaccccaactaagcgttctcattggaccgtgtggtggcaggccattgactggctgtccaggcttctgccaaggcctagctgagcctcttactagctgcatgaaccttcattcttcctaaaatgagggttaaagctatacatgttacatcacagaaatataaggctcaaaatgataaaacatgtataaaagtttattgtaggctgggtgcggtggctcatgcctgtaatcctggcactttgggaggccgaggcgggtggatcacaaggtcaggagattgagaccatcctggctaacacggtgaaaccccatctctactaaaaatacaaaaaattagctgggcgtggtggtgggcacctgtagtcccagctactcaggaggctgaggcaggagaatggcatgaaaccaggaggcggagcttgcagtgagccaagatcacgccactgcactccagcctgggcaacagagcgagactccttctcaaaaaaaaaaaaaaaaaaargaaaaaaaagaaaatttattgtagaatttaggacactatggccaataaccaatgatgaaagtctggttacacctatctagtcaagcctatcctcacctatttaaagggaaaaaacaccgaccttacagagttgccatgaggtgaagattaactaaatatatgtggattcatggttttatctgtaaaaaccctacaaaacctacgttgctgttgtgtaggaggaaaaagtcgggcagtgtattctataattactgagattcacaatgagtgctggagtttttcttcccctcagccctatgttgatgccagacccccccaccaaatacattgtgagtttatttcctaccaggagaaccattactggactgactttaggagcttaaatggtgattataatcctgtccatctcatttctagaaatttggaatcctagttggataaacccagaaatggttttcccggctcttgtaacaacccttttctatgggagaatattctgagttgaagaattatagagtttcattcgatgtcatttctgtagttgagtaaattcagcttgtggggagaaagggcaggggagggaaaccgttggagttggagatgaagggaagagtactagcactcactggtttccataaaatgagaatcatgtctgttaatgtcagaayttcatagatcatgatatagataaaattccaaattgcaccttagcaggaggtcattgattacatatcttacttatagcttttacactgtttctgcagggcgacatgcttttatgatttctataaatagttgttgaattgatggcgggaagatagatgcatgtaaacatgaaattatttttaatttaaagtaacttccttttagttagagttgggttttttataaatgagtaggraaacattaaaaattgtttttatggcccagcgtggtggctcacacctatattcctggcactttgggaggctgaggcgggaggattgcttgagaccagcctgggcagcatggcaaaaacctgtctctacaaaaaatacaaaaattaaccgggcatggtgttgcatggttgtagtcccagctacttgggaggctgaggtggaagggtggcttgagtccaggaggcagaggctgcagtgagttgagattgcrctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccctcctgggagacatctccactcaccagtccctgcagacagctgcctgccttcattccaggagtccccttccttctattctggcaccaagagagtgatcattaaagtgtttctgtgtctcaagtaagcagactagcttccatgcagtgtcagcacaagacccaatcctggagctgtcccgtggcctggttgagctgttgatggcgtgggtacagactcaccagctgcccttgccctgccctgcctaacacaactcatcgagaccttgctgggttgcctggtgctggaaacacggtggccctggccatccagccagcgctgtccttcccaaaacatccattggccagtgcgtttgttctgtcacccctcagtgtcctaatgcccttcattgtacgtgatcttaaaaagacccttgccgaaatgttttctccgagtctggaccacggcctagattcaatatttggcatctgcaaatgtacatttacaaagtgattcatcaactagaaactgtcctcttttgaggtacaggaagataaggcaaaggtttactcaaatcacccagccagtgggtggcaggatcaaactgcctcgctcctcacagcttcagaggcctcgacagttcccagcctcactgcagacccacgcccacttctcatcaagctcccgaaatgtcggagctgccttcactgcgcacggcaggggagcccagcacagcaggaaagccccgatttctttgatcaattccgtcagtgctctgaagccacattatgcagcattttgttagcatactaaacaccttcagggtgtcaagccttgtctttgcagtgcgttccttagagaagtggaagtttcctgcccttgaggtttcctcttactcctcctgctcacttacggagggtggcggggggaacaaaaatagaaaaccaaattccatattctctttccttcccccaccccccccaaaaaacacagacaccccactacctcttcatttgtctccccagacaactctgtacttggaacctgcattacttgtgcttgctcctgggaaattcgctgcaatgtgcacagaggggctgtagcctgtcttcattcctcttcatcatcttaccaggctatttgtcatgtgagcaagctggaaagtgagtttggattcattacccatcccaggcattcccacaggcaccctccatgtgcgctgaatgcttctgactttgcaaatgatattgcccttgaagatgcaggaggcgtggagcaggtttccaacctcagccattacacagcacaggcacattacatggcacaggcttgccggccagtccaggcgccataaatcagttctcaacggtggcaccattcagaaaagcatgcagggaaggcagggagaccaccaagggctccaacccctcgtcagttctgcactgacaggctgcacaaattactctctaatttttgagagcctccacctccagggaaccctgccctcattcgatcattttgacagtgcatttgcaaattttctttattcggtacattcatttgctgttccttactgctcttgggcaccaaggtgctaggaatcttcccatttaatggataagaaaaaataggcagaagcgttgaaatgacttctcaggccaaaacccagtgttgcacatcccacaggagttggcccccagaagaaccgccacaaggatctgtcagggtgaactgagcttcggctaacgggtgttatgtcccagctcatctgaaggaccacagcttttcgagactcagattctcaccatgacccaattatctcaaaatagaatttctggttctcttagatgttgctttgtagagggcacaggcccttagaaagcacacacctgtcatgcaggcgtccttcaagccctgaagcatttaccttcattgatgactgctgctccatatggagaaagaattcctttaatgggtcatatgacctgtttgcttatttgccaacacggtgtttctaaacactctgtttctaaacaacagctagttgctaatgtcttggctgccctttaacaagagttcatggaaagtccttctgtggccctctcatgtcatgcctgtctgagatgcttctcccagtcatcttgaaaaatggtgctacataaccatcctgtcgtggaaatgatgcccggcacctccctctcacgggtttggtctatggttcagacccagacctaatccttgtttgttgagatcagtcactgagacactttgggtctcagcagctgtgctgagctcgcctcctcctctctctggtagagcctgaggcaatctgtgatccaagctgcaggccacragcaaacaccrcaggcarcatccacttccagaaggctgtgttccacaaaagcgatgaggacacccatcctcaggggctataatgggaactcttttcctcctaaggccctagtgaggagtcaggaaccaaggtcatctttaagcttgtagcatcgggacacaccagttcattcaaagcagcaggcagcactagaagctcaagttcaaatcagtgacttgaaaggaaatgacacttcataagtagaggcagctttttcaaaatgcaagcaccttctcatccaagagagggtggggttctggcacctgtgggtcacacttgtggcagcaggcccagcattggcaggaacttcaggacgagcctctgaaggatgtggacattcccctccttgcctggagaagtgcttcctcctagagcccatggagatttgggattagcctctcctttctcagaactggaaacccagtactcaaggtctgggaagctggggaaaggggctcaagattgctgttagctagagcggggttccaaacccccaggccacagattggtacaggtccctggcttgttgggaaccagcctgcacagcaggaggtgagcagtgggggagcatgaccacctgagggctgttggctgtctgatcagtggtggcactggattctcataggaacctcatgctattgtgaactgtgygtgcgagggatctagcctgtgcgctccttatgagaatctaatgcctgatgatctgaggtggagcagtctcatccccaaaccattccctactcccattgggtccatggagaaattgtcttccacgaaacctgtccctggtgccaaaaaggtaaaagggtttgggactgcggagccayggcattgaattcccatctcacacaggagaggaaaggctcttcctcaggacttggatgtatattacttagacgtaccatgaaattaagtagatatttgccaggaaaaatgcaaaggagtatcagttctccagatttgtttaagatagcatgaaacggagaggttcatgtaagaatctgtgtgtgtgtgtgtgtgtgtgtgtgtgtgtgtgtgtgtgtgtgtgkgwgagagagacatatgcatatttaacctcctttaaatgtacattaatgctgtattttctccccctgatttacagggagaatatcaatttagaactatttgcacaaactcyakataccagtttagagcgttccctatttagaaataaaataaccaaagtctcaggttgccaggcaactgcagcaatgataattcttagtattgctgctttagaaatactcatttttatacattttagtgatggttaggatgcagagaatgtgagttcagaatgtcgctgggacatcgaagtcccttttctatgagatttttagcattctcacttgcttttatttttcccccttagctctgtttgcttccttggctagcggtatcttcatatttagctatagaaatctcgagagattgttattattttcttaagagttgaggcagaagctgccactacattaattctgccaggctcattatagaaccacgccagtcactcagggagaaatgacaccgtctggggatcggccggggtcacaaacactgggttcaagctttggttgttctgccgctagtttgacacatgaactctacacctcgtccttttcattcttmagaggaccacattctggcccctctcagagcttcactgaattgggaamagaatatcaggccccagctctgtcatcatctcttggcagcaaagccacggctcatgtttttgtctgtccactgcagcagcygytgtggcgtaatggcacatratggtctcggggctgggtagaaattggaaggcgtcttcctttcccttttggcctttcaagtgtatcttcctttatgtctaatgtctggggttactattaaagtctttctgaattctgaaccaatgatcagatagatacaagagaatgattgggaatgaaaagcctgctaatcctagcagagtaggaaagggtagacagccccttccccaaccccacggcctcagtggaggagagaatggtgtggcctgcaggggagggacaggcagacagcgccagctgtcacccaggctcacgttcaccagcctcagcagtcagaccttcttccttcctcccttggaggaagtgaatagaagggcagaaccgagagcgggaactctatcttgatcttgctaaaggggtagaagttcctaattcgtggacttgctggaccacagggaggaggagaaaatgatttctagtacttatttcctggcatttcagctacatggaaggtagttagcayggtgcataaatgagcccccggtgagagtatttcccatcgtgagcaccacagccgggcrttgttctcactgtgcctcacaagctctgctaaatgccttayggatatttcattctgacaacctgtgacataggtactgtaatcatactagtatcacagatggggaaactgagacacagaaaggttgagtatcttgtccaagttcacacagctaataggcaacagggcctcactgcctcccagtttatcaccccccaccgagtacagtttctggaatattgtgctcrgtcaacatttgttgcaataacaagtggggtacaacagaggatcaaacataccagcaaagcttgcatatgtgtagttgattataagtaaaagcacagtctgggcacagtggttcacacctataatctcagcactttggaaggcctaggcaggaggatcacttgagcccaggagtttgagaccagtctgaacaacataaggagacctcgtctccacaaaaaaaattaaaacactagctgggcatggtggctcatacctgtagtccaagctacttgggaggctgaggtggaaggatcgcttgaacccaggaggttgaggctgcagtaagctatgatcgtatcactgcactccagcctggacaacagagcaagaccctgcctctaagtgagtgaatgaatgaaggcacagacccgaggggcagggctgatggtagccaattcatacattcaggtcggtctcctggtctcacctgtttctgtgattgctaagccaggctgatggctagatacccatggyaatgaagaatgtaaaatacgaaaggtaaaaaagggaaataaatcttcctttcaggacccaagctacttatcagggctaaacaaaaaataccaagtaagaatgtaatgatgaggkgtggggagggggcaaaaaataaaattaaaaagaatgtaacaagcaacgagacgctcctgactttgaacctgtgtgcagggctccgggtagattagaaggcatcctaacctcagtaaatggctgtcagtggggcctgacagtctgggtcccgtgttctgggcaccaccaatggagggtatcctctcagaaagcttcaccctatttcatgagcctttaataaaatatagctataatctttctcgtgaaagagcctgacagttcatggagccacttcccacgccgcactgatgggagaaactgcaggactccaccaggctttctctggctccaggacccccacgaaggcctcctgatttatctggrgcagctcctgcataagaagggtgaccgtttcccacagtggagaaccagacactgggcacagcccacttgataagacagcttccatctcccgcccctcctgggtatgcaaaggcattcctgagtgaataggttcaggtcagagcaggagaggttatcacccaggctgtgccttgaagctttgctgagtacaagaaaggtaaggaagagataagcaagaggtgagaatgacggcagggctggcaagtgagatcacgagcttttcctcaaacatctggctaagaatagaagctttgggaaattccacaactggcagattaaggtgatcagcctctcagctggaatttgtgaagtttcttcagactgagctcccagagaagtatgtgtggtggaatcgctgtgctttctaaagagatggattgcaacctgcgccgttgagctagtgctgagctgaggcccggtgagatggattctagcacccctgccacggctaacctcacacactcagacgctctccctgagcttttcatttctccatcagcaaaatctcaatcattcttactcctcgtccacctcagaaacatattgtaggttccatggagacgatgtctgtggtagacaaagagacgtgcttcaaaggcagaaaggtcactgttttatcatctttcagaatcgtgtaacccacgtggttctgccaccatcctgtcttctgtgcattccttgactttgaaagtacgcatcytttcttttgaccaagtagataattaccgtctatygaaatgaaccctcatgcatttattcaatgagagtttgtgtgcctaacacacagcatggctgcctgatacaratacttggtttaagagaattctacaggctctgcacgaaagtgaagtcatgatgtaaggaggcaaaggactctgccctcaaacagtccaatgggcctgagaatgagcctggggtgggggttcgatgctgctgcacccccagttgtatctgtgtatcccagtgactggggcgtgatttgaatatttaaagatactcctttttcatacggcctttaaatgcaagccgagtacttctgctgcacagccggagaggtggtatgtttttaatgctggagtaaaacttgtctgtgttggacttagtgagagaatggttttcgttcagagattgtcaaggccaactttgatataaatttcactttacattttacaccacacgtgactcataacatttaactctgtcatccatagarctcggtgctgttctgatcagcaaggtagattctggcccaaaagaactggtggaggaatttaaggaactggttctaagcctaattgaggtcaccaaacatacagagaaaataatctgagaaatgtatagcagaaatctaagttttccatttattcatttactcaaaaataccctacaataaataccaggaatataacatgatctgcattcttgggcaacttacagtgtagcaggaatacagacactgagcaccgagtaactgataatatacgcacatcagcgctgaatcggcactaagggaagaggggtcgggtggggctgaggaatggcacagagcggtgattctcaagctctctcctcctcgagtcccactcattctctactcacgctcatctgtgtcttccaaagtttgccacagtccgtcctctaaacgcctgagtcattcacacctgttctgtcattccctgctttgatatagagatgatccaacacaaatcatgacaaaccaccaagccaaatgcaagactctgaatccacagctgagtgtgatctttaatgacgactaaccatcatatcacaagttgtgtcataaccagaaacaaaacagccagagaaggagggctttaggttggtctggggacagtacggagagcccaagacgcccttgggcacccacagggggctgtgattattcaaggatggcttgatttaggcacaattaggcattggacaggatggagcatacaaatgtgttggggattaattcattaaaaatctgtcttgagctttaatagagcttcagtcagagtgtccaaccataaattctcacctgtttcacaactggttcaggcccaattgagcattaacagatttttttttttgttcatgcaaatgaggttttgtgtgtaattcattcattcatttcatttatttcatgtctaattgaacaatttttgaatagttacatttgtggagtagttaagttgtatcaaattgtctaatgtacctagtaattttgtaactaaaacagagctgaatttcattttgatataacaaaaggagaaccacagaagtagaggtggtttgaggaatagtcggcttttaagagactttatgatactctgttctttagggcaatgaccacagttgctgtttctttttatcctcacttttctttcttttcactccctaccgatgagatcaatgaaaatttgggggcatttctagatttggcagcctcccatttataagcatacatttttttagttttgtgccctgacatgcccatttttctgagggtcaaatgtgtctgtctttaaaacaccgcgctggtgtctttcaaaccgcttatcaagggttgtttctcccacgagaccttgtcacccctgagcctgaagtcgcgcgctgagaactaattgcagtagctgcatacacacggtgaacaaagttcactgctcccttcattaagggcacctgccatgtccactgtttccttccgagaactcttttggtgaagacgggatttttgttttctttacattccacatagctgccagaaggcccctttaaaatgcaaatctgatgtctctcagtctttaaaaccttcagtggcttcctgttggctacaggatagttgaaacccttttgtggcctatggagctcttccgaatttgggccacacctacctttctgaccatagaaactacatagagatgactgaacaccccaccccacccccacagtcacatgctttgccgatgccgattcttctgcttccagcggctgttcattcactcactcattcattcattcaatcaatagttaccaagaacataccctactccagtactgtactggagctcctcctccatttgtgagattcttcttatgtctttgacatgttttgattgtaagatgtgttgcatatgcagatgtagaaacacacctrctcagtctatagaatgacaaaaaatctgtgtgcccaccacccaggttaggaaatagaacattccactagctcaggtgcccttgtgtgatcgtctgccttccgtcaccctcctgcctgttccagcggtgaccacagtgctgaattttctggttttgatccccttgcttgtcttataggttttaccacctaagtatgtgtccccccaaaacatactgtttagttttgtctgctgttgaacgttacrtaaatgaaatcatactctattctatgcccttccgtaccttcttttgatcagtatttcatttttgagatccatcttgatgcgcacagctacaggttcttaatcttcattgctgtacgatttttccattgtagatggatattgcaaaatattcttctgtgggtggatttctaacaagtttttaaaaactgattgttgaagttaatcgaacctatttctgctctaatgagatgctcacttggttcctccattaatcatttaatatggtcaattacattgtgagttttcttttctttttgagacagggtgtcactccgtcacccagactggaacgcagtgacaccaacaaggctcgctgcactcccaggctcaagtgatcctcccacctcagcctcccatgtagctgggactacaggtgtgcaccaccatgcctggctaatagtttatattttttggagagacggggttttaccatgttgcccaggctggctttgaaatcctgagctcaagcaatcctcctgccttggcctcccaaagtgctgggattacaggtgggagccactgtacccggccaatcagttttccattaataatactaaaaattcttggattccttcctacttattctttgaggcttatctcaaatatcatctcccctctcaagccttctctgatctcctttcccccctcctaattctttgctccaggaaagttgtttccatcttccaactcaatggcattaaaatggtattttaatgtaggcacttatattttaaatatttgtttacatatacctctcctatcatatgagctcatctagataatgatagagggcacatgcagtggctcacacttgtaatcccagcacttcaggaagccaaggcaggaggatcacttgggcccaagttcaagaccagcctgggcaacatagtgagactccatctgtacaaaaaaaaaatttaaaagtatagtagccatgcatagtggcgtgtgcctgtagtcccagctactcggcaggctgaggtgggaggattgcgtgagcctgggaggttgaggctgcagtcagctatgatcatgccactacaccccagcctgggcaacagagcaagaccctgtctcaaaaaaataataatgatggaatcttgttcttcagcttccttacgattttgcactaatctgaatgaaaccagcctgatctaaaccttgcatctttagtgacagatatgagtctgacacccaccttcaactttgtggtagcctgcccagcttcccagaggacacctttgtgcccgcaggcttcctgtggccatcggatccccaatctaaactaggataaagtatatgttttgtggtattgtcacctgtttaggatgagaagaggcactgaagctataaccctattttctgagccagataaaatagcaaacatatatttgctctaccgggttattttgacaaatttatcaagcatcttcaaartatacagtactagtctaagcattagggctaatgcagagagcttttgcaccagtaggacagaggaaaaaatgtgcacaaattagagtacaaggcataaagcagttaaaagtcacattatcaagtacattcaaggaaagaggtaagcagttccagcaagtaggccgggcgcggtggctcacrcctgtaatcccagcactttgagagcccaaggagggcggatcatttgaggtgaggagtttaagaccagactgaccaacatggcaaaacccaatatctactaaaaatmcaagaaaaaaaaaaaaaagccaggcgtggtggaacatgcctgtaatctcagctactcaggagcctgaggcaggcgaatcgcttgaaccccgggaggtggaggttgcagtgagccgagatcacgccattgcactccagcctgggcaacagggcgagactccatctcagaaaaaaaaagttccagcaagtcagctgtgaatattttttctatggcaataataataaacacaagatgcaggtatagattcctatttatgactacaactctccacatgtctagaatttggtggaagcaaataggtcttagaatttaccccaaagcttgaattactgaaactgcctgttagtaatagtcatttatcacatggatttggcgctggtgtcctgaggatctaagtacaggggagttctgggcatgcattagtgctctaaggagaggccttcgctggttaatgtccccaggtttgggttggtagcctaccatttggtatcatactgagctccctaattttgagctacatctagaagaccacgtgcctggtgccaagaaggacacttagactatgtgtggatggagcttcatcagctgttctaatgaacgttttgcaaaagaccattgtgagtgagatgggagtttctctgttttcaagcccagggccctgcctgctggtgtgtccctcttctgagtcattcagccttgacccactctagggaaccggaggaatccacagcccagagctctcccatggtggcctgtttgacagtcacattctgaaaaagcaaacctcttggcttgatttcttgctggaataatgaaacccagctcggcccctgcttgataattgcctttgggaaaaaggtaatagccaccttgaaacaccattcagttggacctttccaaaagccacgggtttttctycaccaaagtccttcatttgagcctataatctgtgaatggaaagaagcgatgatgcctctaaaagccttttggttggagtcagagtcaccctttgagcactgagttctctttccagggacctctcccatgtggtcttggagccatgggtgttgtacaaaagcaacaggcctagcagagctannnnnnnnnnnnnnnnnnnnnnnnnnnnnnnnnnnnnnnnnnnnnnnnnnnagcatttgcagtgtgagcccaggctctttacaggacgaagattctcttaccagcatgtgaacatttgcagtgtgagcccaggctctctacaggacgaagattctctcaccagagtgtgagcatttgctagtgtgagcccaggctctctacaggacgaagattctcttaccagcatgtgagcatttgcagtgtgagcccaggctctccacaggacaaagattctcttttcaccctcacgtcaacctcacgtcaagatgggagataaagaatagcaaaatagggctgggtgtaagctctggatagcttcttcgggtatccagggatagatgctgtgattactcctattttatagatgaagaaacagatgaaaggagcccacgtcccatgcacgatactggcaagctaggattcaaacacagtggggctccagcaccttccctttcagtccccacattagcctctgkmtgaggtgtggggaaaagcwcacagatcagactggggggacctgagttccagccccagctcctcgcgggctgcctgtgtgacctgagagccccgaggctccatctgtgaaatgcagagggggtggcagacagctcgtcacgaggagtgaatgagatcctgcagatgaaggtatttggtatactgaagagctctgagaatgatgaaaatgatgtgcaagtctcttccaggactttttgtgtgcctttcrtagtgtaatacagaccccggcacatgggtgttcacacttaggrtatgaccagcctcacagctaagttgcttagcatatggtaccagcgaacccaagtttgtaaaccagaacttsccattgctttcttgattgtcaagtttgaccctggccagcatcctctgatacactgaaaatacactctgtgtgtccagaagcagctgagcttttgtctcaggccaacctcacattcaacccactatcctccgtcttgttcctccacgaggaaagggacgtgaatgcctataggccatcagagatgcaggtgaaacaaacctcagtgcatcattgcacggggccagatgggggggccggtgtttccctgcggaatccggaggacagctgtgccagccacgtgtccaggcccaggatccacaataggaaaggggttgctgatgcatttcaaactatctctaaagttgtgagtgtatatggcaaaatcccatcctaccaagccttcttgctatatacatttgagtagaaaatgacatgagccagaagctccaaagcctgagatccagagcataaactcctgctgtcatgttgaggctggggcagtccagtcgcaagcagtgctccaaaggaatgcagtaggctgttctcatcttgccgtaaagaaatacccgaggctgggtaatttctaaggagaaaggtttatttttggctcacagttccacaggctgtacgggaagcatggtgccggcatctgcttctggtgaggcctcaggaagcttataatcaagatggaaggtgaagggggagcaggtgtgttacatggcaacagagggtgcaagagagagagaagggggaggtcccagactctttgaaatagctggatctcatgtgaactaatagagcgagaactcactcatcaacaggggatggctctaagccattcaggarggatcttcccccaggatccagccacctcccgccaggccccccctccaacactgggaatcacatttcaacctgagctttggagggtatgaacatccaaaccatattgggctctatcgtttttgagattttactcactgggcgacaacgtagagcacccaccgctgggctgatatgatttgttcccgtttcctgggcaaccaggtgcgcagggccacgagatgagcctcttgtgacaactaagccaccttgatgatggctttaactcggggcctggaagtcagactcccatgctttgaggatattttttgtggtggtgtcatttgttatgagggttattcttttttctcttggtacttcccagcctcattacttctctgtgccaaactgtgccaggaaatcactgactttatcatcatgatcatcatcatcatcaccatcactcaaactttggtagtgcagtgcagtgcctgctagcgccaagctctagactcggttctttatatatactcagtcatcgcatgttcatggcagtctcatgggaccagcactacaaatgtgtctaaggaggtttcctcgaaatctcctttgtcacagyrgcctggagcatgcagaagcaggtaacagaaataccagcagccactcctgactcatcactgatagtggaactggtaagggacaaacttgtaaatgagcaaagttagatttctgggcctcctcaccacctccccacttagtgctgtgtccccaccccacaggtacccggtacctttgtgctctccaagaatgccccatrctgccactttccacccccatcctcctgcctgtaccttgttgcaaatccccaacgccctgggcctcagttgactctgtacctaccccaaaaggcatctttcctgcaggtgctccttcccacgaagccctgtggtaaggtcatgtgctgtcttcggtcaaatcaaaactccagtatctgataagagtctaaagatatatgagagttcccactattcccaaccttgtcaatatttgtattgtttgatttttaaagtttttggccattaggtgaatatttaatggtatgtcattgtaattttaatttgcaattttcctgatgactgctaaggttgagtatcttttcatgtttattattctctgtatagttcttgttcatgtcttttgcctgcttttctgtacagttgcttagctttttgttaattgattcataggaattctttgtaaactctggataccttctgcaggcaccactcattgagaccccactgaccaggaacgatctttcagtcatttaagtgactctgtgtggagttgtctctgggttctctagccctgcgctgttaccacagtcttaataacattgccctttgctaattttctttacggcatgttcatttgccatttattaatttctgttgtttgctattttttgggggggcgggtaggggagacaaaggtcttgtcacccaggctagaatgcagtgatgtggtcatagctcactgcagccttgatctcccgggctcaacagcgatcctcccacctcagcatcctgagtagctgggactacaggtgtgcaccaccatgcctggttaatttttaaaaatttttttctagagccagggtctcactgtgttgcccaggctggtcttgaattcctgagctcaagtgatcctcccatcttggcctcccaaagtgctgggattacaggcatgagccaccgcacccagccctactttgccattctttatttctcatcttaaggtggctacttagcttrgcagtttccccttcttgttctgtaagcacctacgttgctctctaagtactgctttgtctgtatcctcaagttctggtaatgacaggtattttcactatcattcactcaaaatattttccatttctcattgtaattatcattttttgagacagggtctcattctgtcactgaagctggagtgtagtggtgcgatcttggctcactgcagccttgacctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctcagccccccgagtagccgggattrtttgcgcctgccaccatgcccagctaatttttgtatttttagtagagatggggttttgcatgttgccaggctggtctcaaactcctggcctccagtgatccactccctgcctcagcctcccaaagtgctggaattacaggtgtgagccactgygcctggcccattttwattattttgtgatccgtgggttatttagaaatgtatttactaatcgccacagttaagttacttggaatttgttccttttgagccttttaagccttgcaaaggcaggtgcagcacagcctagggctgctttgatcccactgttagcgcagtaaccttctgaggacgctgaggaatgatttacatacactcacatatatatgtacacccattatatacaccatatatgttatatacaatatacacacatacccaatatgtatatacacccaatgttatatatatatatacacacccccaatatatatatacacccaatgatatatatatacacacacacccaatatatatatacacccaatgttatatatagacacacacactcaatatatatatatacacccaatgttatacatatatacacacacaccaatatatatacacccagtgttatatatacacacaccctatatgtatacacccaatgatatatatacacatacacacaatatatatacacccaatgatatatatattacacacaccatatatatatacaccctatgatatacatacacacatacccccatatatatacacccaatgatatacatacacacacacactcaatatatatatacacccaatgatgtatacatacacacaccccatatatatatactcaatgacataaataatatgcacacccaatatatatacacccaatgatatatattacacacaccctatgatatacatacacacatacccccatatatatacacccaatgatatacatacacacactcaatatatatatatacccaatgatatatacatacacacaccccatatatatatacccaatgacataatacacacacccaatatatatatacccaatgatatatataatatacacacactatatagatacacccaatgatatatctatacacacacacacccaatatatatacacccaatgatatatatactcacacacgccctatatatatttacacacctaatgatatatatacacacacaccctatatatatatacacccagtgatatatacacacacaccatatatatatacacacacacatacacccagtgatatatacatacacatacccgatatatatatatacaccccatgatacatatatacacacacacccaatatatatatgtacacccaatgatatatatacacacacccccaatatatatacacacccaatgatatatatatacacacacaccctatatatatatatacacccaatgatacatatatatacaatatatatataaacccaatgatacatatacacacacacccaatatgcatatacacccaatgatatatacacacacacacacacacacccaatatatatataacccagtgatatacacacacacacgcatgccctgggtataaacagatctcctcactctgtctgcttgaacacagacttccaatcccttcttggcttcaaggattattccaactctcctttctgtggccttgcttgtttttttgtacacatgtggattagagctcaaccagagggctccagagagctcttgcttgctctcaggtcatctctgtcttttttttttttctctcttattctctttcccctcttctatctctccaattctttctttgcatctctctccattcttcccttctgctattktgtcctacaaattttagctgccctgatctccccaaagtctggacttttccttgttcagaaggatgtggctgcctggctctgcttgggtcccctgtcgtgtttgggggcctggaacctctctcctggcagtaagctggggcacttacaaggctcagctcatcttttttcccttctctcagacatgactttcctctgctgcttgttacccagtatcagaaacccatttttttttcttatagtttgtttggttttctagttgcttaaggttggagggtaaatccagtttctatttttcaaagatggccagaagcagaaatttcgtcatttgtgattttttttttgtttatttctttaaacagtttaattgtctctaacatgttaatcaactttttgttgtttatttgtgatctaggtttgaacatctcattcttgcatctgtggtttctgctggctctttctcatggtgccgtgtttctttgtttatttgtgtctgggggctactcattttcactggcattttatttgtgagaattctgcaagctctgggataaagatagtttactccagacagcatttgtgtttacttctaccaggtgccagttgaggatagtctaaaytacattctcagcttgaaatatttttgaccacccagatatggagaactaagcgtgcaaacctgcatgtaattcagaccagggttcgcaattctcaggacagtttcwttcccctctgctcagtgcttatttcaagacagtcatgtcttgaatacctacaagggacaattattgggggttgattttcctgtgaaaattcacatgtggagcaggcctccagctttgactgctgccacataaaactcagcagggtgttacctggctgggcagatgtctttggggtgaaagaaagcttgcctgttctgcttatttatcttgagttcccaacttcacttgcttttttttggcctgaggattctttacctttttgcaggttcaacaatgcatttactaagacttaaaaataatatccacggccgggcatggtggctcacgcctgtaatcccagcattttaggaggccgaggcaggcagatcacctgaggtcgggagttcgagaccagcctgaccaacatggagaaaccctgtctcgagtaaaaatacaaaattagcygggcatggtggcgggcrcctgtaatcccagcagctgaggcaggagaatcgcttgaacccgggaggtggaggttgcagtgagccgagatcacgccattgcactccagccttggcaacaagagtgaaactccatctcaaaaaaaaaaaaaaatccacaacatttaactgtacttggtaagaaggttttcctaggaacccagcctatcatattgctcctttgcttttatttttttcctgttacacacctctccttcttttaaataagtaaggagatcatataacttattatcgaagccacttttgagagtgaaaagggacacttaattattattatttcatgtttcgaaatattttctgacacagccgtctatattggtgaacctataaaacagttctattcaaaaattactttcaaacatgaaatgctttcttaataaaagaaaatacatcaaagtagaaaaaggttaaaactgctttatattgtttatctggacattaaaaaataagcagaataatcacttaatatacttttgtgtattttaatcattgtcttcactatcttctaataccacttcagtagtatttttcttaacactattttttctattgttaatgtcagggcgtttttctccttcacataatccaactgccttacctatatatttacatatatgtttatgtgcattaacacatcaaaccatctgtttttgataactgtggcttctgtttctcttgatagaatatcacagtttgkttaaaaataagtgtgaatttattcatacaaccaccaattacaagtttatttcagtgaaatacatttctcaattcagtgagaatattgtgtgttaaagtttcaaaggatcttcccacaagtcaatttccagagcatacttgtagaatttcacattttaatcttctatacagtttgagctcttgtcatctatatttcagggtcccctgtttgcaaattttgtttttaatcattgcaattcattacaggcttcagaggctgagctttttgtgtttcattggttgaacacttgattatggattacaacttattttgaaccacaagccatcaaaatttagatgacttgtttccaaaactggagtactttttttgtagagcatttggattgactcatgaagtatgttttaaagttaaaagctgcctaatgtcagcaatttcctatcatttcattatttcaagtgtcaaatatttctcaaatccaacttgacaggcagcaaagagagaaccgcacactctactgatgaaatgtttttaatccaatttaaacttcataaaaaatttttgtagttcagttactctcagtttatgtaaattttacacatttcaaaaactatagcttgtgcttctctgggtagaattagaactgtgtttgagctcagttatgaattacataggtacatcaattacaggtacatttcagcataataagtttctcagcttggaacattatatcttttttttattttttatttttttgagactgagtctttctccatcacccaggactgcaacctccgcttcccgagttcaagtgatcctcctgcctcagcctcccaagtagctgggactacaggcacgcaccaccatgcccagctaatttttgtatttttggtagagctggggtttcaccatgttgcccaggctggtctcaaactcctgacctccagtgatccacccgcggtcagcctcccaaagtcctggcattasaggcatgagccactgctcctggctggaacattatgtccttttttttttttttttttttttgagacggagtctctctctgtcgcccaggctggagtgcagtggtgcaatctcagctcactgcacctctgcctcctgggtttaagcaattctcctccctcagcctcccaagtggctgggattacaggcaggtgccaccacacttggctaattttttttgtttttagtatagatggggtttcaccatattggccaggctggtcttgaactcctgacattatgtcttaaagtgctaactctgttcactgcacataacctcatatgttcctagatgagaccactgaaatagaaagtgaaagtctatccaattcttccatctcattttaataagtcttagtaataactacttgtattttgaataaagaaatgaaaaatccaggacaaaataaaccagacaggatgcagggtgataggcatacactgagacttctaggcaagtgagcaactggtcagccraattaaagcccttggaggggttcctgtaccctaggttcttaatacatgcttgttgaatgaacaatcggaggtagcttatttgtttgaataaggctttctgtgtgttactgcaaaggaatgaggatgggacaggtttaggctttgtaacaagacctcccaaaggctaacacataggcggctgcttcctcggcaagcagagatgacgcttgtggccctttttgaaacaccttttttacatgccagaggtatttaacttgwccgtaccaaatggtacggwcaagttaaaagggttatccgcccttttaactcaaatatcccgttgggatcaaacatttttgctctggagacctttgtacctgtgcagcatcagtataaggatagcctgggggtggtaacccagacacagctaacagcggggtctgagtggcttggccagagtcttggcctcaaattgagggcacagcagtggttctgactgttcctcttcggggaacgttgtacatcaggaggggcctgatggtaatgttggtgtaaaatgtctctgctgtgatccacccttgaagactgtgagctgtgcagaacgaagcaggtcatggcttgtcctctaggatgtgatgggaggctgaaagcatctctctgctgtgacgtaggagggaccgtgagccttatgctaggcactccttccagcccaaggcagcatcgtctrctttggttttctttctttctttttttgaaacactctgcccaggctggagtgcagtggcacgatctcggctcactgcagccttaasctcctgggctcaagctatcctcctgactcagcctcccaagtagctgggacaacaggcgtgtgccaccatgcccggctacttttttaaatatttttaatagagatggggtttcgccatgtgtcccaggctggtctcaaactcctggattcagacaatctgcctgcctcggcctcccaaagtgctgggattacaggcgtgagccaccgtgcctggcctgctttggttttattctgactgtggctcctaggaagaaaaagaaaagatgatgctttggaagctgtagggttgggaagctggagacttcttgtgatggagaggtacacccagtagatacttatttaaatacttatagaaagacgactttatgccggacactgtgttaggtcctggctatacaggaagaagagaagtggcatctgcccatcctacgcagttctccaggaaggaggtggcaggagtgacatttgggccatccaggcaactcaccaagtcccttcgcagcactcctgaaaagctctgagatgttttgaagctaaaacagacaaacaaaagggaccaaagaggtggcatgagtagcatgagtcagatgtgattaattcctaattccttagctgcttctgtttgtttgttttgttttgtgtttttgagatggagtctcactctgtcacccaggctggagtgcagtgcagtggcgcaatctcagctcactgcaacttccacctcccaggttcaagcgattctcctgcctcagcctcccaggtaactgggattacaggcacacgccaccacgcttggctaatttttgtatttttagtagagacggggtttcaccatgttggtcaggctggtcttaaactcctgacctcaagtgatcagcctgcctcggcctcccaaagtgctgggtttacagatgtgagccaccaagcccggccccctatttccttatcttcttatccgcagcaggactttgagaaacggctcagttagggtcttgcagggataacagtgattagagcctgaacacaaactacatttatcccatgtcagaaatgaatagcttatcaaacgtaccaacttaaaagatgcaagaattgtgcaacaatagctaccttcttttcaaacaaaataaacatcactaaaaaactctaatcttaattctttttcaagaaatggataattcctccacatcattctcctttaaaattttgtagattctcccttaagttacttaatgtatgagttgtggcttctgtgtaacgtcttttctcaggcttgtattggtaatggaaagcattcttcagcttaatttccttttaattccttccaattactatgcactgttctttgtgccaagtgccagtccagttatccagttggtgcattttgtgagaactgtaggatcatggagatcatgtttcttttcttttcttttcttttctttttttgagacagcgtcttgctctgtcaccaggctggagtgcagtggcacaatcttggcttaccgcaacctctgcttcctgggttcaagtgattcttctgcctcagcctcccaagtagctgggattacaggcacgcaccaccatgcctggctaattttttgtagttttagtagagatggggtttcgccatgttggccaggctggtcgcgaactcccgacctcaggtgatccgcctgcctcagatcacccaaagtgctgggattacaggcatgagccactgtgcctggccaggatcatgtttctttaaaccacacatgatacccagaaggcatcataatagagttggcttcatcatcttccttatcmtaggttatgcttgatttcaaaagaaatttgttcctcgacaatacacagaaaatgcacttaacaatagcccctgaagttttccccagccaatgactggttagcagtctaataaggatcatattggacaagtatctttaacacaaaacagcacagggaatcatgggccactctcatcgttaggctctcttcacaggtatagcctatgttagaaggcttctgaaccacagatgctaaagaaaaattagttaaactgaagactgatgaagtattccctacaaatgaaaaggcaatcttatatgacaaaggacactatcaggaggttgaaaaacaacctatagaatgggagaaaatatttgtaaatcatatgtctatgattaatatccagaatatataaagaactcctgtaagtcaacaaccatcaccacacccagttcacaaatgggcagaggaatcttatggacatttctccagcggagatatatgcacagccaaggagcacgtgaaaagatactcagcatcattagttgctagagaaatgcaaagcaaaccccaagaaggtaccacttcctagccagcaggatgtagctattaaaacaacaacagaaaatcagtgttggcaagggtgtggaggaattgcagtccgtgtgcgttgctggtgggaatgtaaaatggcatagtcattgtggaaaggagtgtggcagttcctccaagagtcgcatatagaattgtcacatggtccagcaattccattcctaggttacccaaaagaatggaaagcaggggagctggaggccattatgctaagtgaagtaactcaggaagggaaagccacattcctatgttctcaggtataagtgggagctaagctgagggtccacaaaggcagagtggaggaatggacattggagactccgaaggggaaaggagatggaggattaaaacgctacattttgggtacaacatatactacttcggtgacaggtgcaccacaatctcagacctcaccactatacagttcatccacgtaaccaaaaaccacttggacccctaaagctattaaataaaataaataaatataaacattcagtaacattatctttagaagaacactttttaataaacctgggcatgaagaaaaaaggctgaataatattccatcgtatgcgtgtgtatatccatatatatatatatatatatatatatatatatatatgcacacacacacacaatgtatatgtctagtgttaccaacttagtttcctttccttcaatattaaacgtctcatatttcccccagactttttgagagatagttgagaaataaagctgtgtaagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgwataccaatgctcatagtagcattaagcataatagccaagaggtaggaacaacccaattgttcatccacaaatgaggagagaaaatgtggtatgtaaatataatggaatatacgtttcatggaaaagaatgtatctttcaatttttaatttttgtgggtacatagtaggtgaatatatctatgggatccatgagatgttgggatacagacatgcaatgtgaaataagcacgtcatggagaatggggtatccatcccctcaagcatttatcctttgagttacaaacaattcaattacactcttttaggtacttaaaaacgtacaattaagttgttatagtcaccctgttgtactttcaaatactagatcttattctttcaaaaattggttgaacctattaaccatccccacatcccccatactctcccaatacctttcccagcctctggtaaccatccttctactctctatgcccatgagttcaattgctttgatttttaggtctcacaaacaagtgagaacatgtgatgtttgtctttctgttcctggcttatttcacaaaatgatctccatttccatccatgatgttgcaaacaacaggatctcattcttttccatggctgaatagtactccattgtgtatatataccacattttctttatccattcacctgttgatggacatttaggttgcttccaaatctaatggaatatattattcactcataaaaagtgtgaaattctgatacatgctgttaatataacacggatgtaccttgcaagcatgttgagtaacataagccacaccccaaaggacaaatattgtatgattccacttatacaaggtacctggcacaggcaaattcatagagacacaaagtagaatggtggttaccgggggccgggggagtagggagtggggagttgttacttaatgggtagagtttgtttgtttgggaaggttctggagataaaggatgtgatggttgcacaacaatgtgaacgggcgcaatgccactaaactgtgcgcttagttgcaaggttacaataggacattttatgtatatttcaccacaataaaaataggaaaaggcaggtgatttctaaggacacaagtcccttggggttgctagttctgtcagacttttccccttgtttttctgaatgacaaggattagtagtggatrataatgagtggattcatggatttgagcaggacatgaaasaatttccatagacagagatgaaagggcatttctgacttgaaacctgggatgagcaccgatgcaggagaggcacgaaagctcacagcgtgttcagggcgtagtgaatagaggggtgcgtgccccgagcctgcagagcgggcagggatgtgtaggaaggcaccttcatcctcctcactcagcctcccagctccaggtccaaagccgccaaatcatctttcttgtcaccatcacatgataagggggagtccttccagactgccagtcaatgaagtaacacacacagccacggtcatgccagtctgagcccatcgggcgagccctgaggggaataacagtcttggtggcattgggcaagccccgaggactccatctcggggaataacagtcttggtggcatcggcgcttcaccaggcctcctggaaccatattcgggatccccaactgagtgctggaaagaccactggtcaggagcagggagcaggggtggaaggaggtggctcgtcctgaccttgacaatgagaatcctgttttaagcttcacgctgctgactaaacagaaaggccacggcacagggacagacgtgcgcatgaaatcacaggaagaaagacatttcacgaacaaatgcatcctcccaaaccagtctgaatccctccggacagggtgatgttaccacgcaactggcctggcctaatgagctggtttctgtcatccctcctggaaggttaccctgtaacacaaggcgtgcccactgacatgcagcctgatggagcaaggttacacctgtctgccttttgtgtgcacaagatcagaacacagtcaagtgaatacaaatgcaacagctgcttggggctcaaacttgcatagtctattttatttggatagagagcataaaattggctctaccaaagtctggaggctggaagtaatcataattgtaatctagtataattaccaagcctagacctttacctagtcctatttaacctccctttcacctttccaaggaatgtggagggataagagagtcactgaataagttggttggtaatactgtattgtatctctcaaatccattgtttttttttaaagaatgagatcaataaatataaattccaatattttcttccccaaagcaccatcttgtaccgctttggagaacattagagggactcacctgggtttccagagctggaaaacataagccccataatgtacccagtccccacggcgcgctgccatcttaggcccagtccccactgcacgctgtcatcttaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttgggcccagtccccgaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttagggttttgcttagggggcagatagaaaatagtaaatgaaaccctttcagatatttcctggccttatttagtaaacacgtctttttgaaagaactctgaatacacctgcagatttttcaaagcccagattctacacacttctaatgtcaaccttgaagggagatcgtagattgaattacagaaaggggtgctgtcaaaatgccacatcaaatataaacttcacatatgtttcttacctgaaacactcactcacactcatggaaaagcacaggaatgttctaaaaatgcaagtttatcacgaaggagacacaggaggttcagagacgatgaagcggcaagccgggaggaaagatctgagagaagccaccaggctggggcaggatttcattatatccagaattccacttgggctctgcagtttctttcttcctgagaattatttaaaagtccctggggaaggacaagagtaagaaaaaatcaagggagagcctctgggttactatgacaacatgactcttgaccccttctctctcacccagcagtgcctaagtcccttttgcattgctgcagagatctctggcactgtgattagcacatactcctaaacctgaggatgatttaaagtggaaggagatcaaagtttctaaatagtacaatgagctcatcttgactcaaaagatgtgtaatggttataatgcaacataactgagatgtttccttatcccccccaccagtaaagctggtcacagaccgttgcaaaggctctgtgaaaaatgacaggtctatggaaatgtctactgcaaagcactgataactcaggataatgattcaggccaaaaaaaaatttaaaaggaagtgaaacttcagacaatgtgaaacatgtcagagtcgtgtttgcattctaaattgcagtaatgatataaacatcattattcctaatctgatcctgcaggtggatcaaatacgcacacatctattaaagaacagtctgcatgctcagtaagtgcacagggtcttattaccgaatctttcagcacatcttcatttcatctttaacttcattagaatatgtaagttttggcagtctattgattcaggagaaatctatggatctattattttctatttgtctataaagtccactaattcaccttctaagttgttgttttgggttttcatcaaagtgatgacattccaactcctgattatgctacattgaataaaaataaatgtaggattttctcctttctgacctagagctaataagttgtacatattggctgagttactgcaaagaaagggcaaaatgaaaacacagctcttatagtcaaggttcttaggatcttattgagatgagctcctcagaatcagccaaacttcaaacatggagagcacggcccccagtctgccaagtcggcccaagactactgacacctactgcaagcaattagggtccaactacaaagttagcagaaagagcccacccaagaccactgtcacgtgtgacaactgcatgtttggagggttcccaaaacgaccctcaggctcgtaattctctagagggactcacagaattcacggaaaatactcatggctacaatttawtatgttggaaaggagacagattaaaatcagccaaaggaagagacacatggggcagaatctaggacggtttcaaaagggacgcttccattgtcgtcaggacacattacattaccttcccggcatccgtgtgtgatggtacacgtggagcactgccaacccaggatgctcacctgagccttgtatccagagttgttactgtggtttcattacattggcatgattgattgattgatttcccatgtggtctaactcagtctccaggtggactggtactgtgtgaccccaaagcccctgccctaaatcacatggttgatccttctcttgcaaccagcttggaccatatgactatcaggtatggcccatcctaccctaagatcttatgtggccaaccctcaccataacaaaggcactcccagtgagtatgatgtagtttacctcccagaagctcatggaaaaggccacatctatctttgggaaaggtcaaattttttactacccaagcctgacctgagaagtgctaaattgtgagggtggaaaggggctagtgtgagcttggatgaacgaagtatctgaagagcaatggaaggaacatggaatgttcttaaacaacagaacatttttaggaccatagagtattggagttgaaagaatttgggagattattgcatttcttaataagagcactgccatgcagaagtggccttgtcttggtaacatgatagaagcacatgataactgtctttaaagtgtgaggggcccatgtgagcaacagggtttatttttaccccatataatcctagagaacaaagccagtggccatgggttagaagttattaaaaagaagatttaagtttaatagaagaaagagctttctaataattgaggctattcagaatattacacaggctgtactgggatatggtaagttctcccaagttaaaaatattcaagcagaaagcagatcacctgttaccatggcagtgcttttattaggaaatgcaataatctcccaaattctttcaagtctaatactctgtggccctaaaaagagttttcaatcttgacagaattgtattctggaattagtggactatttctttcataagtcattatgtgaattaccttgaaaatttctaatatcgtacctgagtgccatggccttggcatgaatatacacttcctgagcagaacttaagaatgagaatatctggagtaattcaggttctgctaattctgcatggttgtcactgcgatgatgttcattgttctaggtaagaaggataaatgagtaataaaagtttcatgggacacatataagtgaactcatgttttatatccacttcagtcattcattgcaagcgagtcttgttcaatgagatcaaagcagattggttaggattttgacttgaaaccttctgttatttataaattggagttacatcatatatttcttctaaaagattctattgagactgtttgctgtctacagctggtctttctccagaagtaggttgaattgccatgaattttatcttattcagataaatagaatgctggtatctaggatccaatagattcatgtggcccaaatttcatccagacttcatcctcctctgtgtacagtggcaactattaaaatcataacagagacttgttggctccagcccatacttgcaatgtaaaacctccacttggtgcaaactctttccatccagtattttctgatgtccctgagggctctcatgaatgctcatcacacgtctcctcctggaaacaactgctgcttcaccaagaatcgcaggccccacggggaaccatcacttctctcctgcctgtcactgggcacagccaccaacattccagagccatcatggtgccagccccaaatgaccaggatggtgtcgggaagaacgcgtctctcccacgcattatcctgcctcagaggmatctcaaatgatgctgcttgcacctcagggttctacagtgtttcataaaaagagatcgatgagcaaataaatagattaacttcatgtactcttaatagttmaagacctctgccaaccagcggtctcaggataagcaagacatgacctcataataggaggtgtgctggttggatcacaaaggctggtccttcagccagagtgggtggttctctgcagggacctcttctaagctctccttgatgagacaactaatcatcgtgtacactgccgaatgacagtgtttgcagaacctctagcatgcatgctggcctcggctatctctgccaatactttattacacaagccagagtcaccttcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaaygtaggaatgttcaggaagcagtcatggacagcgagatcatcaagtcccttaggaataagtaaactcaaataaaataaaaataaagtgattttcccttttggaggtatgtgtttcagtctggcgcaactcaacactgtcagaaataataaagacacttacttgagacctaggagaccctttggggcagaattgccctcagcagagctggtgatggtttcccttgagaacagcctttcccatgagggataaggaactgcggagatgctgctcaccttggccaggagcattgggccagggatgatggcttgggaccctggtccctggcatctcaggctggtctccaagggtcactggtgacctttcaggggacaaaagaaaaggatcttcacagatagttggctgtaaataggaaggaggcagggtcagtggtgaggaggatatttgaacagtcagcgtgtatttcaaagccgtggttctgtccccctctggtgttgcttccttctcctcttcactctgcagcygcctcttggtggtcagagggtgaatgcagggccctggggtttggggcctagggctgggagatcagagctcttggagctggcttgatacctggcaatcctcatccagcatctccatctctctacgacgcgttctggcacgttgcaggtgaagtgggtagagcgtgggatggttactggaatcgatgtagttccagggtgctgtccttaagagtgcgagtggtaccagtcagtgttctcggcatttaaatattagttgttgttatcttggctatctcatgcgtgtaagaattctgtgtgtgtagtttccatccttaaattcaaccaaggtattactgtaaaaaaaagcaagacaggcctggcacggtggctcacgcctgtaatcccagcactttgggaggccaaggagggaggatcacgaggtcaggagattgagaccatcstggccaacatggtgaaaycccgtctctactaaaaaatacaaaaaattgctgggcgtggtggtgcatgcctgtagttccagctactcaggaggctgaggcaggggaatcgcttgaacccaggaggcggaggttgccgtgagctgagatcacactactgcactccagcccgggtgacagggcaagacttcgtctcaaaaaagaaaaaaaaaaagcaagacaaaaactctctcccttttctagaaaagagcatgcctgtgcgtatggctggctgtgtgcctacagttcatgtgcctgtttccgtttttgctgctcaaagccatggattggtgtgtagtcaggacctgcattctctgcttggtggttcagtgtctgggatgatactgtttcccggttactctagagcagaggtcaacaaacttcttatgcaaaggagcaggtagcgagcatttttggctttgtgggcgacacaggctctgttacaaccactcaactcttattgtagcacaaaagtagccacagacactatgtaaacaaatagatgtggctgtgttttaataaaactttatttacaaaagcaggcagtgtgccagcttgggcctgcaggaccctggttggtcagccctgtgcctgagtgataacatgctctttcatgcctttaaaaatgattattaaagtgtgttcattatcytgttctttttgtcctttttcttgtttaataagtgttcactgattttaaaaagacatttttctaaaaatctggggtttttttgtgttttttttgtgtgtgtttttttttttttttttttttttttttttgacacaaggtcttgctctgtcacccaggctggagtgcagtggcgcaatctcggctcactgcaacctctgcctcctgggttcaggtgattctcctgcctcggcctcctgagaagctgggattataggcgcgcgccaccatgcccagataatttttgtatttttagtagagatggggtttcaccatgttggccaggctggtctcaaactcccgatctcaggtgatctgcccgcctcagcctctcaaagtgtggggattacaggcgtgagccacggtgcccagcataaatttattttcaaaggcaagtgtggtcagtgtaggcagggagtgaaacatgtatgcgtaaacacaactacttgaaagagcggtgyrgtccttcctcaggcccccgtcagctctgctccatccccagtcccttcctgtgcctgcccaacctgtcctccatagccagggccccccaacccaaacccctccaggcaccacctccctccatccctcccgcctggctctggggagggggtggccagcggccctgcacgcttcttcctcttttctcttcctctctcttcagacttgatgcaaagagtgggctaagtctgtgctgactgttgccctggaaactcttttgaacctttctctttccctccaaagattccgagttcctcctacagtttgcagccttcagtaccctgccccttccctcccctgccctcccttacttggttgtctttattccaagttaaatgatcatcatgaggttgggaaagccgcagctttctatgcaccatgttttactccccaaaggacatcttttagagtccgcagaggcccacatgaagggctcaccagcagctctaccggtttgctttccacaaggagagctaaaatgccggttgctaagcagcatacatgccgctgcttctttccacaatgtagacttaaaaaaatcgccgtaaacattttaccatatgattgagtcaggtgtggggagtcgcagtaaacattttaccatgtgattgagtcatgggtggggagtcgcggaaatacacagggcaggcagttcgctatcacgatgttctctctcawttctgtctttggtctgtcttcctgggtaatgtcacatggagacccaggggatctgccrtcagctgtgtgcagtgggttaacaagacgacggggaacttcagagygcaggcagtcctcatcttttgcagattctgtatttgcacattcacctactcactgaaatgcatttgtaaccccaaaatcaatacagcggtttcacagtcattctccgacacgggcagaggggtgaagatactgagtcgccagatgcacgcgttccccgccgaggtggagcgtgcaaagctctgccttcacgtttggctctcatatcgtgcacatgtgtcctttttgcagtctccttagcactgtgtttttcatatttttgtgctttctgatggttattttgctgtaaacggcccccaagaatggtgctgatgtcctatttagggtccctaagcacaggaaggctgtgatgtgccttatggagaaaatccatgtgttagacacacttctttcaggtaggagctacagtgctcatgggggtctagtgttaatgaatcaagaatacacacacccagaaaaaggaagaggaagcgcacagggcagccagcttgatgtcaccacgttacatccttttatccggtctttggtaagttttcttttcttttttttttttttttgagacagacaggtctcgctctgtcgcccaggctgaagygcagtggcgcgatcacggctcactgcaagctccaccccccgggttcacgccattctcctgcctcagcctcctgagtagctgggaatacaggtgcccgccaccacgcccagctaattttttgtatttttggtagagatggggtttcaccgtgttagccaggatgttctygatctcctgacctcatgatccacccacctcggcctcccaaagtgctgggattacaggcatgagccaccgcgccyggccggtctttggtatgttttcttggggacttacacagggtcacgtggagatacagggggatgcgccttcggcccatctgtatgtggggccactctggaaagtgctaaggtaacagctatagtacatgaggaagccatggaagagatgaaaagtggctgaatgtgtggattcatcagatgatgagaacatttaatgtaatagatagcattggtgtgaggctagacaccaaagaaatgtacaatcatgttacccaagggaaggaaagtattaaacccttcttggctagtgttttattttaaagaaataccaaatataattcattattttgaagaaacgtattaaataaagcatcttattaacaaggttacgtattgaccagttgaagaaacttttgtcatcagaggttcacagaaacctaaaccatacgttaggttggtgcaaaagtaattgaaatgggccagatgcagtggctcacacctgtaatcccagcactttgggaggccgaggcgggcggatcgcctgaggtcaggagtttgagactagmctggccaacatgggtgaaaccccgtctctactaaaaatacaaaaaattagctgggtgtggtggcgcgtgcctgtagtcccagctactccggaggctgaggcgggagaatcccctgaacctgggaggcggagattgcagtgagccgagatcgtgccgttgcactccagcctgggcaacagagcaagagtctgtcttaggaaaaaaagaaagaaaaaaaaagtcatcgaaatgacagaaaccgtaattacttttgcaccaaactgtatttcccctaagaacaatggcccagtatttacaaattcagtgttcacaaatattttatagaacacagctaccatgaataacaagagctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactgcgcatattgaagacagagcccaagacgcatccaggtgcaacgtctctgctaagaatgtgtgccaggaatggggcctggcttcctcgtcgagtgcggctgtccgtgggtttctgctagacagataacgttctgaaggagttaaactttcacagctcctcctcctcctcctcctcctytatatcccttacctcgccacgttcatcactggtcattttgctggaagggaagccctggtatattcttacattgctctggaagtgagccttagcccagcgtcgccaaacttacaccttaattgatcccagatgagaaggaaaagctattgctcttaccccacagtcttccctccctgaggccagaagcaggtcacgtgtaaaatggtctgctctctgctgacagtggcctgagtctcccatagtgtctgctgagctggatagtccctctccagggagytttgcaggggayggrtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgcagtttcctggctaaaggaactgtgcaggtattaaaaacccaccgatctttaatccaggttcgtggcagggggactcctttttgttgcaagattgtctgtgtgtggaaacccyggagaaaggccacaygtgcagtcagcaagccgagtcaccaggcacagagccctttctcctgatcccctcctcttgtttctattcccaggcctcattatgtataatgtcayagacacacacgcccaggaacatcccatcacagccaggacagaagcgccaagggaggtgctttgcacagattccatcttggagttagaagcacttgctyggtgcttgccaactacaaatagccccatgctggaaaatgatgctaattagtatgccattaaaaagggtggggggaccaccacccacaacaaaatggccrtgtgcaggcctgaagccctgccctgagggccacagggaagcayggccgctaatgcagcctaattcactttgtttggcagagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaaggtaaggagctcgcggggtgggggggtggtggatgagggagcctttggagcygtgccctggaacagagtcagaaaaagccaaatcaacgttgccaatccmccagcatcaggagatgtgacttggagctgacaacacgtggctcagggtccactttggggcagggaaaccttggggctgatacaaagtcatgtcacctccccacacctggtgctggccctggtcacccagcctggacccctgaccggaagcacttggtccgctttagagagtacaaatggattgctacctcaagaggaaaaacgttggagggatggaaaatattgtttttctcatgcatggcctcggtcctgcgtaggtggagactgtgtccttcgaaggcttggcaccaaagaggttctcaactccctgctctcagggcccctcccctgctgcatgtccaggagtcactccctggctgctgcttttgtcctggcaattcagtggtttctggatgatactgagtctgctggacatcgctgggctcattttctcaggcagaggccaagccaggatggtggcagggtggcaagtagttgagaaaaccatcatgatcgtggccactcagtggcaggggcagctgctgaggkgggggcctttttcccccttctctgttttgtaccttttttatctttaaatagcgtttcttaaccagagttccacggcacagggtgccaaacattggtgagccagcagcccttagctggtcaggcagggcctggatggtcaccccctttcctgagcagctgtttccccagcgtgccacacggggcttccccttcacaaatgcagtggtgatgtgacaccgggcgcgcgggcatggcaccccgagtggcccacgtgcgggaggccaacgggggtggctgtcagtagcctgtgtcgtcaggggccttcaccacttgccgcgcacagctgggctcccggggaaactgccacggaaaggccaccacattaactgccgtctcactcacagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccrgccygcagaggcaggagaggcygcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcrgagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctytgcacgggccctggcctcgggctcgcggcccgtcagcatcatcagcagcatcagygaggacctggagtgctactccagcacggcccccgtctccgaggtcagcatcacacagttcttgcccctcccgaagatgagcctggatgagaaggcccaggaygcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccsgaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacrggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacggtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggtaggcggctgggcgcagggacgcgggtgaggagggcggcaggtgggcgagctgcccaaaccccactgccagggtgtcccgtgccctggggagggggcgtccaggcctggcctctccttgcaggtgggcgaactgcccaaaccccactgccagggtgtcccgtgccctggggagggggcgtccaggcctggcctctcctttcccacggcccggcaccccgcggggctccgccggggacatcaccgcggagggtttctctgtgagaaactgccctactgtgtgccgtcatcaggcttagggccgtgaatcccttggcgctcagcagggtggaaaggcgagggcccggatgcaggtggcagcatgacccgcacctgctcgctctgggggcagcctggctcttcgccgtccattccctcacccctgcccctctgttcaacaaccaaggatcctgtggacggtttacagcctgttgagggatcaggtgagggtacctaccctcatgacctggtggcttcagaagcccctcctgtgaggttggtggcctgcaagaccctggcagcctctctcagggatgtgggataacgcrcagattgtcccattgaaagtggaatggcgagacccttcctccacctccaccccaaacatatttgtggacagtcatgtttgcacacctgccacagggcctgcagtgccccccgccacacacaccatgatgcctgaaatgcgtgattttggagaaagtctttgccatttctttttttcctttttttgagacagtcttactctatcgcccaggctggagtgcaatggcgtgatcttgccaaactgcaacctctgcttcctatgttcaagtgattctcctgcttcagcctcctgagtagctgggattacaagcgtgcaccaccgtgcctggctaatttttctatctttggtagagacaaggttttaccatgttgaccaggctggtctcgaactcctgacctcaagtgatccgcccgtctcagcctcccaaagtgctgggattacaggcgtgagccaccacacccagtcagtctttgycatttttaagaatctcctatcaaaaggcacgtactccagaataattaatatataaagcccacagacttgttaattggagtcttgggtggcacatgacagtaagttatgatgggcaaggagaagaggacccrggtcagagctggtggccctggaggtcttggggtaggwgaaatgaaaggatggtaaggagagaaaaagacagacagaggcaaaagttcccaagaacaactgaagctacttgagaattttgcctggaatcatctctgctcataagtggcttccaaagaaattacccctgctcatcctttaagggcttaaaaaaaaataaatgaaatttacgcagaaccccacgtgcaattctgtggcttggttgaagccagggcggccgggttcctgccctcctggcctgtctctcccctcccgctgcccttctgtgcaacactaggctcttcacatgctctcagaagccaggtccctgcagggatccgtgcccgcagcatatgtggaagtaaaagatggggtgagacacagatgtagggcttcccctttcctactgctccagcaactgccccacaggcttgttctctgtcatggggtggcttcttcctgttctcccaccacaggcgagcacaaactctggaatgttccaaatgtaagggctgtggtcagtgaacattataaaccattcctcttcctagaatcaaagaaatccaccttaagggatggtgtagttatgcagatgtagttttatgatatagacagccccatccgctcccctcatcacagatcacagaacttggccatggggatgttaggctctaagcatggtagggaatcatcgtggctgtcagtaccttgacatctttatttgccgggggtgggggtatgcttcagtctttgatacgctttgactctgctttacttcacccctcaatctcggtgacagcacttggagcagaaccccatttaagacaagttgaaaaggaagagccattccgtgtaacatagcagcttctgtgtcttatggccagggccaagggcattgaaacgtattgatgagagtaaaaataacaagcaggaaagcatctgccggccttcccagtacctggttaatgaactcttgttattctaatccacgcagcctcggtcttcaaagtccagatgactgtgtggcatcggctgcgtggccacgtgtgtttcagtgtcccacagtgctttcatggactcaaatttagtgccttgcgtctaccagtccatttcattatttccgtggctttcacaggtttttgtttttttycccaagacttttattgtttggtttggcggttacagtgsagtaaagaggaagaacaatgatggaaaaacaaacgtgtgaagtgactgcttggcgagcaggcagcaggctctgcatacgcccttgctctgggctaagtgctctcgtaaatgctgtcctctaggagcctctggttaggtaaggctattggaggaaaacagtgtaaaattaaaatgccrgggcaggtgctagaaatggatttcatgtggaatgtcaagagcagaagacctttgtgatgagctgctgtagatccaggctccatgatggatgtggcagtggagatgtgctggtttcaggttaggtgaccttgtctggcttatttatgattattattaagagaaacggtggctgtcagacatgatcagcataaatcaaaagcaacttctttaagagaagctataaaactcctccaaggaaattcctaactagatggctagagtttacaattatgagaggtgtttggaaccagagaggagacatcttttgtctgagatggcttttgaatttggaatattttaatgcttatttccttagtaaaaatgaactagaattattgggaaaataaccttgacctctctgattccttggtagtacatgtaacagcagaaacgaccaaatatcaccgtggttccttcttgtcttctcattcttggaggtccatgttgctgaggagtgtgcagcattgggcttgttccaccggccatagcagggtgcagtgaattaagttagaaagcaggaggaggcttagaatcttgagctgtgtgacctttggggaataactgtcctctttgagcttcaattttctcatatgcaagtaaaacgagaagattgataggtaatagccatggtctctctgctgcccacatcatatgagactatgcagataatttaaataatgttatggtcatgtgatgtcttttccttagagcaatctgtagtcagtggggtttattttcagttgttcaacattgaccaggtatcttctgtgctcttagagcttggtgatagtttctggtgtgtgggtggaggtggaggcagccggcacaggggacaaggccactgtaagaagtttgtaatctaattggagagaaagggtgaaaagcgtggaatagagaacagtgaactgagtgcattcccrgatgctgagtggggtagtgaaggcccaagtggagagagcatttagacaaagcaggatcctgcaaggcaaaggctgcagagaaatgtcgggattgagcttggtccgggagggtgcttacatcgggacaggcagagagggcgcagggcatcgaggctgaggcagggatgggactgcaaactcccagcggcaagagcctggcctgtgggcgacacagcgagattaactcaaggagggaccgtcccagcaagcagagcaagacgctagcaaacgcaagccacagtcacacccggaacaaacacaagccacagtcacacctggaacatctgggagctacaagaacagtacacattattctatattctacatagttctaaaagaatatcagtatattattgtagttggcaatggggagtcattacaggctcttgaccaacaacgtgataaggtgagagaaatgatgttgcttttattgatggattttcattgcttcatccacagctccttgccagcccctctatggtcagcaagatgaaattgtgtatagcccagagccaagaatgagcccaggagggaagggaatgtctgtcctggccagtgcacatatcagcagctgaggatgtcaatctgtgatacacagttgatgccataattacaccagctgagcccctaccctgagcccccagtcctcgcgctcccccgtcccctatcatccattatatgttatgtcaatcctattttcttcctccagtctcttaacatttcaccctcatcctggtgtgttacttccttggattctttcccttgctttccttttcttggactggatggggaagtctgacagttagatgagcaccttggtctgaattaaattcattcccaccacagggaggctcagcaccagaaaagccctggagtgagggagggtctgcctgaagagaagcccctcagggaagcatggaggttctggaatgctccagaccttggcccgcctggacatgagcaaggcctgttctgcgctcgacccagcctgcttggtgcccagcactgggctggtgcaggttactgttggatattattggttgattcattgatgggctggttgcttggttggcggcacagtcctraaagtttactcatgtttattttctgtgtatttctcatatcttttcctgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcagttcccagggcgctgcacaaaaacttgtgactaattgctcctcaccgagggcaccatggtttgctctgccaacctctcctattcatttggttctcaggcacatcctggttttgttttaataaattcaagcagcacagtgatcactggcttaatgaaaaccagaggaaggcaagccgcttgctgtcagacttcagatttccagaatgtttctaagcgaaccaacctagagccagttgagaataggttcagaatgagagcctttttgaatacacagttgggggaaaaggaggagagtcattgattctctcagacaccaaggaagctccttagaatagaaccccaaagagagtaggtggcgctgatgctgtgagatgacactgtggtcctaggtgcggggttcggaatcgcagagaacacgggaggaagcccaggctcggcatcgaggagagctttgtggccctggagaacctgcctctttctcatccccagcacgggagcacttgccttttcagctaaaacatgacagcaggccacacagccagcatcgttcttcatcatggagctggccccttcctggtcaacaaaatcacatggattgattcacattctctttctctctctgctctgatatctacagttcctttcaacattagtgcctcgtgcttttttgactgtcttcctagtgcctactctttgaatcagaatgcagacagtgggcgatggagcgaaagccatgctggagggctctcaggagcaggagtttgggaatgggcagaagcatattccccagggggagctgagagggctcagcactcagaacacccatgtttcccaacacttaacctcagmagcagcatctgcagactcgtgtggggacttctgtctggactcagggatgttaagagtagaaggcccaatgtcagcttctcacgtgggctgtcagcaccgcagatgataccggaagatggactgtgatgggccagcgacccctctgactgcacgcagctgtcagccaggcctggaacaggaggggcgagggggtgggctcagcctctgttagtgggagaggtcctggttggaagtttcactgaagtatcagtgttgactttctcaggtcaaatctgggccatttcatgcggtaaattcatgttggcaggtatcagcccaagtgttttgaacatgctgcacttgtacatgcctggaccaaatgccaggctgatgagcagggaggggttgaaaagcagaagggagcccaacccaccggcgtcagcaggaggctggccctggctgtggctccccgatcagacaggcggcgtccaatggggcaccacacgactcccaccagggtggggcttcccctgtacctttcttagagctgatggtcccctgaccccactcgcagcctggaaggaggggatccctggcagagaccgggcttggcagaaaactgggcatctgcttgagaggtggaaatgctggagcatgcagaaaatctaagaacccttatttatagggggccccagaccaagaccctcgggtcagtctttctttgcccagggatggcatagcagtaccatcgcttcctgtgccctttccagtaatgtgagggcaccatctccgcccctgaactcccttcaggccacttcactccatttcctcagcctgaccacattacccctgccccagtacttggcttccctcaccatcacctaagtgaagctcacatgcacctctggagggagacaggcacggggagagggagcctcagctggaggtgcaggaactgagtatcaatccattcacgggattgaggttctggtacccaaattcagaattttacgaaaatccaagacacttgttcattcgtgtgcaggaaaaaggtattcctagcccccaaaccacacctaacctgacagtgggcactcacttcaccttgagagggatcgatgtggtgaggaagttcaaggttgctagatggcatggaaaggaggcaatgggaaggaagtagatacccgccaggatatttctgtgaagctgttgtagcccagtgaaatgtcactctccaggtgtttttaccttctctactcccagctcacacggtgccctggcacgggtattggcaggactctccaggtgtttttctctactcccatctcacacggtgccctggcacgggtattggcaggagatggagggtggctcttatccaagacattttcccatctgatcatatcccatccgcggtagccaggctccaagatggcccccatggtctctgcctcctggtgttcacacccttgtgtagtcccctcccgtatttaccagagttggtctctgttgagtgaggtaaggcagagtgatggtatgtcactttcaaaagtaggttataaaagacactgcaccttctgtgctgggtgcccctcttgctttcttgggtcattccctctgggggatgccagctgccatgtcataaatagtcctgtgtaggagaggcctgcatggcaatgaactaaagcctcctgccatgatgacatgagtgagcttagaaatggaagcttcaacctcagtcaagccttcagatgagtgcagccctagctgacagcttgcctgcgactccgagaggctctgagccagaaccacctggcaaaaattgctcccagattcccaacccacagggatatgtgagatcaatgtttgttgttttagcygctgggtttggggtttatttgttacacagcagccatttggaagctagagttgaggcacacagaagctaaacagtttgccaacagtcagctagcttgatcagactgatttaaaagaaaaaaacccctctgatctggtcccttcccagggtaggtgtctcacgctaaggagacagacatttgctttattcccgtggtcgatgttacttagtttcgttagttggggcctgcactttgttggaaactaaatgcsattgtgtatgtgtctacacaagatcaaatctgggctctaaaaagtgaggttttggccgggcacagtggctcatgcctgtaatcccaacactttgggaggctgaggcaagtggatcatttgagatcaggmgttcragaccagtctggccaacatcgtgaaaccctgtctctactaaaaatacaaaaaattagccgtgcgtggtagcgggcgcctgtagtcccagctacttgggaggctggggcaggagaattgattgaacccagcaggcagaggctgcagtgacctgagatcacaccactgcactccagcctgggcgacagagtgagactccctctcaaaaamagtgaggtttaatatgaagcaaaaggagctcggagcccagagttcactccatagagaaaattaacacagcagtgagtgccccttgttgtctcctggaggaggcatgcttcagctggcatctgctcatcaaaacgtcagtcccctgtaccatgcaagagtttagtctccattctgggagccatgtgcttcactaatacccagggtctcttctgctgtgaaagaaagaggatagatactgggagagaactagccgtcctcrtcacaacgtgtgaagtgtgtgaaatagtaccaggcacgtaaccagtgcatgtgagtgctactgctgctgttataagcaaataaacagtgttttctggaactcctgtaatgacatcaaatgctaggaccttttgacctatccatgctgaggatgccccctaggctgcgtgttttacaggtggaaactaggaggcggttctaaagattcctcagggagtttgctgagctaaagcccaagtgttggtttaggggagtagaggtggaggtgggtggtgggaagtgggagtgtttagccctacctcagatcctggggtgcttgtcatgacctcctctgttacatccacaaaatatttaaaagattgaaattcaggcttcagctgaatttcagggtgtagtggctcacacttgtaatcccagcacttcgggagattaaggtgggaggatcacttgaggccaggagtttgagaccagcctgggcaatatagcaagatgtcgtctctcaaaaaaaaacatttaattagctgggtgtggtggtgtgcacctgttatcccaactacttaggaggctgagacaagagaattgcttgagcccaggaattcaaggctgcagtgagctatggatcgcaccactrcactccagcctgggcaacagagcaagaccctgtctcaaaaaaacaacaaaaaaattgaaattcagaaagactaactctctgggcttatccccctcctcaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatygatgaygtggagcgcctgcagcggcgacgagggggtgccagcaaggtgaggcagcctccttcccaccccctgcctacgtggtggcagctccccaccaagcctgagcaggtgctaggcagggccctggggaagaaaactcagacccgggcttcccagcgggcttctggcatgggtggtgggaagggggcttctgtcccagcaaagggcctttggacagaggccttggagagagccccatgtttctcttcctgaaatgttttaagggcttcaaagccaggggtcgggggctggtgatcttgggggcttttctggctccttgaggctcccagtcttaaccaacctttgtccaacttgaacacccaccacctgctttctcaacttaagaatggcctgtcatagtccaaaaatggtctgtcatagtccaagaatggtctgtcatagtcctaccttgtgaggtgtctgaattgaggtctgtcaagggagaatttggtggggatgacccatgtccctcccacacgtctccaagcccagcctgttttccatcaacgatactcacaggtgctcctgtggtgtgggctgggtgtgagcagaagggccctttctcctctctgtctgtgtgctaggaggccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatgtaaggccrgggtgccttcccacccttgtgactagtgggttcacctgctcaaccgggctggcgtgtagcccagggtgacagtgacacaggctgtgtcctcgtcctcagtcacaggatgcccatcaaatggaggaagttgcaccgagcgagcagccctactcccctggggatgggcgggaggggccgggacagcagaggggtggtgaatattgctcttgcaagattatttctacgtgtctcagtccaaagcacctgaaaatgagatttttccccctgcgtgtggcagaagatcacccagacatgaaggctgtattacaaatctcctaggccacaaaatcacactgcatatctagcctgaaatagacaagaatttatagagcccttaaaaaggtagagtgtacagtcctcgaaaagccacgcagagaacccagaaagcaaggaaaacatttttgagtggaaaaaaaaaaaaaaagacagccacagtgttatttccatttaatagaaagcccaggatgaccataaccatctaataacaattcaggacaattttgctctctttgaaaggtggattcaattgtcttattagttcctgaccattccatttagcacaaaataaaacttcagtctggtcccagctattacacggatataggagctaatgctggaagactcagtctgtggggtgaaatacattcctgccattcaagttccctctgcctccccttcccatccagccctcagcctccggcaggcctcctttgtacagcccctcccctgcactgccccaaccctcttccagtcttccccagccagtgtggagggcctacaggtggaggctggaagcttaggtttatgttccaaagcagctggttgaaaaaatattggtgtgaaatggtcctgggtgaaggtgcggaagaaagtggcaggacttgtcagcctcccagctgtgccttccacatgtaactgcagtctcgcagcagctgcctctccacagggataaggtgataacaacatttccctaagtactcattggattcttgggacagtctgtggagcattctataatataatattaagttgcagcatttgccgctgtggccacaggcatacagacctgctttggctgctggctttctcacatactagctgtgggacctcaggtaagacacttaactctgagccttgacttccttagctgtaaaatgggaaaaataatggtgactacaccatagggcagttgtgaggtataaatcagttcccgttggtcctcttggtgcttactacactgcttggcccaggatgagagctcaggatctggtagtaattattactattatcccaaagttcaacaacaggagacatttcctggccaggcacggtggctcacgcctgtaatcccagcaccttgggaggccaaggtgggcagatcacttgagcccaggagttcaagaccagccttgacaacatggtgtgaaaccctgtctgtctctaccaaaaatacaaaaattagccgggcgtggtggcgggcacctgtaatctcagctactcaggaggctgaggttgcagtgagccagagattgcgccagaccctgtctcaaaaataaaaataaaaaacaggaggcatttccttcgtgtctgcttgcatgatgcactgaggagttggatcttctgttagaaatttgagcaaagaaagacatgaactagtcctgcgagggcctttcatcgaaggcgctaatggggagggcagacaggggcgagggcgctggttactgtctgcgcgtgacatgcgcacggggcgctgtgcttatccctccccgctgcggatacccttttccttgtttcaggaatccctggccacttcaagatcccaggggcctcctttcagtcagtcagttctctctccttcatttttgctattttcattaacattttattttcaagaactgtttatgcccaaggcagacttgacttgaaaattatcttcatcttacaaagtcagtcatatttttcccaggatgggaacaagctgaaacatcaatacatatgtgtttagatgcttccaggaaacaattgcttccttctagtctttgtacatgtcaaaaatcactgtgtttttgatgctgagaaagaaaatgaacagaaagctacatgaaaggggaaatatatattgtttcttgaagatgaattgaaaacagtaatgaaaaaaaggatcaatgagctgcctgctgactattccctgtgggcatgaggcaggggactggcatggaaagatccatttttagttctattatttcttcattctgatgccacttttaaggttgtccagtaatgtagtctgatgtggtcatagaatgatgtctccttttgcttttttgttttggtttttaaatattaaactggtattcagggccttcggtctccttccagctctagtcctggttaactgtgtcagcctcagtgagtcacgtcactgtccagctctcagggacctcatctgcagaaagaagacactctgcagacagcggccactctaagccccagtgtttccatagcacggcatcgttttcaaatcaagttcgtgttcattattatctcattttattcttcacagcaactcaaggcaggcagggcaggcagcgtaggagttactattctcacatgcctttaaagacactgtcagcagaggtggaggtcccagagctcgtctcttcagagcttgtctcgtgcctggggttccagggccatcccaccaccttggactgctgtccacgcctctcctcctcgtactgggagcctgctggacccctggacctgggccaggcagcccatccctctgcccggccacctctggacaaagcaggggacttgatgccagaggggttgatcccagatacctgctcttcaggcctggaatgatacagactttttactctgtgcaggcctgaacatcaggaaaggcatctgggttataatccagaaacgtcctttcatataaggaagcagaggtataaatgtcactcaactgagacccccaaaagggagggactctccccacctcaacttgaattatttacttgattgatagtgaatagtgtggtagcgtctctcaaatcctgggatccatcctggatcctccatggctggaggtagggggagctagaatgtcaccttattggtcagtagaatctcagaaaaaaccttaaggatctaaatactggtaaagagtgttcctttcaacccaaaagaggccgagaatcaggcaggagggaactctgcagtggcctaaggcaagcgaactagacctttagaccaaggggtagatgtgggggtggcagctccaggctgagccgtcgggagttgcttctcaccctgtttgctctgcgtctccatcaggctcttcctctcttgcagttgacttggagcaggtttgggagctggattccctggagtacctggaggcaytggagtgtgtgacggagcgcctggagagccrtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagasacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagttttctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattctacccagagttgtgaattcctctatccagcttctccttctgtacctcgggggaaagcaattcaagagctaggggtgggtgcttctcacggcagcaacaccttggcccaagtctagcccccaggcctctcaggacctcatgggatgaggcctgtctagtcgccctgtggagctggcccccaacaagttcagcagctcagccaggagtgagtagaggtgtcagctaagtcccagagtccctggacttgttctgcacacctgagagccagacgctggggaaagtgtggagaagcttgtgttgataatgggatattttctgttgccctccctcagtccagtgtttctggggcttacacaaaataagggaatttgcagtcactgtagattgctcgggcctggatgcatgggcctctgttacactggtgcttggtctcagttataactgggcacattcaggcaagaaggcaaaaacagatcagaactagaaaaaggtctctcagggtagccccttcccttgaggacagtctccctccactgcagacatttccctctgaacagtaatgagggactttcctagatgctggtgccacattcatccaatcaactgagtgctccacacccccaggagatagggcaggatggccactcaaagcaaatacatactcttcactcctggcaagatccctctctgagtccctgtctcctactgcaccacgcttgcctggacatgcacacctccaaggctccctgcttttcttctccccaaatcctagccaagaccttcttgggctccctttgggtaaaccgagcagaagccgtaagggttttctaaacataatgccttcaactagaagagaaggtagaggtggtgccaaactgatcattcccttggggaggagacgatggaaaggcagcctctattatagaattgtttctaatgccctcactcc

SEQ ID NO: 10682 - DNA, 16803 bp, Homo sapiens
  misc_feature (1)...(16803): n = A,T,C or G, or insertion/deletion polymorphism (see Tables 1-2)
tgattctaaccaccctacttatacttttctgggcagtttgagcagttccaggatccagtacttggaggctgagcacaggggtgacctcagtgcctgctcatctgatactcaccttggtctctctggagatgggttggggctgcggggaggaggtgtgcgtggcacagctgccttcggagcaacgctggctgcaggtaaaaggccatggatgatgtgtttctgcacaaatgaaatccaacagaagtcactgggttgggtcactggatcacctgagtcttgtcaccactctccctgggcctgcaaggggacacctgcactggccacccatggatccaaacccatcagaagcccactcctcccctgccatccccagtccccatcaggccagacaagtgcacacagccaaggagcatcatgatagctgctcattgtgtggccctcttgtccttccctcctcagagcttccctggctgtccccaagagtcaccctctagctcttccatgtgtcccacagcactccccccagtgatgtctcatgtggctccccctgcagagcagggcgacttcctgagaagcaagtgatatccttattgtttttcgctttgttttgtttttgagatggggtcttgctctgttgcccagagtggagtgcagtggtacgatcatagctcaccgcagcctcaaactcccgcttcagccacacgagtagacgggactacagatgttcaccaccatgcctaggtaatttttgtatttttttgtagagacaggatctcactacattgcccagactggtctcgaacttctagcttcaagtgatcctcccacctcagcctcccaaagtgttgggattataggtgcgagtgctgcacctggcccactctcttatctttatcaatcctggaactctagcattgagcacattgcctcacacctcataggggcttaatataagcttttaggtggcttatctccaagacgagagtaatgaaaactagctcctatacacaatgaaagtcagagagctccgctttaggtaactgtaactgggagtctctgagacgtttctgggtctagtccaatcattttcttggcacgagccattcattcacacctactagaggcaaaacaccatgacagcaatgaagaaaccttgtcttcatccccaaagtggtgagaagggaggaaaaacacccaaataattattacagaacatagaattatggaatgagccgggagaaaggctctcactaaaaatgaaaaaaaaaaaaaagagcatcaatgagatgtgggataaaaacactattgttttctatttgaagccagtaattagcacaaagtgctggggtgggcagggagggaagattcctccaggtctggggccagcctgggaatttcaaatgctttccttcgagaaaatcacacaggcgtttagactgggctttcagagatgcccactggtcccacatttggaaatgtgacggaacagcattctaggaagagggaacggcatgaacaaaggaatggagcaagacattggttgcagtgctcggaaatcataagcacgattctccgttttgctagactagaggcatcttcgagggtggggcttgggggcatggtggggacaattcccatgggaagggcttccagagcagatggaggaaatcccaaggcctagtgaggagcacccactgacagtggccccaggaatgttaggtagtggtcagcacgagacacaaggctgggaagggtggcacagagtgggggcatctttcaggagtgagggatgggcacaccttccagtcatctcctacagcccccaccaccgacttgcacagccacccacaggagcagaagctccaagcagtctctacccaatacccccactctgtttacctctgtgtggcacctgccaccctgtatttgtcaagtgattccacagtttccatgtttccaccctgcccccctccaccacctgctacacgacaagaaatggtttttgtttgtttgcttgttttggagacagtcttgtctgtcacccaggctggagtgcggtggcacgatcttggctcactgcaacctccacctcctgggttcaagctattctcatgcctcagcctcccaagtagctaggaccacaggcatgtgccaacatgcctagctaatttttgtattttggtagagatggggttttaccatgttggccagggtggtctcaaactcctgacctcaggcaatccgcctgccttggcctcccaaagtactgggattacatgtgtgaaccactgcacctggccagaaaaggttttcttaacctttgaatcccaagggctggcgtccagcaggtcctccaaaaaggctgcataagattttttttttttaaagagtgaatcccccctcataccatcacaatcattcctaactatggtcccctcgtcaatcctgtctctactgggcataaaaaccctcatgggcagcaccactctctcaacggcaggcaaatgtccagcatggcttatcaggctgatataggttggttcctaccaagtgttatgggatttttggggtgtcgatttttctggccggaacctctgtggccacagtgcctttgcctgagttcttgtcctgcatccaggaagaatgaggtacacagacaagtgaagggtgaagaggagttttatttagtgttagaagagctcagaggagtgggtagctcctctctggagacagattgtcccatgagctcaatcattcagctctcaacagagaggaggccctggagagagtggctcctctccgcaggcaagtcattccaatgtctctgcaggtctctgaagctcgcagcagagtgtagctcctctctgctggcaggtggtctctgtagctttcagcggagaaggtactcctctctgtagctggtcaccccaccgtctccagctatcagcagagagggtactgctctctgcagctggtcatcctgtcccctcgtctctaccatcttcatcctctggctattctctgcgctgctctggctgagccyagggtttttatggacctcagcggggaagaagtgtgtgctgattgggccattggcaggcccagaaaaggctccacgagtttccactctggtcagagggactggcagcccagcccccagaattcaggccctccctggcctgagggtggggccttactggggaccccacccccttcctcctgctgccattcatggctgcaggtcttggctccgactcccctccaagatcagagcagttgctggagtggagagaggccaggcagtggaagcagacacccctgagcctgcagggatggagggtgaagggggctgtccttcctgggatggccgatggtgcaggctacagagatgccctcgtcctgtgcctgggggggcagccacagctgcacctgggagctcccaccccgccaacttggaagaggcagggctcccacttgtccctggctcctgcctgcgcggctgcagctgcatctggaagggcaaattctgcctgttcccggctcccccaggagcagagaggctcggatccacagctgcagtttgggtggctgtagccctgcccaagagggtggggctcctgcctgctccatagagcagaaggcctgggtctgcagcagcggtttgcggctccagtcccaactcatgagggacggggcttccaccggctccatgaagtgtgcagccctagccacacagcgtgatggcagcagccactgccatcacaaggacccaaattcatttcttgcttcccctcctcttcctgcgcagagtccctgtgcttcagcactcagcgtgggcttccatttcccaaacagcaaataattcattcttttttaggccttggtatttgctgtcttctgcacccagaattctttccttactccctgccaggcccaggccaactctccaggctgaygtcactgcccttctggtacacacatcaacagcagttcttgttttaccattgtgtacagaattatttatgggcttgtctatcctacagaccgtgtggccataagctgtcagttgtgggtatcagcacacagcagggactcattaatgtttggggctttaaataaaaactcaagccagatgcagtggctcacacctgtaatcccaacactctggaggccaaggtgagaggattgcttgagccaaggtttaagaccagcctgggcagcatacccagaccccatctctaccaaaaaaaaaaaattatgtttttttgaggcagagtctagctttgtcgcccaggctggagtgcagtggcacaatcttggctcactgcaacctctgcctctcgggtttaagcgattatcccacctcaacctcccgtgtagntgggattacaggtgcccaccaccacgcccgctaatttttgtatttttagtagagatgggttttcaccatgttggccaggctaatcttgaactcctgacctcaaatgatccgcctgcctcagcctcccaaagtgctggattacaggtgagagccacctcacgtggcctctacaaaataatttttaaaattagccaggcattgagacttggcagagtgtgaggcaaaaaataaaataaataaaaaatacctaggtgtggtggtgcacacctgtagtcccagctactcaggagcctgaggcaggaggatcacttgagcccaagaggttgaagccacagtgagctatgatcatgccactgtactccagcctgggcatcaggacaagaccctgtctctaaaactaaattaaataataaataaatataagaatccccttggctgctacgtggagaatggacctaggggaagggcgagagtggaagcagagaaaccagtgaggatctgccgcagcagtccagacagatgctggaggccggggtgtgggtggagatgggaacagctggcagatgtatgtagtgggtatatcggatgggacttgctgatggggtgtacatggtgggtggaggagggaaaaatgaagaatggctatatccagcagtgcagcaggtgtacgtcgtccaggagttaactccgggcacggggacgaatgctacaggggaggcagggtgctcctgtccaactgtggccgaccctggggcagaagattgttaacgccgggcacagtggctcacgcctgtgataccaacactttaggaggctaaggagctcaagaccaccataggaacatagcaagatccctgtttccacaaaaatattgaacaattagccgggagtagtggcgcgcgcctgtagtctcagctcctcgggaggctggggtgggaagatcgcttgagcccaggagttcgaggatgcagtgagctatgatcgcaccactgcactctagcctgggcgacagagcgagaccctgtttcttaaaaaaaaaaaaaaaagtttagaacacgaaaaatcaaggcttcctcaactgaaaaccactttctcttgtgccgcccccttgactggatctcaggccaaaccccaacccgccccaacactttacccctaattcccggccccacagagccccacgcgcggcgggcgagcatctacttacgaaatgactcctgcggcctctccgaaatcccaggagcatccttgcagcgcgaggagaatggaccggggcctggactcatcagcagatctatccacagccagggaccactccctaaagcccgccgcaggcccagccctcacgctttctcttcgcaatggactttgcagcaaccacgtcggccattggctcagctcggccctcgaccaatcagagctaaggttacttccacaccggtcgttcttggcaaccagtgggtaccgttcaaatccccgccagggcggaaacgtccgcccttatccgttctcttattggtcaggttagacgtccatttctgacgccacagcctatccggcgctgcgggaggcggagggcgggctggatgaaggactgggcgagcaccgagggcgtgaacccggaaggtggcgcggccaccagtaacatgatctctagactgggacggtggggttcctgccggctgtattcgggccttggactggactgagaagctacggtgcggatccagctggggtatcaggggctaggcacgtgatgaaaatgaaggacgcggacaccaggacaggaatctcctggttcttagagaatttatttcgccacaaataattggcaaacgggatctcgctgtattgctcaggctggtctcgaactcctgggcacaagcgatcctcacgcctcagccttgcccaatgttgggattacagacgtgagctaccatgcccagcccaggattcttttaaaacttaaatctgatcgtgcctctggccttattggaatccaatgccattaccacctccaccaccacacatcccgtctccagccaccctggccttcattcaggcctttgtgttttctttttcttttcttttttttttttttttttgagacgagtcttgctctgtcgcccaggctggagtgcagtggcgcgatctcggctcactgcaacctccgccttccggattcaagcaattctctgcctcagcctcccaagtggctgggattacaggtgcccaccaccaagcccggctaatttttttgtatttttagtaragacgcggtttcactatcwtggccaggctggtcttgaactcctgaccttgtgatccacccgcctcgctcggcctcccaaagtgctgggattacaggtgtgagccaccgcgcccagsctgtgttttcttattagtaattataaagggaatcttatttgacagttctttgacaaataattcagtttgcagaggggatcctgccccagaggccctggcttggagtggaatgcagggccgtgtgcgggagagcctgctcaagtgccgcctggcttttccctccttaggtggagaccatccatggaaaagaacccccctgatgatacggsccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatyctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtgatggctccatcagtcattatcctgccctttcgctggtgaaaacgtcaacctagaggccaggcgtgatggctcatgcttgtaatcccagcactttgggaggcggaggcgggaggatcacttgaggccaggagttcgagaccagcctggccaacatggcaaaaccctgtctctactaaaaatacaaaaattagctgggcgtggtggtgggtgcatgtaatcccagctactccggaggctgaggcaggagaatcacctgaactgaggaggtggaggttgcagtgagtggagatgctccattgcactccagcctgagcaacaggagcgaaactttgtctcaaaaaaagaaagaaagaaagaaaatgttaactagaagctgctttgtctcatcccgtatttttgttaagcatcagcaccttgtgcaagtttttttttttcccttttttttgaggcggagtctcgctctgtcctacaggccagagtgcagtggtacaatcttggctcactgccatctccacctcccgggttcaagccattcttctgcctcagcctcccgagtagctgggactacaggcacgcaccaccacacccggctaatttttgtatttttagtagacagggtttcaccatattggccaggctggtctcaaactcctgacctcatgatccgcccaccttggcctcccaaagtgctgggattacaggtgtgagccaccatgcctgggcagtttttttttttttttagatagggtcttgctctgtcattccagctggagtgcagtggtgcaatcttggcttactgcaacctttgcctcctgggttcaagcgattctcctgcctcagcctccctagtacctgggattacaggcacccaccaccatgcccggctaatttttgtatttttagtagagataagagtttcaccatgttggccaggctagtctcaaactcctgacctcaggtgatctgcctgcctcagcctcccaaagttctgggccaccgcaccaaccaacacttttttttttttttttgagatggagtttcgctcttgttgctcaggttggagtgcaatgatgcagtctcggctcactgcaacctcctcctcctgagttcaagtgattctcctgcctcagcctcccgagtagctggaattacaggtgcccgccaccacgcccagctaatttgtattcttagtaaagacggggtttctccatgttggtcaggctggtctcgaactcccgacctcaggtgttgtgcccgcctcagcctcccaaagtgctgggattacagtcgtgagccatcgcgcccggccgccaacacttatttttaaaatcagtttagtagcttacgcctctgatcccagcatggggaacatcaattgtgtgtgtgtgttgtttgtttttttcacttttgttttctttgttatgtgtgtgttgtttttaaatcaccccctctgatgtggagctagagttgagagccacattgaagatgcaagcagccatgaatggttcacagatccctctctaccatatcccttgcgtcaccgttcctaactttccttgatataacactgttgtctgccttagtataaccaccactaactagaccaggtttctcctttgaggcaggcttcctgcagctcctgcgtgaagtaggcctagtttaggtgtagccatcatttaatcctgcacaactgaaatgtttcttaatggaccaacagaaagtgtttgaattcktctgtgtgtttttctaaacattctgaaaacgcacatttttgtaaattaatgtcttaactcctttgtgtggttcacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagancccagtaagaaccctcttctcgggaagaaacgggccctgctgctgtctgagccttygctccttcgaaccgtgcagcagatcccaggagttggaaaagttaaagctccccttctcctccagaagtttccaagcatccagcaactgagtaatgcttccaytggggaactggagcaggtggtcggacaagcagtggcacagcagatccatgccttcttcacrcagcccaggtgagggctggcctcagggccacggcatcttctccygagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcgtatgtcttctgcacacagaaagtatgaagtctgaagttcccacttaaagttgaaaactcaacggccgggcatagtggctcacacctgtaatcccagcactttgggaggccaagcggggtgaatcacaaggtcaggagatccagaccatcctggccgacatggtgaagccctgtctctactaaaaatacaaaaattagctgggtgtggtggcacacacctgtaatcccaactactcaggagactgaggcacgagaatcgcttgaacccaggaggtggaggttgcaatgggccgagattgcaccactgcactccagcctggatgacagagtgagactccatctcaaaaaaaaaaaaaaaaaatttaaagttgaaaactcaacatgcatgaggcagaacaggctgtgtttgtatatgaaaggcccaacaatggaaggatacaagaaaatgatggcagcagctgcatctagtgagggaagcaggggctggggatcaaaaggtacaaattgcccattcaaaaaatagacacaggccaggcacagtggctcacacctgtagtcccagcactttgggaggctgaggtgggaggattgcttgagtccaggatttcgagatcagcctgggcaacatggcaagaccccatctctacaaaaaaatcaaaaaaattagccaggcatggtggctcatgtctgtagtcccagctactcaggagggtgaggtgggaggattgcttgagcccggaaggttgaggctgccatgagccacaattgcgccactgtcctcctgcctgggtgacaaagcgagaccctgtcttgaaaaaaagacaaaaacaaaaaataagcacaaagataccatctgtcttagaaaatactaagataacttgacagctttttaagttctgctttgtgaaatgttagtaactaaaaaaatcagaacattagaaactgtgtgcattggggagaaacaatttgaaagaggagggaatgaaaatgaaataaaagtaaaaagaaatattaactcgggtaaatgaatatgtttatttaaatatgtatacaagcatggccctaggagcagcagatacactttcccaaaggtggttgcttcctttaagatattgcacaatagaaaataaactcttgtcaatccttaaaattagtcttcaatgctatgtattttagctatgtaacttgtactgtgtcaacagtgaaccttattagattcacggtgtcatcgaacttatagcaagataaaaatcaatcagtaggaatgtcattttaaaaagtaaaatagtgggacggttgtggtggctcatgcctgtaatcccagcactttgggaggctgaggtgggtggatcatttgaggtcaggatttcgaaacccgcctggccaacatggtgaaacctcacctcaactaaaaatacaaaaatcagccaggcatgctggagggcaccttgtagtcccagctatttgggaggctgaggtaggagaatcgcttgatcccagggggcggaggttgcactgagctgagatcacaccactgcactccagcctgggcaacacagcaagacgctatctcaaacaaaaaaaggaagtcaaatagagctttaaacctgaatcatttacatctttactttataaaatgtaaaactacttttttacccaagacttaaaatatagaattatgtaacttctactttaaacaaaatgaaaaatgttttgagtatcaaacagtatattatctaccttgtagacagcatcttcatctaacactgccactgtgttagtaattcttaaatgacatcaaactagaagaaaagctgctcctacattgtttttatttaataagacaaatttggcactagactttttctagaaatagcartcatagtctatcgatataatagtaacatcttgttttaggttaatgaattcctattaggaagcagcactttgggacagtttttagtgacactaatttaattctatcattacagtcctctgacctgccttaattccaggatcatctgaattctaggttaaggaatgattattagccaaacctggaaacaactacaaattgtactgatataggtaaccccaatttaatagtgactaaaagtcataattgtcaccattaaaaatagccatatttcatatcttcaacactattctatttacaatactttatataataaataacttacagcagtatagtaacacacctcaaaaaagttcttttttcactaattcctagaggtttcttggttactttccttcataaaaacacatcaaatgtgagtttacactatgagaaaaacaggatttgagaacagatagatagatattttccattatggcacaaacgtttaaggccgagtcagcaccggaaatgttcagggcctgaacatgtttgtttcctcacattagtaccaagaactgtctgagttgagaaggctgaaaggggagggcagcttcttcttgacctgangccgtgcagccccgaccgatgggaggcacaagktgctggctgacttctgtctgttcttgttggtgccccaactcaggaaggaaagcttcttggagattttcttggttttatcagttttgtcgtcatcatcaatggctaagcagatcatggagtacgttttctncattcccacggagtatgtggcactcttattatgctgcacatagaaaagtaagaaaaagggcgtcaggcatcatcaagatagatgataaaaactacgaagtttggccaggcgcggtggctcacacctgtaatcccaacagtttgggaggccgaggaaggcggatcacttgaggtcaggagttcaagaccagcctggccaacatggtgaaaccccatctctactaaaatacaaaaattaaccaggtgtggtggtggatgtctgtagtcccagctgcttggagcctgggcacaagaatcacttgaacccaggaggtggaggttgcagtgagctgagatcacaccactgcactccaacctgggtgacagagcaggattctgtctccaaaaaataaattgaacagacataattcggaaactcaggtgaccaatgcttatatagaattaggttcttaaaacaaggacaaactttttttcttttttgagacagggtcttgctatgttgcccaggctggtcttaaactcctgggctcaagcgatcttcctgccttggcctcctgagtagctggggctctaggtgtgcaccaccaggtccaacaaggataattttttgtttgttttttgtttttgttttttaagacagagtctcactctgtcgcccaggctggagtgtagtggtacgatctcggctcactgtaagctccgcctcccgggttcacgccattctcctgcctcagcctctctgagtagctgggactacagacacccgccaccacacctggctaattttttgtatttttagtagagacggggtttcaccccttctcgatctcctgacctcgtgatccgcccgtcttggcctcccaaagtgctggaattataagcgtgagccaccacgcccggcccaacaaggataatttttaaggaatgtactcaatagtaacaatttaagcttaggagccacaactcatattttaaggttcttcttctatttgagaaagtaataatactcatggtcacgaatatgaaagtacagggtggggcgcggtggctcacaactacagtcccagctacctgggaggcttagaggggaagattgcttgagcccaggaggttgaggctatagtgagctgtgattgtgccactgcactccagcctgggcgacagagtgagacctctgtctcaaaataaaaaaaaaggggggggggcggggggaagggaagaggggaaaggaagggaagaggggaaggaaagggaagaggagaagggaatggaagaggggaagggaagggaaaaaaaaaaaaagagtatgcagtgagcaataggtctccctgtcacctgggcttctaaggccctccatgttatacttctagagatgatgtacaagtatttctatatgtacctaagtatattaccattcattttcttaaaaggaatatactacactattctacacctgattttctttttttcttttttttctttttcctttttttttttttttttaagatggagtctcgctctgtcgcccaggctggagtgccatttttatcattttcaagtgtagagttcggtggcattaattacattcacatcattatgctccactgccaccatccatctctaaaactttttcatcttcctcagctgaaactttgtaccattaaacactctctactattaactttccaagaatcatgtaggattcaaactggaaatctaaggaagcttgctttctgaagacttccacatgggctatcaccggcttctaaggtttgcctaacattgagattgtttagttygccacatgtttattgatggtctactatgttctggcactaaaattaggcatacaatatatcgctgcaatagttgaggacattgttcctaatataaaccctaagaggggccgggcacagtgtcttacacctgtaatcccaacattttgggaggctgagttgggcagatcacttgaggccaggagttcaagaccatcgtggccaacatggtgaaaccccatctctactaaaaatacaaaaatcagccaggtgtggtggtgcacacctgtaatcccagctactcaggagctgaggcagaagaatcacttgaacccaggaggcggaggttgcagtgagcccagatcacgccactgcactccagcctgggcgatggagtgagacgctattgcaaaaaataaataaataataaataaataaataaaataaaccctcagaggaatctgagttatgcagcaataaagtagggggtacttcgagcccctaaggatggagatgcctcttccttttctggaaaactgaccgctaactccaccatgttttacggagcacacacaatgtcatttaaaacaataataaaacgaataatcctggagacagatgtgaggcctgaaagcatttcccaaccctcagctgctcaaagtccattgtgtatcaaaaccactgccttataaataccctcagttctcttccatctgcccccactcgctcatctccaccctctgcctcccctagggcctgtatctgaaaggttgtgcgttgctggaggacactcaccaaggcttcccttggaattctaacctgaccccaaacctctaataggcacccatttcctggcacttctgtgtgtccctagtaatttcatttccttttctcctgtatacttgtttcttatcttcgctctcctcctgaagccactcacgcaccctcctgacatccctgccgtatacttcatggcatccgtcccccaagaccaagcccttctgtgtgcctggatcccattccctctctcctccaggcacccttgcctcccaga

SEQ ID NO: 10683 - DNA, 15061 bp, Homo sapiens
  misc_feature (1)...(15061): n = A,T,C or G, or insertion/deletion polymorphism (see Tables 1-2)
ggcgtgatccaccgcgcccggctagaaaatatatttaaaatgcatagcacaaggccgggcccagtggctcatgcctgtaatcccagcactatgggaggctgaggcgggcagatcgagaccagcctggccaacatagtgaaaccccatctctactaaaaatacaaaaattagccaggcatagtggtgcgcacctgtagttcccactacttgggaggctgaggcaggagaattactcgaactcgggaggcggagactgtggtgaaccgagattgtgccactgcactctagcctgagcaacagagcgagactccatctcaaaaaaaaaaaaaaatgcatagcacagtgtcaggttcagaagtaaccaatagtggcacactctaaaaagaaatgtctttgaaactcatcttgataaaaccacattatcttcttgctatcaaagtagaaattgattagtttgtggtttaaaaatcatttctaaatattaaatgaaaatgagtgtctttacatttgaacaaagcaagcagtattaaaattacctctacaagtagctttccgaaagttttcctttccagggcatacttggtagcttcatccaaagctctttgtgctaatccaacagcaccagcagctacctagtattttaagatattataaagcaaaagttcatgttatctttaaaacacacaatatctgcctaagtgtctatgttagggagtgtacaaagagaaggtgatgtacagcaacaagaaactggtggggaacagggaataggcacgtaagtttatattatttgttaattaaaggtagtaagaggcatttgttaggcatagtatcatactctagaaaaaagtcattgcttttgtttaacaagagaaatcttactaggggaaatgttcttaatgagtaaaaacagaaaatgagtacatattaacaggatgatcatatttagggtggactgcctctctaaatctagcaccaactacagtaattttgcagttgctaaaataatttctataatgtatagtaagaaaacttgaagaattatttaaaaaattaagaaaagtaacaatatggtcaggcgcggtggctcacgcctgtaatcccagcactttgggaggccgaggtaggcagatcacgaggtcaagagatcgagaccatcctggccaacatcatgaaaccccatctctactaaaaatacaaaaattagctgggcagagtggtgtgcacctgtagtcccagctactcatgaggctaaggcaggagaatctcttgaacccaggacgtgaaggttgcaatgagctgagattgcaccactgcactccatcctggtgacagagtgagactctgtctcaaaaaaaaaaaaaaaaaagaaagaaaagtaacagtatttttcctatatccttaataaaataagcagatattaaaaagagaaacacactgaacatacaattttaaagtaaaaatacttatttaatgtaataaataaaagatcctataaagattatgaacccatattacttactacaggtctggttttatcaaaagctcccattgcaactttgaaaccagctccgtcaccaattaaaacattttctttaggcactttcacatcttcgaagacaattcctctagtatctgaacatcgctggcccatgtttaattcctaataagaaaattgatatattttaaggaattttttttgagccagcatcaatttttgctttaatcactgtttcatgactttctgcaattacctaaaacagggatcaacaaactgtagtctgcaatgcctgttttgcaaagaaagcctgattggaatacagtcacgcctatttgttcatatatcatctacagttactttcttgctacaatggcagaactgagtagttgtgacagagatatggcctgcaaagcctgaaatatttataatttggatctttacaaaaaaatttgccaaccataatctaaaacaatgtttcacaaattttgaaaccaacactagtctaaaggtctacaagtacatcttatcaacaaagacaaatctcattatatgtttgaaagctatctattttaccatgtcagaaaaaacatttagtaaacacaatctgatttgagacctttaatcttaatagagctagtaaaataatctactgaataaaaattgattttgttttcctttgactcttgttaaaattaggtttactgaggtataatttacatgtagaaaagtcaccatttttatgtatacatttctaatagctctgacaaatgtatatgtgtgtaaccaccaccatgctcaagatacagagtactttagaaccccaaaaagttaccttgttctccctttatagtcaatttccttattctacacttatcccctggcaaccactgtgtgatttctctccgcgtagtctttccttttccagaatgtcatttaagtgaaataataaagtccgctttctgtgtctgacttttcacttagtatagtgcttctgagattcatccatgttgctgcatgatcaataattcatttattttactgctaagtagtatcccactcttggatgtaccatatatccattatcttttcactagttgacggatactcccctcctttttagcaatcattaataaaattacaataaacatttgtatataggtctttattttcatttctcttgggtatttatttaagggcactggttatgtgataagtgtatgtttgactttataagaaactactaaactagctacattccctcaactttttgttttaaaaattttcaaaccaatggaggagttgtaacaggcatgtaagtacttatacacccttcatctataatagattcaccaattgttaacattttgatacatttgctttattttttatttctctttctctttgtatatgactattagtgttatgctaaatcatgagaggaagttgcagacataactcttaataaggaaaaaaacttgatctcatgtttaataagcagaataagaaacaggagcaatggaaacaaagagctataaactaaccctttaatttgctggttttaatagtctgcttctgagtttgaagaaataataacgatagtttgacctagaaagaagccaacatccctttattttgtctttaaaagttaataaactagaatcttggaccaccatgcatatataatgagaaaacaccctaccagatttatcccaaaccccacaacatttaaaaccaaaatgcttcctgggctcatctcaaaccatataatttctaaaacacaaaagatttgaaaacattaggtctcactctgtcatccaggctgcagtacagacagcaacaggagcatggctcactgcagccttgacttcctgggcttaggtgatcctcccacttcagccttccaagtagctgggactacaggtgtgcgccactgccactggctaattttcaaatttttttgtagaggtaaagtctcaatatgttgcccaggctggtcctgaactcctgggttcaaatagttctcccacctcaacctcccaaagtgctaggattacagtcatgaaccaccaaacctggcctgaaaacattaaatttcacaaatttgtaaatatccatttgtttcaataaagatttaaggaggcttaaatatacacaatataattatctctatcactcaccagaaagtaatttacctaaggccagggatttttgtctattttgatccatactgtatccctaatagatagaatactgtatatagtatgcactacataaatatttattgaagtagatttttttttaagtgagaaaattaggcaaagaaaaaaactagaaatagcaagataaaatcaggagtgagtttactactaaaaaaagtataagctgttaggtcctttatactttctaaagatgggccatacatttggccaagtttgctagcaactatccctaagacagaaacatgatctgttatacaaataaaaaacaatttcttgggaaaagcacaataatttttaattcttatattttgttacatacaacagtatcatctgttttgtcaagtgcagtctacctttaatatctgattgaaaatatagcacaatacagtatcagaaactatactgggtaaggtcctaggataccttcatattgatttcaactctgcctctaactttgggactttggttgggcgcagtggctcatgcctgtaatcccagcactttagggggccaaggtgggaggattgcttgagcccaggagtctgagaccagcctgggcaacacagcacaaccctgtctctacaaaaaatacaaaaattagccaggtgtggtggtgcatgccaataatcctagccactcaggaggctgaggtgggatgattgtttgagcccaggaggcagaggttgcagtgagctgagatcctgccactgcactccagcctgggcaacagagcgagacgctgtctcaaaaaaaaaaaaaaaaaattactttattgacttcatttctttccttctttataaaatttataattttaaattgtgatttataaaattttaaactcttttctctttagtctactttaaatgccaaatttatctccacatattcagaatacaaaccttttcaaatatgttaaattaccttttcttatttaagtaagattttcttgcctttccatattcaaggctatttgctattttctacactcttttcaggcatagacttttttcttagtgttgtatgacctagtaaaatctcagttatgtcacattgtttttatctgtaaaatgggcataatgccacttatcctaccaaaaggttgctgtgaggatccaatggggaaaagagtgggaaagtcccttgaaatatccagaattcttattattggtcaggtaatataaatgatagcttgattttacttcattattcctcacagctgttattagccttctccacaggttggtactactctttcaaaatgacttgaaatgactgttcacaaaatcttcagtagtatatagactatttgatctaatatcatcaaaacatagctttatttttactccaacttaatacaaacaaatgtttttattaaaggaaagttaagtaattttgcaatttataattaaaataatatttggggccctaatcattaataaatactttacctttctcccaatctgaattcctggggtatctgcttccacaatgaatccagtaaaggctttattagcaggagctttaggatctggatcagaacgtgccaataaaaaatacctaagagatacacataccggataatggtgataatatcggcaaataacacatggtgattgctctctcagttaattctcttaacaatcccaattattattacctacattttacaaatgaggaaataaataatcaggtttaaaaacttgcctagtcacgtacctagtatatggaagagctagtatttgaggtctatgtcttaataacacagtaggccctcccccattccatggggtttcactttctgtggtttcagttacccgcagtacagtatatatatgatattttgaaagacaaagaggacatttacataactttttttttttagacaagatctcactctgttgcgcaggctggagtacagtggcatgatcttggctcactgcagtctcgacttccccagctcaagccatccttccacctcttctgagtcactggtactatgggcatgtgccaccatgcctagctaattttttgtttattttttgtagggatgaagtctcactacctttcccaggctggtctcaaactcttggactcaagggatcttcccacgtgggccttctaaagtgctgggattacaggtgtgagccaccatgcctggcctacatttacataacttattacaatacattgttatagttctattttattagttgttgttaatctcttgctgggcccactttatagattaaactttataataagtatatatgtgtaggaaaaaaacatagtatatacagggtttggtatttctgaggtttcaggcatccattaggggtcctggaatgtatcctgcaaggataaggagggactatagtatgctatttaactttcttttagtaatatgagttgcaagtaaaaattcctggtatagtattattattacaacaagacagtctatgcctgttgaaactggcactttttctttcccaaaactaattttattctttaaggggcatgctatcttgaaaaggagggcaaatagagctgcctgtgaaaaggaataatataaaacggagacccggccgccgtgatgctgtcccggtcccactgtgtcccgggcgttcagccactcgctctctgccttccagaaggggaactgccctctagggagacattccctgcctggggtctccttatgccagggaccaggttaccctaacagcaggaaggttgtcattaacaacagtgtcttcagtgttcgcttcttcagaactacaactgtatgcaagtatgacttggttacagtcaaaaccccagcgtttgcagaacctgtcacagagggagatgtcaggtgggagaaagctgttggagacacagttgcagaagatgaagtggtttgtgagattgaaactgacaagacattggtgcaggttccatcaccagcaaatggcatgattgaagctcttttcgtacctgatgggggaaaagtcgaaggaggcactccgcttttcacactcaggaaaactggtgctgctcctgctaaggccaagccggctgaagctcctgctgctgcagccccaaaagcagaacctatagcagcggcagttcctccccrtgcagcacccatacccactcgatgccaccagtgccctcgccctcacaacctccttctagcaaacctgtgtctgcagtaaaacccactgctgtcccaccactagctgagccaggagctggcaaaggtctgcattcagaacatcnggagaaaatgaacaggatgcggcartgcattgctcagcgtctgaaggaggcccagaatacatgtgccaatgctgacaatttttaatgagattgatgtgagtaacatccagaagatgagggctcggcacaaagaggcttttttgaagaaacataacctcaaactaggcttcatgtcggcatctgtgaaggcctcagcctttgccttgcaggaacagcctgttgtaaacgcagtgattgatgatataaccaaagaggtggtatatagggattatattgacatcagtgttgcagtggccaccccacagggtctggtggttccagtcatcaggaatgtggaagctatgaattatgcagatattgaacagaccatcactgaactgggagagaaggcccgaaagaatgaatttgccattgaagatatggatggtggtaccttcaccattagcaatggaggtgtttttggctcactctttgaacacccattatcaacccccctgtctgccatcctggggatgcatggcatctttgacaagccagtggctataggaggcaaggtagaggtgcagcccatgatgtacgtggcactgacctatgatcaccggctgattgatggcagagaggctgtgactttcctccgcaaaatcaaggcagcggtagaggatcccagagtcctcctctttgatctttaggaggaacccacacaccctacaaattgatcatgcaggaactgaaaaccagtcttctccctgtcccctcatgggtcccaggttagcctggtgacaggcacatgctgttggcctcamgcaaggaagcagagcactatgtaaccagcagtcacagcttttttcttggtgttcctgcctggctctctccctctctgcacctgtctcataccctcgaatatcttaattccttaggcttgagagagagccttaatggatgctcattcatattcctgcctttcttccatcagctctctgcaaagatgattttgcttctccctagtgctggtatactatagagaaacccccgaggaccatgtgattaagttcctatcttttgaaagtttgttctgcagagacatctaggaggatgctgtgcctcccaagctcagagcagcctctgtcctggctgtgcacattctcgattccacttgtatggagggattgaacacaggcaaagaggtgctgctttccttcttcaatggcaccttcattctccattgtcattgacttcaagatgcctcttctacctctaccaggaagcacaggccaggggatctgggtgtgtgaatgggagganagagcagaggttccctgaggtcacgtgttgtaatcatcatagaaggagagcccaggtctgccctcacgctctccatcataggctcacaccaagaagactcatcttggcacaatctcacacagctggggctgtagcaaccctttcctggttgctgggcctcattctagcaccttgttcttacttagagcagattctagcacatcatggcagtggaaccaagcgtagtcccgaagaagggccagagcctggtagagattagggaagggaggtctcctctagactcagattgccttgagcttttcaagtaagttgctgtaagcccgtgggctgaggaggcagttcttgttccttcctgcgttatagtggggccttgtctcttcctctgcaggacacagatttggaggacgtggactggggtaggaaaccaccctgagggtgttagtagatagtggtgtaatggatgaggtcatttctaagatgtgttgccggtggatctgggcacaatcattggaattccttggagctactgggattcatggctttgtatccaactgcatccaggccwgaggctgctgacatttgacactagggccagtagagagtgcctttttgtatcttgagccaagaagtgaggcctgggggtggggaggggggaaggggtgggagccaatactgagtgcctgcagcatctactactctgtcttcactattcagaacttgtaactaaagtatttaaagaaactgattttaaatgcaaattaaagggcagatgttctcaaaaaaataaataaataaaatggagacccatatgttccaactactgtttctttatgcagcaagtcagtgtttttgttatagctgagttattatgaatatttgctgattttttcctacagaagaatttctcagaaagatcttgaagtgcaacataagaaaaaaatgcaaatatccaagcatctgtctaattcatgttctatatatcctggtacacgaaaaattcttttaaaaaggtatattcttccctaaacaacacaaacttattttctttggttaaaaccaatacattaccactcattctatagttttatttaataatagtaacaaaatcgtaaaaattgttatctggtttcatatattacctaatttgccttactatatgaacagtgaacagttgtaatcagttctttctttttgttttaattttgtaaagatggggtctcgttatgttgcccaagctggtcttgaacccctgggctcaagcaatcctcctgcctcagcctccaaaactgctgggattgtagacgtgagtgattgcacctggctaatccgtttttaaaattacgaaaacttcaaactgcattgttagatttctctcaacttgttaaattttaatagtttcttcactttttattagttgctgatattaccaggaattggttaaaggtaaagatatagcactccataatactgaatatatttaggatgctcataaggaattgactgatatgtttaatctaagtaactttttagtaggctcactctgaaaaaaaatgatgttttatttgctagaaaactgtagtatatggcacacaaatatattgaatctgaattttttacaaagagagacaggtcatttagtacattattccaatcaataaaaagttattctagaaactctctatatacttgtagtgatgggtaaatacagtatttcccatgacaacttaacagcactgctgatagaaagcctgtccttatgttaagctaaattctacatttttctaactttcactcattaattctaagctggcatcctgaagtaaacatataagcctgatcatctttctgtgtaataatatttgaaaaacttcaagattcttccaaaataaccaaggctttgcttttcagaacatgttttgtaggctcctcctaatgcaagatacttacatgcttctagatttagtcaagtttttcaatacatgttttaaaatgtgttgcccagaactgtcaccattttttctctatttgatgctgtacttctattactttggcttaaaattacattggctttttaaaggctcatactattgattcttattgaacttaacagttattgaactttcctcatcttttatcaacaaataatcgagtgtttttttttagtattttatatttatacaaattatttttgatcctttgttgaacttcatattttttgaccatatattagaaaatttcagattttattaaagtcaaattctgtcttctctaatagataacctgttttaagactgactctgtttatttctgacatctggagacaggcactataccaaaggttctcctttttccttagggttttagggattccaaggagcggctggtataggagatgaggagtggagataataagccaagtagacagagtgctagccttcctaatcagattcaaacagagcacgcatttgtattttattttacacattaaacttctgagagttaatttgaaaaaacagtgcaggggcttaaaattagtttttgaaaatcactgaactgtttataatctcctttaggccttccagttccacaaacataccttaactgtagtggtttaaaaatatacagaaagaaagagagatttgaagataaaacaattaagaaaaaatatacaaagatgttttgaacaacataccaattagcttttcctccgttggttatccacatcttctgaccattaataatatactcatctcctttcttttctgctttggtctttataccagctacatcagagcctgctccaggttctgttacacaataagccttgaatatataaaaacaagagaaatgaaattaaatgttagtgattaaattttgactgtttggaaacaggattgttttattttttaagctgtattttaaatatttttaaatatctaaaattaaaatgttcttacaaaatcaaagaaaccactcaaatgtaaaaacttttctgttttgtttgtaagagacagggtctcactctcttgcccaggctggaatgcagaggctcaatgcagtcttggcttcctggactcaggaaatcctcccgcctcagcctcccgtgtataatagctgagactgcaagcacacatcaccatgcccagctaattttaaattttttgtagacatggcatctcactgtgttgcctaggctggtctcaacctcctgggctcaggcaatcctctgcctcagcctcccaaagtgctgggactacaggtatgagccacagtgcctggcctaaaaacacttaatatataattcaaattaggcataggtatatcaacaaatcatatatttaataaaaagtgaaaatgttagatagctttaaacaagttcattaaattcaatttcacatgtattcattcatgcaaacatgtattgaatatctactatgtaccacgatgtaaattaggatatggggaaaccagaggtaaaagacattcagtcctagagattttcacaatgtaacagtgaagataaataactatactgcaactctatgtgtgaaagtcagacaaggggcttgagaaactagtttcccagggcagaggatgtttaaattaagtctcaaaaaggaaaatggcttctttgcgaggagggaaaaagaggaagaatatgcattccaggtacaagtaatggcatatgctatgacactaagataagaaacagagttacccagtgtttctaatgctgaaagtaccagagttccacagtatgtaaattctgtgcatgtaagggaatggtaagacatgagtctggaaagaaaggaaggaaatggtcgacgagaatcttttatatcacattacaaatttaaaattttatctggtagaaacaggggagcctcttagagctcttaaacagaggagtgacaagacacaagcagtaatggataaaagggggtggtagaaggcaagtgttagtgcaagttaattcaagagtggccggtactgtggatactaaagaaacaagttacttgcccttaaggtacttacagtccaaagaagaaagaaactgggccgagcatggtggccccccacctgtaatcctagcattttgtgaggctgagatgggaggatcgcttgagaccaggagttcaagaccagcctggtcaacatgccgagaacccatgtcaatttattttttaaaaatatacaacaaaaaagaaagaaactatatacattttaattcaaagtagtaagcatatataggggcactagaaatgattacttagggccgggcgtggtggctgaggcttcaggtttgtaatcccagcactttgggaggccgaggcaggtgggtcacctgaggttaggagttcgagaccagcctggccaacatggtgaaaccctgtctctactaaaaatacaaaaacttagccaggcttggtggcgggcgcctgtaatcccagctacttgggaggctgaggaagaattgcttgaacctgggaggtggaggttgcagtgagccgagatggtgccactgcactccagcctaggcaacagagcgagactccatttcagaaaaaaaaaataataacaatacttggctgggcatggtggctcacacctgtaattccagcaccttgggaggccaaggtgggcagatcatgaggtcaggagatagagaccatcctggctaacacagtgaaatcttgtctctactaaacatacaaaaaattaggcaggcgtggtggcacgcacctgtagtcccagctgcttgggaggctgaggcaggagaatcgcttgaacctgggaggcagaggttgcagtgggccaagatcacaccactgcactccgacctgggcaacagagcgagactccgtctcaaaaaataaataaataaataaatataactatactcaaacatctgaagggcaatatagccaaagaaaagtacagtgaaatcactctaacatttattgaacacctattacagtatgaactggtaaaattataaaaaaaaaaatgacaggttctgtgcttaagcattatgtaatccaaaatatttttctaatgataacagatgctcgcaaatgatgctgtttcagaaggtgttgattcccaggcacctgaggtataaaaacatgtcagccagatggtcttttgacagggattctgtagaggggattcaggtgtcactcaagttaactgaactagattactctgctacctggagatttgatgtattcagcatcatgacaaattaaggagttgtccataaaagatgccccttttaagtaccaaaattttgttttaaccacctttaaggtatttttttccctgaaatatgctattagacatctgtctgtttcataatacagtgaagtttttagagcctgtgaagtaaatgagcctgtttttttctatacaaaatggcttgtcactactggttcctcagagttgtttttgtcttcttttcttctttttggtttctcatatatatatatatatatatatatatatatatatatatatatatatatatatatataatttgtgtgtgtgtgtggtggcagtctctcaacgttgtccaggctggtcttgaactcctggcctcaagcgatcctcctgccttggcttcccaaagtgttaagattacaggcatgagccaccatgcctggcctgttcttggcttcttatttgatcatttttatttattttttttctgtattattttttaccataacattattttccaaagtaaaaacccaaggagtttaaacattcaacagtacagaaaagtgaaacaatttatagcatatccattagatagcaaattatgcagtattgttacagcatgtaaaaagaaggaaggcataagaaaatgttcatgttgttaaataaagatgtacataaaactacatgtatataatgggggctaactgttaaaaacacaattacatatttaaaaatgtggtaggcactacaataaggaagtaatactaattaactccatatctgagggattacagatatttttgttctacttaaaacatttctaaattttctatactcagtattttataattagaaaagttataaaattttaattttttaaaagtttgcctttggcatccacgaattttggaatttaaccaactgtggagcaaaacccacagatacaaagggctaactgtacattttgtataacagacttggcaaccaaaaattttgatatggagggcaacaggtcctaaactattccctcatggatatggagagctgactgtatatgctacaggagaacaatctagacgtttcacacagttcttatagacaatagtgagaatgtttagctaacctctcaattgttaaaaaaaattgcaaatttcctagcaaatatgtacaaattcctttattaaacagtttgcttgaaattttaggtatctgaaataaaaaacatttattttcaaatattattttctgttctttaagatgaattctcatcattagctcaaaactaatacatctactgtatttcagtataacaaccacaccttagattgaaatatgtttgagtaaacaagaagtaaaaatccttaggtaaacaacagtttcagaatagagcgtgtgtgtgtgtgtgtgtgtgtgtgtgtgtgtgtgtgtatgtctgtgtgtgtatttatcttgttaaaaaaatctaatttaaaaatttgttgagttgctttcagaggtttaaataaactctacaactattcttcccaagtcattcagtcattcaacaaataagttgctattt

SEQ ID NO: 10684 - DNA, 15407 bp, Homo sapiens
  misc_feature (1)...(15407): n = A,T,C or G, or insertion/deletion polymorphism (see Tables 1-2)
aaatgaattcatacatactagtcagtattttcctggtttgggaaaggggaatttctttggcattacaatggccaatgtctcttttaaagatctgtcctttgtggccgggtggtgtggctcatgcctgtaatcccagcactttgggaggccaagtccggcagatcacctgaggtcaggagttcgagaccagtctggccaacacggtgaaaccccatctctactaaaaatacaaaaattagccaggcgtggtggtgggcgcctgtaatcccagctacttgggaggctgaggcacaagaatcgcttgaactggggaggtggaggttgcagtgagccgagatcatgctactgcaatccagcctgggcgacagagtgagactcagtctcaaaaaataaataaataaataaaatctgtcctttgcaacttttcagtatagggagagagagagaaaaaaaagatttgtcttgttgagtaagagtaaggtcatggatgacatggtgtgacctctgctgaagatgtcttaacacctcgaatcgcgtcatgtggcagcttcttctagccacccctggccctgcacatggtgattatgagatttttctcattggatgggagccctggaattgaggtttcttggggtgtgtttttgtcctgtaggtttagtgacgtcgacggggttcctttggaatttcagcagctaagtccgccggagctgcagaaggtcagctcaggacatcggaggagctgacagcctggagaagctgtgcttgtctgctggtagggagcacttgtttctaaagcaagattctgcaacactgacagaaccagtttcccatactgctggtggctgcaaaagatgtttcaggcttgggctgcagtgtgcctgtctttggcactgccactgttccccagtttcctcagctccagatggagcatgtctcagggaccacacagagctttgtttaaatgctcacattagcagaaggacggggatcccattgaatcatcctctcctgtcaaaaagccaagagttgttcagaaggaaaaaacagtttttctcaaagaggctaaatctctagtactaattagttgcagtagtggcatgtgtgtgtgtgtggggggggggtggcatggtaatcttgtgcctccagtgttctaaataggggcaatctttttgctcacggtctgagccatcgaatgagtaacctcgacctcctaagacccttcactgggctcacgtgtgtgtgagtcccacaggaattgtggaatgcctctttctcttgttgggtccagacatttagaatgaataaattaaagggtagtggtaacatggtcattgtcattgcagacaatgtggtatttatatatgggcactagctgtctttctcatggggctcaggaacaagggtaagtttgatctttcatcatgaaccactggggtgttctttatacacagaggctgtaccagctgaaaatagcccaaacatcttgtaattttgtctttcccaatttttgcctattcatatcccagaataaaagagcctgttcagcctttccaaagatttaaagaacattatctatttgctttctaagtacccaaaaagcacaaccgtctacattcaccttggctggatgaggacatgcattcattcatccattcaagagatatttattgccagacctggtggctcacgcctgtaatctcggcactttgggaggcagaggtgggaggatcacttgaggccaggagcttaaggctagcctgggcaacatagcgagaccccatctctacaaaaaataaaaaattagctgggcatggtggtatgtgcctgtggtcctagctacttgggaggctgaggtaggggcattgagcctaggagttcaaggctgcagtgagctataatcacaccactgcactccagcctgggtaacagagtgagaccctgtctcaaaaaaaagaaagaaaaagaaaaagaaaaggggtatttattgaacacctactatgtttcaggcactgtgctagatcctaagtgaatatcagcacatgaacaagacaaaggcgaaaagttaccaaacaagtctaagttgatttcggtatatgcatcttcctgacttctggtcccgtgctttgaccacaacccttcaccactagaccagacttccccaaataaacaactacttctgcatgctggggatgggctgtgtgcggcagcatttacgtaggnggtacagacagcagcctttcacttaatgttgcaataacaccaggctaaacaatgtgcactgacttcaaaagtgtggggtcaggtctccttcaagtgccacagggagagtgcaaagtaggaaaagtctatcggatgaggaaacactgtagagggaaagtgaattttttttcaatttgggttaaaattcagatgtggaattctaccctccttttcacttttggatccccagataggaggaactcagcacatagataatcatgaactacacacattttggttttatatgctcagacttgtccagagcatgaaatccctgccctgttggaaggcagcgccgtgctcacggaggcacacaagcacctgtctcaaagtcaccctgacctgcagatctgcaaatggcaaaaataatttcacatgtttgttctgatttgtcttcatttttaggctaccttgtgtgagctccactttttagaatgtgattttgcagtcctgaaatggataccatgagcagattgagatgtgagaatatgttagaatgatcacaggttcggatgttagtggggcaggagagggagtctgagattgtattggcctatactgtggcttctggttgagcacttggtttgcctggatgatgctctggccttactcaatctttatcattccattatccagaggacagaggatctgagccccatctctgtattgcagtcacctcctctgggacctgtttccaagccttcttctgtgttgcctggcacccctttcttacctctttcaaaccacttactgctaccctgtaagctcgattgacttgttggtcttcctatgagactggaatctctctgagggtcgggacaggcctaccctcttcattacagtgagcaccagcctccagcccagtcaatagttttgttaaataaataattgaacaaaattatttgttaaataatggtttgtcctttccagaggatggacttagtttgtcctttccagaggatggatttagtaagtctccaactctggtcataatggtgccagaaggaaagagttaagctatctggaggaaataggctcactcaaagacccttcttcttttttttttttttaattggcaaaggcaggataagtgtatttgagataaatcctggatataaaatcttgacacatcttttaggtattggccgagatgctttggacctgaaagggaagtaaatcaaatcattctaggttttcttttcttttcttttggagacagaatcttgctctgttgcccaggctggagtgcggtggcacgatctcggctcacaggaacctctgcctcccgggttcaagcaattctcctgcctcagcctcctgagtagctgggactacaggcgtgcgccaccacacccggctgttttgtatttttagcagggacagagtttcaccatgatggccaagctggtctcgaactcctggcctcaagtgatccacccgcctcgggctcccaaagtgcaggaattacaggagtgagccaccgcacccagtcaggtttcctgttaagtggcctgagatctagttgtgaatggcagtcatggccagactcaggaattcaaagcttgacctattttgtctgaagctaatattaataataagagagatgtatttggcttcataacccctttccctcccgtccccctctttctttctgtaatcaaggatagaattagaagtaccgaaggccgcagaattgctttaggattcagagcagctccaaggaatctgtgtttacgtattatgtgtgtttttccgtttccctccctttttatgagtgagaaaaaaaagcgcctaaattcccaccaacataaaccaatgacatacaatgatgaaattctgttttcacctctgcctgtgacagggaatgcaaaaatagcaagtggcccagttccacgaatccccgcctcctgccctccccgctcctgccgggttggatctctaagaatggaggttagcgcacagcctcgcgcgggccgctcagcccccggacccggcggatgatgtcaggcgacgggagcggccgcggccgggccggggaggccgcggcccaggggagctgggagggagggtggcctcgccaggccgacggcgcgcccggccgcgcggcgttgcctggagacggccctggcggcgctgtgttgctgtaaacagccgcttccctgttactatctatagcaggatctcctggctcccgggcgcggcggctggaggcaggtctgcggtccggctccccgcgcgccccgaactatccgcccgccggcctcatcctgcctcgcccctctccaggtgcccaccgcgggccccgacccccgggcccgaagagtggagaagggaagaccggggctgtgcggggacatgcgtcttcgcgccctggaggtggccagcgcgctggggctgagccccggcagcgtgaccccggctgtcctacgcagcagggcaggagattggggggcgtggcacactctggagcaccttgcctccccaaagccccgtgttccaggacgtggagccgctcctggggtcccagcagtcgaggtattccgcccaggcgcagctggacactgtccttccagcccccgtcctccaccctccaagtccgcgctggaaaatcacccgctgcgggctcccgtaagcacagcttcctggcgggaccgaaccagccctcagcgcagatttgagttccccgcaggaagcacaccccgccttgtcatcccgaactgaccaccctgcccacataaccacacctcgcactccctacccctggggcccagctcagaaccgggcagacacccccttcaaatgtcttcgcacgtaggttttgcacagtgtttatctgctggtgtctcagggatttgacagtttccttaatattcccacacatggccgagaaaaataaataaataaatgcgctgtcttctttaaaaaaataaataaataaagtacccagtatcgtaaagtaggttatcgtattctcttattttggatcctccactttctgcttccaaacgcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcawctgagaagccaagactgagccggcggccgcggcgcagcgaacgagcagtgaccgtgctcctacccagctctgctycacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcggracgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacrgtcactgccatctcgaccagtccggacctgcagtggctggtgcagcccgccctcgtctcctcygtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggrgctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaaggggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggstctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattcycagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgctaatattaaattcagatgttttgatcttaaaggaaccctttaagcaaacagaacctagctttgtacagactattttaactttttattctcacaaaatcacgtggagggttattctacttcaaagatgagcaaattgaagaatggttagaataaacaactttcttgatattccgttatcggcattagaatcttcctgctcgttatcgtatccagcaggctgaactgcctcttgatacttggttaaaaaaaattttcaggccgggcgcggtggcccatgcctgtaatcctagcactttgggaggccgaggcaggcggatcacctgaggtcgggagttcgagaccagcctgaccaacatggagaaaccccgtctttactaaaaatacaaaattagcctggtgtggtggtgcatgcctgtaatcctagctacttgagaggctgagacaggaaaatcacttgaactcgggaggcggatgttgcagcgaactgagattgcgccattgcactccagcctgggcaacaagattgaaactctgtttaaaaaaaaaagttttcactaatgtgtacatttttttgtactcttttattctcgaaagggaaggagggctattgccctatcccttattaataaatgcattgtggtttctggtttctctaataccatatgcccttcattcagtttatagtgggcggaagtgggggagaaaaagttgctcagaaatcaaaagatatctcaaacagcacaaataatggctgatcgttctgcaaacaaaaagttacataatagctcaagaaggagaagtcaacatgactctgaacaagctttaacttagaaactttatcatcttaaggaagaacgtgacctttgtccaggacgtctctggtaatggggcacttacacacacatgcacacgtacaaaccacagggaaaggagaccgcccttctgcctctgctcgcgagtatcacgcaggcaccatgcactatgttttcacacacactgggtggaagaagagcttcagcgccagtcttctaatgctttggtgataatgaaaatcactgggtgcttatggggtgtcatattcaatcgagttaaaagttttaattcaaaatgacagttttactgaggttgatgttctcgtctatgatatctctgcccctcccataaaaatggacatttaaaagcaacttaccgctctttagatcactcctatatcacacaccacttggggtgctgtttctgctagacttgtgatgacagtggccttaggatccctgtttgctgttcaaagggcaaatattttatagcctttaaatatacctaaactaaatacagaattaatataactaacaaacacctggtctgaaataacaaggtgatctaccctgtaaggaacccagctggtgggccaggagcggtggctcacacctgtaattccagcactttgggaggctgagacaggaggatcactggagtccaggagtttgagaccagcctgggcaacatggcaaaacccagtgtgcttctgttgtcccagctacactactcaggaggctgaggcaggagtatgacttgagcctgggagggggaggttgcagagaactgatattgcaccaccactgcactccagcctgggtgacacagcaaaaccctatctcaaaaaaaaaaaaaaaaaaaaaggaacccagctggttcctgtaggtgtgcaataataacaaccagaggaagaaaaggaagacgatttcccagatgaagaagggcagctggaccttcggacattgacctgctcctggggacctcaatcatggtccctgtcagccccatgcttactctagagggtgagcattgctttccctttgacagccctggccaaggcccagacacagacccttgctctagcttattgcacagcccagtggagaccaggctgctacatcaagatggcgttaaaggtccagaaagaggaaatcagagaccatcggatccccagggttgacatcccaccaagcttcctgctgaccactttcatgggcttgagagaagaaattccttcctcctttctccagctaaatggctccttccaaatcccttttactcactcaggactggacaactctcagggattattaactctgggaaattttttgtttttgttttttgtttattttttttgttttttaggcagggtctcgctctgctgccatctcggctcacttcaacgtccgcctcccggcttcaagtgattctcctgcctcagcctcctgagtagctggaattacaggcaactgccaccactcctggctaatttttgtatttttagtagagacagggtttcaccatgttggccaggctggcctcgaactcctgacctcaagtgatccccccaaccttggtccccaaagtgctgggattacagatgtgagccaccatacctggccttcaactttcttttgaaaaagactttgtcggattcctacccacaagctatggcctcatgctaatctcaataaaacaactacctgccaggcgcggtggctcacacctgtaatcccaacactttgggaggccaaggtgggtggatcgcctgaggtcaggagttcgaaaccagcctggccaacatagtgaaaccccgtctttactaaaaatacaaaaaaattagctgggtgtggtggcgggcacctgtaatcccagctactcgggaggctgaggtaggagaatggcatgaacctgggaggcggagcttgcagtgagctgagatcatgccattgcactccagcctgggtgacaagcgtgaaactctgtctcaaaaaaacaaaaaacaaacaaaaaagaaaacaactaccagagagcaccactattcaacattgctaaagacatatacatataattgaaggggatagaggcagaagtcatttcctcatggggattatgtccagtttagctcaccaggatccccagaactggctcagtgcctggcacatggtacaaggttaattaatattttgcccagtggatgaataaattctgtgctatttccatacacagaaatatattccacacatattctttaacttctcctctcctggtccctgttagtatattaagcaatgggaattttacatcttttatgtctggctgcaaaaatataccccattcccatccttgcctcctggaattccttcactgtcttcctggatgacctctgccaattcaacttcaaagctgccattgggcttctggctccaaattaattttcaatgggaagagggaagaggaaaaatatttatctctgtagaatagtggattgtagattctgcatcatctttgcacatcactgcatcttgtgtaattatcaaaattaaagggtaggatttaacaatttgttctaataacagtaattttgtatcaacagcaattcccatgtgtgaatgaaagtaaatcaattatgctatctttaattaacggacaaaaaaaaattgaggcacagtaaaagttctcagttgattatcttgaggtaatcgtctaaagtttcaatgtttttacagttgaaaaaaagctaaaacaaaattgatctctaaatggtgtatgagactcattccaaacagagtaaccaaactcctcaaaaaaaaaaaaaaaaaaaagagatatgagcctcacttgaatgctgaatagcagaatgctttaaattgtgctgttttcctattaatattaaagagttgacttttaggaagtctcactcagggtcccctgtctctctactgaagagagagttattctcctttctctttcttttgcttattaaacctctactcctaaacaccacccctccaccaaaaaaaaaaaaaaaagttgacttttaattcctctcccactctatctcttttccttcttccctacaggcactctgctcacgagccttccttccactcctggcacatagaacacgtactcctgcagcagggcctctgcacttgcagtccctctgccggggcctcttgccccaggctggcggcatcctgtcatttgggactctgctcaaaggacatgtcctccaaggggctttccctggtcattctatctagggtgacttcgggacatacttgctccctaggactctctatttagttatcctgctttgttttttcacagcctgtatccctacttgcaatatctaatttatgtgttattttccttttaaaaaattgtctgtctcatcgggtgcagtagctcacgcctgtaatcccagcactttgggagacctaggtgggcggattacctgaggtcaagagttcaagaccagcctggccaacatggcaaaaccctgtctctactaaaaatgcaaaaattagctgggggtgggtggtgtgcacctgtaatcccagctactcaggaggcttaggcaggagaatcgcttgaacccaggaggtgtaggttgcagtgagccaagatcgtgccaatgcactctaacctgggtgacagagcaagaccctgtctcaaaaaaaaaagaaaattgtctgtctcttatccctgaactgtaagttccatgtgagcaggaaccttttctgtcttgatcacatttgtatctctagtgtctattaggccctcaagtgcatgttgaataaagaagatgaatgagtgaatgaatgcagatgaaaattacaaaaatattgacagggacatagctagaacttaaagtgaagataaactatatacttcacagatttttttcagggtagaagagtatgcccatttgtttaaaaaaattgccttcgaggattctacaatattaagatgaggagctagctagcttgggaaagaattttaaggggtacaaaaaatacaagtaagctgtaggtcagtgacacttctaggctaattataggttgagaaattgtttcgctattaaatgcagaatgaatgcatatataaatttagatataatcattttcaaagaaacaaacaaaattatgtttttcactcttactgctataaaactttcagactatcacaaaaatcccatttgagttcaatggttcctagcaatcagtgtgctaaatggtaaaacctataatttagtctgcattaaaatagaagaataagggttagctactatcattattatcacatcaacatcatcatcataattatcatttgccaagaatatgcccagacctgaggagaagcaggtagaaatagggtacattgaatcctgaggaatcagtgcaaagtctctgaagggggatggttggatagatttccatttcctttgcatgcgggagaaagcaacagaaacgtaaaccagttccgttgcaacacaatttattttcgtggttccacacatctatttttggactaaactaagttgcctttcctttgcccaagcattcttcagttgcttaagaggacacagagcagtaagggctctggagcctgcctggccttatggccatcagctctccatttttttttttctgagacggagtctcactctgtcacccaggctggctcactgcaacctctgcctcctgagttcaagcgattgtcctgcctcactcccgtctcagccaccagagtagctgggattccaggcaactgctatcatgcctggctaatttttgtattgttgtagagatggggtttcaccatgttgcccaggttggtctccaactgctgacctcaggtgatccgcccgtctcagcctcccaa
